United States Patent 10,407,724 (METHODS AND COMPOSITIONS FOR SCREENING AND TREATING DEVELOPMENTAL DISORDERS) - sequence listing, part 59

SEQ ID NO: 1610 - DNA, 577372 bp, Homo sapiens
gtagtgtccctaacatttatttcaggtggtgactaggagggttgaggtgtagatatacttcctctcttctcgtggagccttactgaagacaggatcgccgttcttgtgtttatcagctgagaagggcagtctcgccatcttaaagacctgccctccagccccttcaaacgccacacttcccaggaagcactctctccataagtgttcagagaaccctgaccagagaagctcccgcacttcttatatgaactccgattgtgctgagggggaggggaggagtacacaaagcaggaggtgggtggggaggctggggtcacacagcccaggaggggcacacccggcgaggtgctccgtcagcacaggctccctcctccctccctccccccagtacaccaggctctgaccggaccggtcccaccgcagagttcagcggcatcaagtccaaggacagaactgcaagagtatggacacaaaacaccaaacaaattgggggtgggctcccggccagcctggtgagagagaggctcctttagccaaggccatttctggcttgtcagcctccagggtatgggctatgagcagcagtggggagccggggtttctggggcagctcagtgctgggaagacgtcatccccttctccccagggctgtatgggagcacaggcacaggggtaggtagagcttctggtcagcgaggggtagagcccacagagagaccagagagtggaccgcagtttcatgaaagcagagttatagctgccacttgtgcctgtgggcagagcaggtggtagaggggcctccaggaaagggccggggacacgggtgtccagcactaagcacagcgcactcagccgcagcctctgtctgtctccccacccgcccacctctggcacacagcacctggggacccagatttgtgcttgatcagagcttcgaaggaaggcagtggcagaggcgctgggaggctgtcctggaagtggccaattctggtgtcctctgcaaagtacccctcgtccctggacaaccagaacgtgccctgacctcttccctggcccgtccccacccgcggtgtgtgatccttagacgtgagtctgcatccgccgctgcaggggtcgactggggtcagagttctgggacgaggactgggagtggtgggaggaggaagcagaagccttgctggccttgtcgaactgcacatagccatcctgcttgccgctgctgctgacgctgctgtcacactgcgtgtccaggaaggagctgctgtcgctgagggagcctctctggaactcccgctcacaaagctcgatggacgagctgcccatgcccagcacaaaccgctgcccgtagtcgtagaggcggccctggccgctcagggtgctgtagatgttggtgaaggacatgcctgtgggcacacgctgcttgcccgcaggacgcaggtcgggctggcagctggagagggagatggtcggggttgagtggtgctctttgaaggtgttgacgctgtagtagccattggtggggtcctggatgggcgagaggaagaggagcgtcacctggtggagtctccactgagcgtggctggggtttccaggctgagcccgtccccttatgcggggagggaagagggaaaacaggaggaagggagcaacctggtagggagcaaactcaggggtgaacagctgcagggaaggtgcaggggaagaaggacactgaacaggagatggcagaagggggactgcggaccccaggaggggagggacggcaagggtgagggctgagggccgaaggagggaagcagaggctcttgactgggtttatgtcagggcaatgcagggtcatttgaaagtcaggctttttaattgtttttatccagaacatggatgcttcattttgaatctacatgtgaggaggctgtggaagagaactggggagtctcagccttagctctctcagcctcctcagcgttggggtagggagaggaggtgccttaggcagggacgggcacctgccaccaagctggcctctgaccttttcttctctgacttgctgtcatttgttgtatagatttggggtttgggccatcagagctaaagaccagattccatggctgtgtcttataacccggggcccttcttaccttcaggttctgaaactctttctcctcttctttgaggacctccagctgtttcaggactgagtcttgctggaattcaccccggtccatctgcaacccaaaaaaggctgctcagtagataggaggtggctaaacctccacttcccccaaggaaaagatgagatcagaaactcaaaagattgccctgtataacccccaccacccctcactgcctggaccatgtgaaagagtcaagatgagttcctggagccccatcctaggagacagggaagcagttgaggggggtgggtgagtaggtgaggtgaggggcagttaggggaggcgaggggcaggtatccgaggccatactttcctcgcttgggcgagggcatcaccagagatctcccatggctgattcaattccattgactgaacgtttattgtaaaatgccggccagttgctctgctaaggaccagagatccacagattaacgtacattaagatacagctctgctcatcagggagatggacttgtagataaataatttcagaatgtcagtcactgggcatggcaaggctccttagggcagtttcttttccagcgtgcaggcctagtgcaggccttagggagtcacaaggaataaccatctgtgagatgctggcgacatgggccacacctgttattctcatgaaaagttaacttccttagagatgccaaacagcctgagggcaaggatcacttcctgcttgtctctgggtcctcccacacctggttcagtgctttgcatgttgtggtcactgaccttgcctgcttttgggatggaatctcttaattatttgatttgccaatgcctagcacagtgcctgatatacaatagagctgcttcaaatggtatgtatatgttgaatgaataggcaaagtggcttagctctaaattactgaaaattaacaaaattattagacataagatgaaaaagcatactccacacacagtgggcatatgaattaatctgaataaccacagtgatgcttaacctgtgacacacgagaggcttgccatgtgtctctgctagttgcacggtataggtagtaggttccctcctactctctgggccgggatgtttcttctcccttgcaacctgctttcctcgtttctttttggagccctgtagaatcagccaaagtgcggccacccggctgcctcctcactaaggagaccatgcggttcatttttccagtaaatgctctggcactgtctggactggagaccttctttcccatcagattcaacttctaagtctgccccttcttgcagatggggctgtcttggggccaggaggtgaagggaatgcgagaatgacgatatcctcaaggggtggcttagcccagagccctcagcaagtcccttctgctcccacctgacactgagctgcccccactcttgcctgtggatttggactaagggatgtggagacagtctgaggcaaacagaatgtttgccgatgggagagaattcaaggtcccgtttgggatgaaggacacacatgattaagcttaagtatagagacgtcatcccttctcacatctaggctgtggtttcctccctcgtaaaactaaacactccactgtgttaattttaacagtgtcaggccctgtgttaggccccaggggaaatagatgagcgtagactcagaaacatgacctttgcccttgaggagctctgggataactggggaagctgacatggaattgggggaatgcactataaaggaggcacatacaaagtgttttgggagagcagaaggtgcacagctccgccaggggtggggaggacaagcccggaacatcttggagttgattgttatgggagaatgtgagattcaacagacaaaattagcaggcagagagaacagccggtgcacaggcctttgaagtccaaaagattcgaaggccaggaatcaagctctttggcatgtctggaaggccagatgtacttggccggaaaatggagctggagaggttggtggttgcctggcactgaggagccctgatggcacaccaggaagttgggctttgtccagcagatgtggggagccaccgagggattttaagtgggcaagtaacaggaccagatttgcattttagaaaggctgctttctcaaggctctcgagggtggattgagaaaagagacaaaagactacaaggctgagaccaactgggaggctgctgtaatcatccaggggagcaatgatgaggcctgaagtaaagaagtgatggtggaggacaggtggggcacacatttgagacactttttgaagtggaattgacaggacctgaaaatcaattggagagagaaagcgtagccgagggaaaagtcagtttgattcagtaaacgtctgtgagcctctaccagggcctgtgtaaggctccgaagaccccgggatgaacacagcagcagctgctcaccctctagcaacataaaccgctaatatttcttgagcacttattgtgttccatgggcttcaagcccttctgagttttgtccacttcaccctcaccacagccctgtatactgtggctttcagacccatctcatggatgaggacatggaggcaccagaaagcccatctactatattccttgctctgctgcctccactccaacatgttacgaccgaggcaaccagaaacttctagcatggttgtccaggtttctgcttggacaactaggtagatgatggcccataaatggggattcggaagaggaggagcaggcttgatgtgcctggagaagtgatgagttgactggcaatccagtccccaaggaggaacctgtgtttcttgcagactgttttggtggggtgcgggggatgagggagagggacatgtattgaatatctataatagctatgtgtgtgtgtgcgggggaggggaggggattatatgttatataacaacatattgtggcaatttatgcatatgtcttttctccttactgaagagccaggctctctgaagggtagactgcatttttgttgttgttgttgttttgagatggagtctcgctctcacccaggctggggtgcagtggcctgatctcagctcactgcaacctccacctcctgggttcaagcaattctcctgcctcagcttcccaagtagctgggattacaggcgcccgccaccacgcccagctaatttttgtatttttagtagagatgtagtttcaccatgttggccaggctggtctcgaactcctaatctcaagtgatccgcccaactcggtctcccaaagtgttgggattgcaagcgtgagccactgcacctggcctggactgcatcttagatgtctttgagtctgccagaacacaagcacagtacagcaggcacacactcacatttgttggctgagagtgtgtgcctcacctattgtggggtgggcagggggcatcttgaacgctgctctgctttttggaagcatctagttcattgagaagcctctagtcccaggaccttctgggaatggagtcacgggatgggatggggcgtaattgcattcttaccatcagctgcttgatggtggagtgctcctcaccctcccgaccagaggctggttccttgtggacaatttccactcggatatcatttttggctgacacaacacctttgagatctggagataaaatagtaaagtgtagatgatagatttagttcttacctttgagatgtcaagctcccttgcagtcccctgcccctgccctgccaccctctgcatttcccctccagcccctgaactcagcagcttcaccagccccccaccaatagaacctccatatggagatgctgtgggtgtttgggcctcagaggaggctgaccccatggccggcctgcctcctgtcacatgcccctcagccatgcacccttggcttgaaagatcgtcttcagccacttgtccgccttactgagctaggtccttttcatcctactgaattctcacttccttctagaagtcttctctgacctgctctaccaggcgggctccaatccctccattcatagaaccataaatctcagtgttggaaaggacctcaaagtgcccatggccaacccccatccaaagagaaacgcccctgaggcagtgggcagcttctctgtcgacgcctccgtgatggaagctttactgctacttctgcaggaggcaggctgtttctagttggagagctctgttagaaaattcttggctgggtgcggtggctcacgcctgtaatcccagcactttgggaggccgaggtgggcagatcacgaggtcaggagtttgacaccagcctggccaacatggtgaaaccccgtctctattaaaaatccaaaaattagctgggcgtggtggtgggtgcctgtaatgccagctactcgggaggctgagcatgagactcgcttgaatgaacccgggaggcagcggctgcggtaagccgagattgtgccactgcactccagcctgggcaacaggatgagactctgtctcaaaaaaaaaaaaggaaattcttgaggagctggtgcggtggctcacgcctgtaatcccagcacattgggaggccgaggaaggcggaccacttgaggccaggagttcgagaccagcctgggcaacatggtgaaatcctgtctctgcaaaaaattaaaaaaatagcaaggcatgatggcacacgcctgtaatcccagcgactcaggaggcttaggcacgagaatcgcttgaacctgggaggcggaggttgcagtgagctgagatcgtgtcactgcacttcagcctggccaaaagagagagaccctatataaaaaaaaaccgtatatatatgtgtatatatgcgtatgtgtatatatttgtatgcttccctataatttccactgagacggtggtgatggaggtcctgagaccacatcattgctggggtggtcttgagagccaaggctgcttagctcggagtgcagaaaatgcaaggggaacagctttcttcaaacatgtgcaggctgccgagtggcagaggagcagacccattctggtgattcattttttgcattacacttatataatgttagtgccagatggggccatcagagtcatatcctcattataaatgaggagacaggcctggaataactgtggctggcccagggtcatgtggcagaagaggtgggactggaacactgtgtctccattgtcttcacctgttctctgccatccaatctctcacacgttatctcctcggtgcacgcaattcttcaagcgtgcacaaacactagaattttattggtaatcactgaagacctttaaaagttttctcaaagcaattcctttattgcttccccacccactcccccacagctgtgtgagtgacctgcttttctggtgagactagcagctctttatttttattttgttgtagagatggggtctctctagactaacagctcttgtagagcaaggatcaaaccacaaaccgcttttccccctatctttctgtacagttcctgactgaaagagctatgtgttcaatccaaaatgctggctgccctgcagatgaagttcagtctagtccaggtcaacctcagcctagcgcccactctgccaggcgccatgttgcccaggctcacatacaccgatgcatcagacccactccctgccccaggagctcacagcactgttaggacccctgttcattgcactcctgcttacttgctctccggggcagcctaagcctggcctttttctctgtccccctccctgagatcccggatctccctcccgtacttctctgggaacgggcacagcagaacgccacgatggttgccataaggacgaggaaggccacaccagctcctacggccaccccaatgatgacggccatcggcacagactctgtgggagagaagcgggcacagctgatgacggatggggaatggcctactatccccccatgatctcaccccgttcctgcgggggcagcccctgccacatggggccctcctgggaaatgcctcagtggggcctgggcaggcacaggccgagtccaactggggtcagctctagctgggactgcaaagaccagggtggaggacacaggggcttggtgggtggaggagagggcaggggaactgaggtaaagggcagaggaaggagagcgaggcaggcagacacggagaagggagggccaggggacaggaagaccggagatgaggggtggggctggcacgatggagctctctctggcattaaacaggaatgctctatcacacagcggccagtgagtcataggccctggctttttttgaaaaatgactatggtcactgcccttgtttgttccgtatgttctctccttcccttccctttctcgggtgaatatagaggacatccggctcttagtgtttgcaggtctaagtagcttccccgcaggtctgctgggcatcagttgtggccctcaggtgtccaagtctcagggtccagggagcagggttacagcttctccactgccacctctctaaggagagaggcccctttccctccatctccaggtctgcagcttctccctcaaggctgcccctctgagcatccttgcacccctcctggcaagagaggcccacacactgggcaggcaagccctcacccctgctgagtctctgtggcctgtctcctgcccaagccgagtgggggtagggacagggagggtaaggatagagtcgggggtgatcttccacacagccttggcccttctacagctgcaagtggggtcggagcacatgatttagggccttgaggaatccatcaggaatagaactagagaatgctggggcagggagagcttggggctctcactgaggtccggagaagtcaagtgatttggccaaggacacacaggagctgcccagccagggtcaatccaggtctcctctcactgctcccacccctccactcaccccactcccaccccgtccagctccacccacagagtgacatgtgagatcccccacatctcatgtgctcggtaccgcccagactgctgctgctccgagtcctggctccatcccttctgctgagcaactgactttgcctctcttatatctgtaggatggggataatggtaccggcccctctgagggttgttatgggcttgagctgggtgaatgtgggcagaggccttggagcagagcctggcacccagccctgtttggtgtttgctgttgttgttacccaggaaggggtcaccagcagttcacggtcttttatttttgggatggagtctggctgtgacacccaggctggagggcagtggcacgatctcagttcactgcaacctccgcctcctgggttcaagcgattctcctgcctcagtctcccgaatagctgggattacaggcacatgccaccatgcctggctaatttttgtatttttagtagagatagggtttcaccatgttggccaggctggtctcaaactcctgacctcaggtgatccgcccgcctcagcctccgaaagtgctgggattacaggcgtgagccatcgttcccgatcagcagttcacagtcttaaaggccaggaaagttcctttgaaagactgagcccctccccagcctaccctgcgttcgtcagtgtgggcgagtggggacagctaggtatcagttctgggttgtaagcctcttgctgtctttttctttaaagggaggagaaagacctcaaaccctggcctctgaagatgctgctgggaggaggtatcaaggggtgggggtagggtggcagccatttgccctccggccagagggagctggcgcccctggctggcagtgttgctggttaagctggcacatccctttgccaccccaggacttgcacacgaagccattggttacctaccaattagtggccaggacagctgtaggggtgacagggaggggaccaagaggaggtggaatggtggacacttagggattgaaacgggaggtgctcgcattggttcaacagtcagactgagaaaaggggctgggcctcagcagagcttgccttgaccaatagacgacaacgtctctaggtttagttccatgaagaaagggaaactgctgtggcagctcattggttctctgcttttgaattggattgatttgggttggtttctcctcagattcctagtaagtttccttggaaaaacacagggcttgtctcagcggaactcagagccaaagcatgtccatggaaggctcttaacacctctgggcctcagtgccttgtctgcaccctggagagctgggcagcagcattgaaggtgccttccgatcctgggatccccagcccacgtttccacacgctgctgacggctgggggaggggtgccctcttagctggacaacggtcaccagggaggtgggcagggggagagcagggggtcctgtgggggcgagtgccccggggtgccatctcttcccagtccccagcctgcctgtgtgtgtttcctccttgcctggcttcctgaggtttggcctagggcgatgtgcaggcccctcctctctgcacagagccttccctgcatggctcctggagagggactggagggaggggctgtccccactcagcctcccctccatccaaggaggtgtgccaggcaccaggagccaccgaggggggaaggtgttggggagctctggatgagtgtcagcagacacaggagacacggagacaggagacaccaccctcagcactagcatggacccggggagaaggcagcgggaggctggcagctttctgggttgccccagtgtgggctgcaggggcctctgtgagcaacctgtgccctgggttggtgctctgataggggcatgtctgccaggaggggcagaggcaggggcatgaggatcccacgtggagcttgttgaggaggtaacagaggccaggggccagtgtggcaggaggcctgggatggaggaccactcaagtcttcagcatggccatagagcctggcttgctggtcctgattctcttttctggttttctgctcggggtggggttgagagcaactccgcccagggggcctgatgactgctttgctgcgtgtgcctggggagggaggcgctgccctgcagcctcagcttggggtgagatgacacttccatggggactgcaggagtagggaggggtggcaaacagcaagcatggattgcacaagccacagcaggggctgggggcccccggtgtcctgggaagcagtggccaagctggtgatgatgtggagaagcgggaagggtcggagagagcctggaagcagaaggcagtcaggacaggggccagctgaccccagaggccaggagtcagggctcctgaagagaaaggatggaaggaatggagcggggacgagcaagagccagtgtcccagagaggaaggagttgtgggttccggcggcaggcaggagacaggtctctggggtccctaggcccaagctggctgggacctcctctccccactgctttgtctacactaaaccctcaggacgggggagggcggagacactagcggccagcacaggcctccctaccccctgctgggttccctccccagctagccaggaagtcccttccccccttcccagggccattctcatcatctccttccgtacctgcttccagcccggctcccgacttcatttccgaacctgtttggaaataaagcaagcgtctacagccagggcctggctggccagggtggggtgggactgggaattagctgcttgagcggggctgggtgaggggctcctttcccagtcatgtctctgggaccccccaacagatccaggctagcccagctgaacttggagttcattcaggctgacttagagactctggaggggctagggaccggagagagatcacgtctcggaggggtctgggagggttggggtgagaacactcgggggagggcatggggatgggggcaccaaggggaagacacggagggtaggcaacaggggaccaggaaggtttgggatgatgtgtggatgatattatgcaaattatgtgcaaagcattatgcaaagcagcacctattagggaagaggtgttgggagatgctgtgtgatttgacccataggtgtgatcctggtgtggcccactgaggcctgggggcccagctgagaccacccacttggcctagaatctcttgctgggcctgacagcctgcgaatggacctttacctaagagggtgtcagagatcgtcaggactgaggcctcctgggcctcagaggcccaggcccagctgagcacgaatccctggtccaccatggcttagcccctgctggcaaaagggcaagatcaactgcccctctcagaacccggcttgctgctggctgtggtggggcttctggagccacccctccgtgcccctccaaggctccccatcctgttgtctgtgcctgagagctctgagcagacgctggagatctgagcctctttgaccaggagctgggacgtcagcgcacgggggcacagtggggtgaggcttgttcctcctgcctcctccctctcacccacccggctgctttgcccagcgctgcctttgaggtacaggggtccatgtgcctcctgggtctgcaggtcatctgagcccagcccccgaccctagggatctggacaagcaagcctaaccccttagctttagcctgggtgccctctgtgggacttgtgtctgagtaactggatgggcttgtcatcttaactgtgactgggccaggttcccagcacacccatgccagtgtatcccacgctccacccaggcatgacactttggtgtcagaccagggcccatggcagagggcagggcacagaagccagggcctctggaggctactgggcagcttgtcactgccaccagcctgctcactgttgtggtcacctcccactgaagcatcgccctcaagggctgcccctctgagctgtgttcttccctttcttggttcctggtggaggctcgtgccccttgcttcagcgagagcctggctgaggaggctgctggctggctaggctgtgtggtcagccaggaagagcactgtggcttgtccttgggccctggcccaccttgcagccacccgcgccctgacctaggtgaggagagggccctctggttccatcgttcgttgttccctcatggccctggcagctctcaccttgctccttgagccggatgatctcagtgtcggagccgaagctgttccaggccgtgcagttgtagatggtctggaagtcggcccgcacgatgttgctgatggtcagggtggagatgacgccctcctcggtgctgatggtctccaccgtatagcgccccgatgtgcccgactccagaacgttctccttccaggaccaggcctgcccgggggcgcagaatcaggaggagaccccaccagaggggcccaggacacgcccacaccagagtcacagtgccactgtcctgctcatgttcatgctcactgccacacactaacacatgtgcacacgggtatgtatgcaggcacacatgccacacaccacaaatatgcacacatgcaggtgcacacacaacacgcatcaccacacatgggcatgcacagcatcccacacggcacccacatgcaggtacacgtgtgcacacacaacacacaaacacatcacacgtctatacacagctccccacacatggccaacacgtttatatacatactacacacaccacaaatgtgtacacacagctctgcacacacacaagtgtgcacccactataacacacacatcaccacgtacacataccaatgtatatacacacaggtttgtacacacacaccacactacaaacatgcatatgcaagtacatgtaccacaacacacataaacatgcatcacaacacatgcacacaccaaagcacacaacacatcacagtgcacacatgcctgcacatatgtgcacatgtcacaacatgcatacacacatcacagtacatgcacatcacacttcacactaaaaacatgatacagacatgtacatacacatggcagacacgacaccacatctacacgcaacacacagccactccccgaaatacatgtacacatgcacacacacaccaagatgcacgcaccatatgccacaatacaacacacaatacaagcatgcttacacacatgtacataccacaacacacactgcaacacatacacacattcgccatacacaccatcatgtgtacttacaggtacacacactatgacatacacacacaccatgtgctcacacacacaagtacacacactaccaacagatacacatgttcacacatgccatgacacatgtacacggtaacacacccacaccacacatgtacacaatccacaaacacatgtacacacacatactctggggcatcctcagagggtctttccatcccagaaaggggcctggggagcatctttctgggcaaagtgggtgccctgttggcctgcgcactgcgcctccacacaaatgccccccgggactgtggctgcctgggtgggtgtgagttaggacagcagccccatgaacgcgtctacctgtgtgatgttgtatgtctgtgtgagaaatgtgtctacagagctgtgtttgcgatcaccttcgtctgccttagtttacagggctgctggttaacagttttcagagccggccacatacactgtctgcacctcatcgtgtaagcgcctcgtatatcctggttcggggctgatgagagggactgagtttctcaagcttgctgctattgtcacgctggactgacccattcctggccgtggggctctcccaggcattgcaggatgtcagcagcaccctggcctctacacacccggtgccaggagtatcctccaagtgatgacaaccaaaatgtctccaggcactgccaaatgtcccctggggccagtgagaaccgctggcctagaatcagatatttctggagagaaggtgtgaaaatgtccaagagtgaatggaatatttgacaatgagcatgtgttacatttataattaaaaacatcaaaaagcaaagtgaatggggaggcgtaggtattagttttattcatgagttcttgcaatttttttgtgaatctttcagacagtgaatgaactgaatgcttgagaaagcgtgtagcagcaataatactctaataatatcttagttaacaggatgacagtttcagttggtgcagcctgggtgtctcagcccccgcatgcacgggttaggggtgacctcagctgcttcacatctgggccagccccaccctccctgcacaactgccctgcccactccacccctggacagtcttctagcaggattttgccatacactgggaattactacaaataagttttccccgagtagtgctataaaatgctcacttttctttgttttcatgcctgagatccctccagttttagatggatttgagtacaagactctgcccctggatcacctgaggtcaggagtttgagaccagcttggccaacatggtgaaaccttatctactaaaaatacaaaaaaattagctgggtgtggtggcaggtgcctgtaatcccagttacttggaaggttgaggcaggagaattgcttgaacccaggaagtggaggttgcagtgagccaagattgcaccattgcacccagcctgggtgatagagagagactctgtctcaaaaaagaaagagggaaaaaaagactctgccctcaccttaatttttttgttgttgttgtagagacagggtctcactatgttgcccaggctggtctcaaactcctgggctcagtcgatcttcccacctcagccttccaaagtgctgggattacagacatgaggctcctgctcagtaagaccctccctttaaaaaaatgcagatactggctgggcatggtggctcacgcctgtaatcccagcactttgggaggctggggtaggaggatcgattgagcccaggagtttgagaccagcctgaccaacatggtgagaccccatctctactgaaaatacaaaaattagcgaggtgtggtggcagatgcctgtaatcccagctactcaagaggcgctgaggcatgagaattgcttgaactgggaggtggaggttgcagtgagccgagattgtgtcactgcactccagcctgggtgatagagcgagactccatctcaaaaaacaaacacaaacaaacaaacccaaaaaacacacaaacaaaaaaaccaagcagatagctggtaggaggcgctgagggtggactcctcagttgccttagctgcattgcagggataagttctttgaggaagggagagagaatggaatggtcactttagaggggacgattgataggcaacagggcaggctaccatggacagtaaaggccacagagacctggcaaggagggctccaggaggcacagaaaggggttgccaactattacctgcgctctaagattttgctaaagactggcctggagcccaggaagagaagaagtcacttgtcttttctctccactaccctcgtgtgcccctctgcccttaggatgcggaatttggtcagagccgttcatgtcagagctcagcagaatggcagctgaaccctgggagagcactgcctgttctgagaaaggcctgcaattgtgtcttcacgatgcttttccaagacagccaaggcaggtataattttcctcagcaagaaagaggaacctcggaggtgtgcaccgcctggctggccacccaggtattggcaaaagtgactgttgggctgctggcccggcccccgcccgccgtccctggagcactcacgatgcggtccggcggcggcgtgctccggatgaagcacttgatctggcccttctcgccgtggagggcgtgctgggtctgggtgctggagatgatggggggtcctgttgagaaacagcgtcccattaggcacccgggaagggcacgtccctgctggcgccctcttgggtgggttcagaagtgtattcattaatccaagcattcagcaaacatttgccgaaggcctgtatgtgcaaggtaaagtgcaaggtagaggactcagagataaattaggcattcagtcataaacctctcaagggatcatgagcgaatgcttctaagtcagaacccccagaagatacaaataactgtaataaaaggtggtgagtgttagtaccacaggagcggtgcagataaagtgctaaccgacttcagaggagagagaataattctatctggcggacggggaaagctttagggaggaggtggtaagcctgcagagggggtggggaggtgtctagatgaaggaagactcccccgcctcagccagcggcacccctgcgagccattcctcagatatccagtagagggcgcccttgcctaacaaatgggagctgctcggccagacgggccaacgggaagaaatggttgctgtccctctccttagggcgggaatcaccccggacagggggaatgcatgcgctggccgtgttcacagccctcctcccacctgtgtctcaggaggtcctgcagttcatcatcttgtctgcctccacgtccatacccagactgcccaagtgaggccatggctcccaaactgaccccaatattatcatatcacagagtgtggcacatgtttatgggtgtcaggttctgagagcgcctgtctcattcaccacattgcacagccaagagagttcacctggtggaggggagcctgttccccagcgcctcctgtccagttccgcctgttacctaacccaagtctttcccctgtgacgcctgcctggccgtgaaagacaaaagaaggagcagctagcttagcctgggctctgctggcttcctggctgggctgggtggttgaaggatgggagtagggacggaaactgtcatgctccctttccaatccctggggtcacagttgggacttagatggcagataccagaggaaagacagccgggagcaacgcatctggagaacacacagaattatgcaggaacaaaacaaaaattgctgcaaacataattgctgtttattagccaccttaattaaagcagatttgcatttctatgagtagctctcagccaagggagaaaaggtactgtagacactccagtgacttctgttgagtttgagaaggcaaaagggctcggggcagcgtgaggtgggcgtgggggaccctccatggctttaagaatgggctgagcgctgccctccttcctaaaaatccttcagctccaacaggtctaggacccaaagagatgaggagattgatgttttaggaaccggatggtgctttgttttattgctggactaaaacgtgatgataatataaaaccttttctggtcaggtgcggtggctcacacctagaaacctagcactttgggaggctgaggagggtggatcacaaggtcaggagttcaagaccagcctggccaatatggtgaaaccccgtctgtactaaaaatacaaaaatttttagtatttattatttagcctccctacttgggaggctgaggcaggagaattgcttgaacctgggaggtggaggttgcagtgagccgagattgcgccactgcactccagcctgggcgacagagcgagactccagctcaaaaaaaaaaaacaaaaaaaaaacaaaaaacccaacatgcacagacacacaaaacacacacacacacacacacacacacacacacacacacacaaaaccttttccttgtgcttcccaggagctaggaattccctgaggggttttcatgattctaaaagccatcatcaaatgcatctgcttcttaaaagaaaatgaaaaccaggataaagggaaatggggtgagggttagtaagatttctctccccttcctgcagatacctgatttgagccaaatcggttgaggtgtgtgccaatttctttcccaaaggactgctgcgctggccagcagttgtccaaggctgggatttgtcgcgataaaaacctgatctcatttgaatgctttcatatcaccagctccctccagcccatgcccaggtcccatccactgggcgtcccccctccctctgcctgctctgcagaagcaggggcagacagttcgccccctggcaggtctggtgcgctcccctccggggccactgaactcatccacctgcctccaggtgtgtgaggccaccctagtcaagaaataaacaagcagcttctttgcttccctccaatccctccagcttttctctgcctggaagcctcggggagcttgtgctggcaggggtggaggcagaggaggggagagaaagagacctggagagtgcagattcaaccttggtcagcgccagggcccgggtttcagtgccctccccgtccaagagaaatgtccctcccggcctgtgttccccagggggcattctctcctcaagaaatctctttaaatctcccttggaaatgtctgaacgtctaaagtgacagcagatgtcagctcctcctttatccacctgcttttccccagaaacgccaatgctcatttgatgctccaggcttgggggccctggagtgcatgagtgagtgtgagggtcccgggctggctggtcatagggccagcagagcagagccggctgcaggcacagacagcctgacttccgagtgccctggctggcgcgggctgtgtggagggccgctgatttcactggggcctggagctctgagccgagtgtcagacacctgcgctgaaaggaaaaggctgcagcctgtgttgccatggatatacggaggcgcgatcagatgctgttatttttagccctgcagtgccaatttattggtggcatcctggggacactcaggaaaggcaggagggctccgactcagggctctgccaggacaggtggctgtgaacgtgctggggtctgggtagactcagcctcccttgggggctgccacgactctggggtggggggagaggaatggaaatgcggggcagtgtggggggagctggtgaatggagacagtagagaggtatggctgaggagacaccaagctggttttggttttctagcgaaggggagaatagatgaggccatcagcaggtggctttctgggtagagaggaagctgaagcccacgagctaatttggagacctcaggagggccctgctctggggccaggacccagatgtcctgcaaatgttggtggttcagttcctgcagggtcccagagctttggggttttgatctgagtcaggctatggtgggaacaggggcctcccaaagggcagtgggcatgacagaggtgaggggggagcattcggaaacggcagaggaatcgaactggcagctttgctttttgcctgtggccaaagcaccagatagggcagggacgtccgcatttgcgtcctggtgccacaaccttcttgggtctggcctgagccaggtctcagcttctccatgactgtctacaccccatcattcaggcctggtgtgatgcccttgtccctacatatttcatgtaacagtcattcatctactaactcccaccgtgaaaatactcccctgctgcaattatttttattatatataataagacatgccccctgccctcaagggggcccctgaacacgtggcctcgtggagacggtgacagggctccctggctgggtgactcacacgcattgggaagaggctgatcaggagctgcagagatgctctcttaaattctcatggggccaggagaggtggctcacgcctataatcccagcactttgggaggccgaggcaggtggctcacttgaggttaggagttggagaccaacaatggtgaaaccctgtctctactaaaaatacaaaaattagctgggcgtagtggcacgtgcctgtagtcccagctactcaggaaggtgaggttgcagtgagctgagatcgtgccactgcattccagtctggacaacagagcgagactccatctcaaaaagcaaaaaaccaacaaaaaattctcacgggccaaggccatggtgagtggatgaaagggtggacacgttggccacctagtgacctctgatgctttttttcctggccaggataaaattcatcacccaccactctcagggctgagaccccttcaaagctaacaaacaaaaagagaggtgactagaaaactacccaggcccttcctccctcagcctgggtctgacggggaatccaggaggtggacctaattgttgtctacccatagttggaggtgacagcaaggcccagagccagcgacagctcctttggggctatgcctggtgccaagatgcctgaggtccttcttccctccctcaggcctggctcaccccagcgagggtcttaccattgacggtcagggtcacctctctctccccggctcccacacggggcaccacagcccggcacacgtacttgcccgcgtcctcctggcgcacggatttgagggtcagggtcttctcattgctcaggacctaggagaattggcaggctcagatgccaagagcaggcggaggggtgcactcttgtctctgggaacaaggcagctgagaggctggcctggggtaactgaggcagtctccggcatctcagtaggaagcaaggtggggaggaaagaggccaaaagtttcctggcccagacaatgcctgtgggctgtacagaggagactgtaccagcagagaggccaccccgtgtgactgaggatgttacatcccaggcgcagccctgtgggctgggggcatgtgggggcacatgtgccggaggagggggatgcctgcctggggacttccaggtttcctcctacaggaacctccctgtacctgcggtggcttctcctctcccaggctagccatgggtgacatgatcctacagctgaacttctctgggggctcctggacctgttttcagagtcattttcaggatccctttgggatatagcttggagtgatgaaaacaggctctggcatgagcttggtctgcgttcgaatcccggctccagcagtgaacacctgtgtctctttggtcagttacttatcttctcagacgctccctttctatgtatggaggctgctaggataatgcagcgtctgctacataacaggccacacaaaggtcggtttccttctggtccccctgcttccctacctggagctctccctgttccttcctatgtgaggacatctgacaatctcttatgcactgaagaatatatacgtcttaaaagaggaacacaagggctggacacggtggctcacgcctgtaatcccagcactttgggaggccgaggtgggcggatcacctgaggttgggagtttgagactagtgtgaccaacatggagaaaccctgtctctactaaaaatacaaaattagctgggcgtggtggcccatacccatagtcccagctactcaggaggctgaggcaggagaattacttgaacccgggaggcggagtttgtggtaagccaagatcacgccgctgcactccagcctgggcaacaagcgcaaaactccatctcaaaaaaaaaaaaaaaaaaaaaatggaacacaggaaagtgaagcccaagtccaaggctaacggtggctttatttgggggaagtttaaaaggctctttctttctctttcttttctttctctctctttcttttctttctcctttctttctttctttctctctctctcttcctttcttcctttctttctttcctttcttcttcttttttttccccaaggtcttgctacgttgcccaggctggacttaaactcttgagctcatgtgatccttccacctcagcctcctgagtagctgggactacaggtgtgtgccactgtgcccacttgaaaagcctttctagtgccttccctcccagcacattggtgaccacctacttttcttgtaaggtttaggacagggcaagagtgcaatggctgaatgtgctcagggtgggacaggcacatgggggtgcctgggttccccctcctctttctgggatctttctccctgtggcttacactggaggctgactcccccagtctaatagtgagaggggcctgggcagcagttccttcttgctccactgtccccgccccctgccagaggtgccccgaggtctgagctgcagcctcaccactccggagccccgcttcatccagacgatggtcagggatgggttgccggtccaggcgcagctgaagatggcatcagagcccagatccacgagcaaggattggggttctgtggtcatccggggcccaactgcgatgtgaggaagaagaagacaggttcaggtgggtggggagctctgggatcctccttgctgctgcctccttttccccctagaccttgactggggggaggcaggcagtggggtacttgtgccacctcagtcgcttccattttaagtcttatgtccgggcggggtctgggatctgggagtgggactcaggaagcaaggaggagaccactctccctgaggcttcgcctctcttgggcccatggaggtggtcggcagcgtggggcctgggaagaaggtgctggggaccaggttctgcctggatttacccccacggctctcatccccttccctctgtctggatcacgcccggtgctagaaagctgcggaagcccctccatcccagtggcgggcaggggccctcctcctgccctggaaatctgggctcttgggatcttcatgcctctgccttcaagctagctgccatctcctccagcctcagccttcatgacctggaatcgagtgactggtgcacctctggggtgggatgggggctctgagatgcagggtgatggaggcagggctctcgtgacccacgcctcctcccccagggtttcccacccggtgctctcaggccaccctcctattacagccgttccagcctctgtgtcacgcccattgcagtggagcagccctgggttccacttccgacccctctcctaagcattaaagagctgaatgcaggctcctctccaccttccctagcatgtctggagccttctgtagaccaagcttggtctacacagtgggggccgtgtggggattccaggctcagggtccgaccgtggccaggcaggcctcagagtgctccttccagggagcagacagagcctgaagcctggtgccaggagactgcgattagtcccctgatgtaaaaagggagtaacagcactttcttcggaggcttcaagggcaagggggagggccagattttttcaagtttgtaaaagcaagtttaaaactgtaaggggcggtgcatgagctaaggatgcttgttttgaacacatccagccagctagtccatggcagtgcgctgccttgctgcgggtccctgctggacctccagtgaataagaggggatgggcaggtgcggtggctcatgcctgtaatcccagcactttgggaggcagaggtgggtagatcacgaggtcaggagattgagaccatcctggccaacatggtgaaactgtctctactaaaaatacaaaaattatctgggtatggtggcaagtgcctgtagtcccagctactcgggaggctgaggcaggagaatctcttgaaccagggagttggaggttgcagtgagcagagatcttgccactgcattccagcctggtggcagagtgagactgtctcaaaaaaaaaaaaaaaaaaaaaagaaataaaaagaaaaagaaggtacgtccgtgagtcccctcagtggaaggcagcagaatgtgtgaatgggcaatggatttggtcattgcctgggttcagttctcatttggccacctactgtgtgacctcagacctccatctcctcattcagatgatgagaataaatatctacccatgatggcctgcgtgcttgtgtcccccgtcaaccctgcaattcgtaaattgaaatcctcacccctgtgggatggtagtaggaggaggagctttgcaggggcaggggttagatcatgagagtggagccctcgtgatgagattagtgcccttggaataaaggccccaagagcttgcttctctctttctctctgccatgggatgccacagcaagaaggcagctgcctgcaagccaggaagagagtccccaccaaaacccaccacgatggcaccctgatttcagccatttaagccaccgagtctatggtaacgtgtcatagcagccccagccaagaccctgactcatggggtcatgatagggattgaaataaacatgaaacaatgcacaaaccagctttcgtcgagtgcaaaccatcctacgctcatgacgcatgaagcttgtgttgtgtgcaatgaatctagccctggtttctccagctctaagcagaaaccagtggatgcctgctcgcctggggaagcctgcaccactgcactcacagtagacgtcaaccgtgcggctgaggttggtgctgcccagggcgttggtcacctcacaggagacgggctctgagaagtacgtgtagtccactgtggtcctgtacacctctccagatgcctccttgatgatctggccccgcttggcccacctgcaacaaaggccaggggctgatgtgggccttgagtggcaaggccaaccctccgggagctggacacatccatcccatggaaaaatgaggcctgggttgtgtggcaagtggggagtcctctggggtccgtcaaggggaatcttcacagaggggctacttcaagggctcagaaagagttggttttgctcccacccaggtggttgtgaaggcagtgggctttggtttgtggtcaccaggcagtcagtggcactcaacaagtgggttattctggagggggtgagttgattactcggctggtcagcccatctgctggctagacgatggaaaatccaactgtcagtgggcagacagctcgctgtcctgctctgagctggatcatgggcccctttggaaaagaaggaggccaagtccatgacctcagaggccagggtcaaacggagcatgcccatacatgcatgctcatacgtgtgcacgagcacacacacacacactgacaaggcgagaagctgtaggagaggtatgctgtaggggctccatctcccgtccaaacagtggaatactaatacccatcaggaggagtggcgtgagcgagtagccctggctgcccctctctttcctcttgacaagctctcagctctcctgtcctgttctgcctcctgcttccatggggttctgcatggtgtctcctcgccccagaaagtcctcctagtttccctggatggcacttgctcttcttcctgcctggcctctgcccttgcagcctggctttgctcctctgaagcaatggctccatcagcactggcttggtgaggggatgtgagtcggaagtctcttttgtcggccaatcggtaccacacaataggggaggacaggaggcctctggcttgctttggatctggctctggggcagtgacccctgtgttggaccagtgacccagcagcctgctgtgtgcagaaagcaacggagcctcacaggggtgtatgtgtatacacatgtatgtgggtgtatgtgtatacacatgtatgtgtgtgcatgtgtgttcatgtgaatgtgtgcatgtatgtgtgcacgtgtgcatatgaatatgcatgtgtgagtgtgcctgtgtgtgcatgtgtgagcatgtgcgtgtgtgcatgtgtgagtgtgcccatgtgcacgtgtgcatgtgtgagcgtgggcatgtgtgtccatgtgcatgtgtgcatgtgtgagtgtgcatgtgtgagtgtgggtatgtgtgagtgtgtgcatgtgtgagtgggcatgtatgtgtccatgtgtatgtgcgcatctgtgagtgtgtgaatgtgtgcatgtgtgtgggtgtgagtgtgtgcatgtgtgcatgtgtgtgtgtgcatctgcgtatgtgtgcatgtgtgtcaatgtgcatgtgtgcatgtgcgtgtgcatgtgtgcatgtgcatgtgtgcatgtgtgtgtccatcggcgtgtgcgagcatgtgcatgtgggagcatgtgcacgtgtgtgtgcatgagtgtgtgtgtgtccatgtgcatggtgcgtgtgtggtgcgtgcatgtgcgagtttgtgcatgtgtgaatgtgggcatgtgtgagtgtgggcatgtatgactgtgtgcatgtgtgagggtgtgcatctgtgcatgtgtgtgtctgcatgtgaaagtgtgggcatatgtgtgtatgcgtgtatagatgtgtgagcatgtgcacgtgtgtgtgcatgtgtgcatgtgtgcatgtgcgtgtgtgcatgtgcgtgtgtgtccacgtgcatgtgtgcatgtgtgtgggcgtgtgtgcatgtgtgagcgtgtgcatgcatgggtgtgtgcatgtgtcaatgtgcatgtgtgcacgtgagtgcatgtgtccatgtgcatgtgtacatgtgtgagcatgtgcatgtgtgcatgcatgtgcatgtgtgtgcgtgtgtgcatatgtgtccatgtgcatgtgtgcatgtgtgtgtgtgcatgtgcatgtgtgtgcatgtgtaaatgtgggcacgtgtgaatgtgtacatgtgtgaatgtggccgtgtgtgtgcatgtgtgtgcatgtgtgggtgtgtgtatgcatgtgtacatgtgtgagcatgtgtgcattgcttgtgtgtccgtgtgcatgtgtgcgtgtgtgcatgtgtgcatgtgtgtgcatgtggttgtgtgcattagtgagtgtgtgcatgtgtgtgcgtatgtgagtgtgactatgtgtgagcgtgtgcatgtgtgaacgtgtgcatgtgtgcatgtgtgtgcatgtgtgagcgtgtgcatgtgtgtgtccaagtgcatgcgcatgtgtgggcatgtgcatgtgtgtgtgcgcatgtgtgtgcatgtgtgagtgtgtccatttgtgagtgggtgcatgtgtgagagtgtgcatgtgtgcatgtgtgtgatcatgtgcatgtgtgtgtgcgtgtgtgtacatgtgtgagcatgtgcatgtgtgcatgtgtgtccatgtgcatgtgtgcatgtatgggcgtgtgcatgtgtgagtgtgtgcatatgtgcgtgtgtgtgcacgtgtgagtgtgtgcatgtgtgagcacgtgcatatgcatgtgaagttgggggcttccttacggatctccagggagagagagttctccgtttcccctggtttaatcctactctgatcccaacattcttttttttgaaaccacggaacttctcttcaggctgttacagttgaagtgtctatggggagtttgtctttccagagctgcagaggcttgttgcctccagaagcgtcaccccacagccactgctccctggaactgcagtgtctctgctcccctgctttgcctcccctttatcttattcctggagcctttcctggcaccacaaacgccgtctcctgcccttccctccattagcttcttgcctccgtctgacccatccagccccgagagacgactgtttcttggcatcagacagaacacctaggctggcaccaagcagttgttattgcaaattaatattgggtaattattaagaacacaattaataataacaactgtagtttaacaacagagcaaaccatatctcccttagagcttaaggagcttcccaacaaaccattatgagttattcatgtgtcgtttcaatctcttaactttgatttaatgaccagacttaaaagagtcaggccggcccctgcctgcggcaaatgaattcagttccaggcacagctagggaagtgtgtccagccccgcagttcctttcaccctgctgaggcgagggggccaggtggtggatgcagcgtgaggccaagcgggcagctggctgggctgggaaggcagggagccctggctgctcacagctgtgggtgccgggctggggctggagggtttgggcccaggtgatagggccaagcatgcgtcttcctcagggcttcctggagaagctctcgcctctcctctccttccagggcccctcaccaggagcatcacggagggtggaagccccacctgcttggccccaagtaatcagcagaactgctgctggctccgggagccaaggttccctgccctccctgtcctctcctctcatggtgagggagccagagacggaagaggaccggagccgctgtcggggctgggtccgcaggagcccaagccaggtcttttggggaggtgcctcaggacccgacagagcccgcagctcacatctcgcccagccggtctttcttcccctcctgcactgaaaaaccctctgagaggtccctgccaaaagcacagacactcaaaccactgcatccacgcagctggccaaggatccaggccaagagctaaagagtgagtctcgccccaccctcttcgtgcctctcctgattttggtgcagtttcttccctgtccttcctctttgtctcctcccctctccccacccacctcccccaactcactgttgcttccccacctcccccagcccctctgaaagtggagtcagcttaagcctctcccaatcaatgtctaatttggtctgaacaaatgtaagaggattaattatttatatcacagaatcaggggggctggcgtgtcacagccgccaggttgtcctcaaatagaccaaggtttcatctcgtgtgggggggccacatcccgctatctgctggggaacactgagagactctcagaggaaagggccccaaagcactttgggctcctggtccctaggagcatctgcagtgacatccccatgccacccaggcctcctttccaggcactgggatggaggagggcgttatctctagcttcagagatgacagcctcttagtgacagcagggaggaagctatcaagatgaatgaaagtaaagaaacaaagtttcctgtaatcttgtcagttaggaaaaatcaatgtacttatgtgatgagatttgcttacggcttttcttcttggatcccaacattgcttctaaacacctggctgcttggtgagaccttgctggagtgaaggggctgagcgagtgtgggtgggtgcaggcgcccaccacctcccctctccgtggcccctccgcctcctcccttcccaggccactctggctctctggcattaacctgggggccggaggggctccctgaaagcctctggagtcctggagggagatgacccctcagtgaggtgttttcagggcccttcactaatcagaaggccatgagggaaggtgaccaggaagaactagtgagtctctgcagggcaccctgccctccctgcccctcccagctcctgcttggtataggaggggccggctgtgatactgtgagctccaggggagtacgaaagggaggacccacaggccacctgtagcatggggaagcccgcatgttctctgcttgttcattaacttttcagcttgcaaaaaacaaacttcggaattacagaaaagttgtaagaatagtcccattaactgccaccctcccatcgcccggattcaccagctgttaacattttctcacgcgtgctttgcggagacctctcctctcctcccaccttcttctctttcctattattgctgttctgcttttttgaggttggtgaccctgggaatcaggcccagcacttcgtttcctgggtgtttgctgtccgggtcagtaggcaggtgtgggtgggggaggcaggcctgggggtggaggggtcaggtcccagggcgtgcagccctgctgtctgcccagcctacccatcactaggaccccaggtgaccagagcctggcagtgaggagaaacgaaagtcgaaagttgtgtgtcctggtctctggggcgcccaacaggcattctaagggtggctgtgagggtgaataggggtgcttgccgggtggtctgtgggtgtgaagggctgccctgggaagctagcatgacagatattttctgggcatgttgtacctggtgtttagggaccaggagcagagacctgggagcagacagaggagagaagctgaacttgtatggagaaacccaggcctggcaggtgcagcgtggaagcctagggccagggagtctcattgggcgcctctcttgtatcttcagtggcttctgaatagatgccagaccacagccaaaccagacttgccccctggacctggctggacccacatgattctggggagcctggagtccccggctcagaagggaccctggaggtcatctgttctttcttctgactctagtcaagcaaatggttaaactggacaggacaaatgggtttcatcctatttaaaaatatccttggggataggaactctgggctctgcctgggtttctgactccagtgctgcttaattacgcactctgcagggagcacctcctcatgtccaacctgaatccctggctgtccctgtggcccatttccttccattctgcccacgggggccacactggctcttgtcttccctgttctccattcccacaggccggcttatttcctaggctggcaccattaacatccttggcctttgcagatgctgcagcttaatggccgagatcaatggcagaggtgacacctgggctccaccactaagcctggtctggtggaaagagaccaggctgagtcagggccatggcaagttccacgtggcacccaaaaggaggtgagtctgcccttgagtgcctccaaggtcacttagtctcctagagtcttgtgcagtgacagtgcccaggcagaaaggcgcccagaggaagcgtgtgtttattggatcagtcagacacatctaaggagcatgtggtttatgccatgtgctgtgctgcatgctgagagccatcagtgactaaattgcagttcctgccttcaagaagctctgtcacaaggcagaaacaagtaaaacaaaaacagtgatgctttggccgggtgcggtggctcatgcctgtaatcccagcactttgggaggctgaggcaggtggatcacgaggtcaggagatcgagaccatcctggctaacacggtgaaacgctgtctctactaaaaatacaaaaaaaaaaaaaaattagctggcgtggtggcgggcgcctgtagtcccagctacttgggaggctgaggcgggagaatggcgtgaacccaggaggcagagcttgccagtgagctgagatcacgccactgcactccagcctgggtgacagagcgagactctgtctcaaaacaaacaaagaaacaaacaaacaaacaaaccaacaaaccaaacagtggtgcttttatccgtgttgtgagcaagagacacacaggggccatgagtaagtgtgatcccggatgctcactggactgggccggggcccagacatcctgatctacccaggtgaaccagtttgatgggcacaagactagaatggaggttctgatcttgctgcttctcctggttgttctggtttttttttgttttcgttttttttttttttttttcctgagccttttccccatgtttggagtgtggaataatcaggctattcaagcagaagccgtgagtcctgcttcctccagtggaagagggcgcgtgcacgcacagaggagaggaagggtccacacggctagcaggcaggcgggtttaagaggaagggaagaaggctactggacacgcggtgtggactaggcacacactgcagccatgctgaggaccctaagtgacatcccacgtgagaggcacgggggtgggggccagtggccaggccgggccccctcagcagtgactctcacctgtactgggtgacagctgggttggcctttgcagagcagtggaaagtgacgacgttgtcctccagcactggctgtggctccaccgagaggttgaccagtggagggtctgcagggagaggagagtcacttgtagaccggagaaagaatgggggcagggagatcctgggcgacatggaggatacagccagagactccaccacccagggaccctcagagcagcccccgccctggtggtcttcaggaagctgggggctccatgggaggtgcctgcttcagacagtcctggaggtgggaacagggcctccccgtggacttggggcctggtgtggacacgaaccccgagccaggaagcctcaggcttgggcccaggggtttcccatcctccaacttttgggcggaacaaaataatctaggaaggagaggtgggaagaggggtgcagggcagagaggggcgcgtggacactcagtctcgcttcagtgcagactgtctttgaaatgtctgtttattatctcttttccgtaaaggttctggggcatttgttaacttgaaagcggcatttacaccctttcatcagcctaatcatctccactcagtcctggctggtggcgcacggcctcagcttcccaggccggggctcgcttcctcatttgacgtgataagaagccaggctctgaagtgctaaatggtgggaaggggaggagacagaaagtcagggagagaaagaggcagggagacaagaaccagagacacacagagacacacagaagggaccggaggccgacagcgagacatgtacatagaggagagacatggagaccatagaggaagagagattatgtgtgtgtgtgtgtgtgtgtgtgtatgtgtatgtgtgtgtatgcatgtgtatatgtatgtgtgtgtatgtgtgtatgcatgtgtgtgtatgcatatgtgtatgtgtgtatgcgtgtgtatgtctctgtgtgtatgcatgtgtatgtgtatatgtgtgtgtgtatgtatgtctctgtgtgtatgcgtgtatgtgtgtatgcgtgtgtgtgtatgtgtgtatgcacgtgtgtatgtgtgtctatgcgtgtgtgtatgtgtatgtgtgtgtatacatgtgtatatgtgtgtatgcttatatgtatgtatgtatgcgtgtgtgtatgtgtgtgtgtatgtgtgtgtagagcgagagagagagagacaaagatgaggaagtgacagggacagggagagacatgggcagagagacagaaagacacacacatagaaattgagaagtgcagaaaaagggcgagaaaaagagaaatctagagaagcagagggcagagtgatggagagatggagagactgacctgtttgcagagactgtgaatcagacaagaatttcagaccaaaagcagaaaaggccacggagacccggcacatagggcccgacaatgacagggtgttagagagaaagaccaagtcaaacaacgaggaaaagagatatgaaggaggagcagacgctgcaagatggaaagatggaaacagctcgagggggctgcagcagagagacagagaggtgggaagggcttccatcagcctggccctgcccagctcaggggcagctggctctggatcctctccagaggctggtgtcacccctgctgctgggctcctggtggcccccaggcctcggcacccccggggcatccacacgccgagggatgggggataacgagccagttcccatcctttttccctgtcatggcccagagctctggctgagttgagtgggcagcccaggacctcatccccatggacaggctgggccctgggctgcatcttctgggtcagtccccaccaacaagcagagcaaattgctggaaagtcacgaggacttctaggggtccagcccatttccagaaaaagaagtaaagaaaccagtttctcagaggcaatgaggaaaaatgctggtctctttcggtccccatgggggcaccacaaagggagcaaggccccagctggcccagttggtctgggctctggttgggactacggtggggtcctgagaccctcagagagtcatacagtcatgcactcagcctctaagctgcagaccgagccggccttactctggagttcggatcacataactgctcagctgccctcttcctgctggtgcccaagaggaccctgcctccctgcctagtgccaggcacgggagctggcctgagagatggccccagggctgtgctggtgtctgcaggcactggggagagaactctgttttctgagtagcaggtggctgactgtgctggggagcctgttctcccacattttccctagttccagacgggggaccacaaatccaggaaacctctgctcctggtgcggtcagcctgcctgcctttcgtggggaattacaagggaagtgccctcacttgtgatctcaatcccagttgtaaggcataattcaagtggtcacaaagatggggttacaaggaatagccacgagaacgctcctcccacccccagaaccccgtgacctctcctcgaagctgcaccctagcttccagggcaaggctgaatcaggagttccagccctctttccatgcagggctggctggctgatctgggcgtccgtgggaccctacctagagaacatggacactcagggaggagcctgcatctcgccgtgggttggagaagtggaggtggggcagaggagcttgggaatcgccaccggatccaaacgcattgctggcccgtgccctcgcattataaaggccaacgctgggacgtgagtacccaccccaagtctggtttgaggaggtgagtgccagtcccataggctcaagggacccgccacagaacttggggggctgttccaggaggcccttccctcacctgggggtcttttctaaagtgatgaggtctgagaggcagggaggtggggcacacacctgttgtaggaccttcctgctgcccgatgcctcatcacgcccctgccatgatcagctcactcgtaaggctgctctcctgcactttcccttcctcttagcatcgtctttggtgatcacctgccccgaagcgattcacaagggttccacactcactggccatatctgcacctccaccccaagaccagaggtgcccaagcttctttctccacttctgctggtgtacagaatatacattttcaggagtctgccaagctccagaggtataaatagtttatgtcatatccaactattaaacatgattttaatctcacttgtgatgtcggcagcataacttgcaggagggcagctttgatgtagctggtggaactgagatcacattgaacagatgttacagctgagagtctgttagtgtttccatccgcccgtgtgtgcgtgtgtccatgtgtgtgtgttttcaggggaagtattacatggaggagagggtgggaaaagagagaatcttcatgactcagtgattttgtagcacattcatttgaaacttggcagctggacacagagtccagatgtggtgaggctttgggggtgttaagctttctctcccattactcaatctgagggctttgtcttccgttgggtaacatatgaagaccaagagaaacaaacaacaaatgtgcttttgctgagtttggatgcttcttggttgactgagaaaatgagcaggttcacaaaggcagctctgatgcagcccatggtgtccttagtaaacagttggatgctgactgaatgaacaaatgaataaatggaggaggagcgggagcaggaggagggggaaggggggagggagcgggtggagaacgtgtgctttgcttggcaagcacatacaagcaccttcaggctaggggcggtgagcgcggggacaaatggatgaagatcccttgcctgttagggctgtggggacacctgatgaggggcaccactcacctatggctctgcgtcctgacagcagctggtaggtgtggggcactcacaacgtgtcagacactgcgctagggggcttgacaggaaggatttcatttaatcctcactgcaaccttaggaggtaagcatgattacttccatgtacagaggaggaaatcggggcacaaggaggttaactaaccgggtcagtgccactcagtaagtggcagagagttcaaagcaggaagaatgctgtggccttcaccactacccagtactgccttggacgaggctggtctgggaaactgggctgctgggccccaagtgtcactctgacctcattctgacgcctcctaaggtggctgagatgtccttggaaaggaagccagaaagggcccagaggcctggcaagacccagtgtcctctggatgcagactgtcacctgcaccctgttgaacgatcttctgtgggcatgagtgcagaaggccgggtgggctgtggttaggagggcgagtttcccgttgcctggagaggttctcctggggtaatgcctggagcaggaaactgcttcttcccacctctccctgccaggacctacgctgctgtcgcagggggccagctagattgtcacttttgtccaggagtctgtaacattttgtacaggcctcctgatcaggttggggacaggctggggaagaagcgagggtggtggtggtggcagtgaatcgaatggcagcctggaagtaggaagcttggatgctctgtgtctcccgccctctccccttcctgatttggattgcatctggacagagagctctgatccgtggccagtcctcgggcaagaaggggccttggatgtcatttggccaaatcagacaaggaaccagagtcccctagggtgatgtgacaggcgtaggcccagcccacccatgggttgtggagccgtcgtggatgctggactgcatggctttgcggcatctcaccttttccagtggggcttactgctccatgtggctgctcaccacacaggaggaggcggtgctcagacccaggacccaggccagggccagggccagtgagggggaagagccgagggtcggagattaaggaggcctggcctcactttcagggccagccctgcttgcactgtgtgccccgggacctccttcagtcaccctagctctaggcttggccagagctccgcggccctggctgcttgtgaatgaggatgccagaaggctccttggtacaggggtatgtcgggggttgtaggggggacagagatgtttgttaatagctggtggcaagacagtgaagataaagtcccccccgccccaagaactcagcctttgtgtgtgggtatcttgagcctacctgaggttttcaaccatttcttctgccctctggaatctaaatggtgtctgtcaggattctagacactggctgggaacttctgctctcagctgccaagatgagctctcagaaccttaagacctggaccccatctctggactccaggtccctggagagacactcggagcccagaatccacaaggcttagagaaatcagggctgttaggaagtgtttttaaatgcacttgctttaaaatgagtaaaaggctaaggaggacacgaatgccagcctgcagctccagccttgaaattcagagcccaggacagaagcagccacctgcttgcagtagcgttatgtttggcggcagggaggggatctcagaggagagaagtccacttttgagtcctgactctttaaactgaactaatccagtcttgagaggaaggcccctggaacaccttgctgagctcttcttggttctggggctgacaggcaccttagggagacttttaggagactttcaggggtctctgttaggtggttgtgggatgcgatgctggtggagccctgaagcatcataactgtcaacatgaatcctaacacgggccaccgagggctggctgggcaggagtgtggagaggatgttaccagggtggactctggaaatctatgctacctaagtggtcttgggcaagttaatcaccctttcggtgcctcagtttcccacggtagggaccacagttgcaccttctccaaacagttgttgtaaagattaaataaggccaggcgaagtggctcacatctgtaatcccagcactttaggaggccaaggcgggcggaacacttgaggtcaggagtttgagaccagcttggccaatatggtgaaaccccatatctactaaagatacagaaattagctgggtgtagtgatggatgcctgtcatcccagctactcaggcaggctaagacaggagaatcgcttgaacctgggcagcagaggttgcagtgagccgagattgcgtcattacactccagcctgggcaacagagtgagactctgtctcgaaagaataaaaaaaagattaaatgagataatacatgtagatttccttcttcttgtccccttgatcaacccttccatgagagtggctggtgcaccctctccagagcacagcgctgcttgccaattctgaagcctggggacccttcaaataccagcatctccactcagacttcccctccaacagaggggccaccggctaggccagcagaggcagcagctgaccgtatttattggtgtgaaagtcccaccttgtacaggtgttgaaatgtggcctgaagatgtcctttgcgaaagaccctcatctgtgaggttgcatctcatgacagtaaggaagacaagatggtccttcctgtccgtatctacaagctggccaatccacagagctgcctgacccatttcctgctatcagatgggccaggctatggtcagggttgctgggtgtttcaccctgggcctggcagggctgggttgggggagggggtgggtactcacgctggatgtcaatggtgaccgacgtctcctttcctccggggatggctttgttggtggcacgacacacgatgctctggccattctccacgtcaccaggggagatgaagagggtgctgacgatgctctcccgcttgccgtcccgaagcagggtcttgggagaaagggaaaggggagagaaagctccatgtcgcttggctggggtggccagcctgggttgggggtaaacgagcaccagcttagacagaagggggagctgtggatggaggggttcagcttaggagacctgggctgcccatgtctacgcagagctcgggggttaccccctggctccctggcctggctaagtgctgggctgtggaaggaaaaaggaactagacagttttccaccatgtgaaaattagcctggattcacatgctaaaagcacaaaagaaagcaggatgggtttcatggaaaccaggcttcagggaggtcccatgttgaaatgaactcacatctttttgcctctggtgcttgagtgacagtctcaggctctgtaggaagcaacgagatggtttgcaaccagcagggactgtggcccctgagcggggacagtctgcagaggaggcacagtttggggaatgggagtcagagtgggtggggatatgggcagaatcagtgcacatcaacctttcgattatttgcctatataaatcctttcaactttccaaagcgtttcactccctgatctcattagagtctcaatcaaaccataggtgggacagataccattatctcccattggataggggaggaaataggtgggctagacagaggctatggagcttgaccaaactcacatttcaagttggtcctgaaataagtactagtctcctacagcaggttgaatggtgtcctctccaaattcttgtctaccaggaacctcagaatatgaccttatttgggaatagggtctttgcagtttagttaagcaattagtaattagttaaggctcttgagatgaggtcatactggattcagagtgagccttaaacccaatgactggtgtccttggaagaagagaagagagtctgctgggtgtggaggctcatgtctgtaatcccagcactttgggaggctgaggtgggaggattgcttgagcctaggacttggtgaccagcctgggcaacataggaagatcctgtcactaccaaaaaaaaaaaaaaaaagaaaaaaattaaaaaaaaattagccaggcatggtggcttgtgcctgtagtcccagctacttgggaggctaaggtgagaggatcacttgatcccggaaggttgaggctgcagtgagctgaggttgtgccactgtactccagccagggccacagagtgagaccctgcctcagaagaagaagaaaaagaaaaagaaaaagaagaaggagaaggataaagagaaagtgaaagagaagaggaggaggaggagaagaggaggatgaggagaagacagagagaaacagagaaggccaggtgaaggtggaggcagagattggagggatgctgccacaagccaaggaatgccaggagctgccaggagctggaagaggcaaggaaggattttcccctggagcctttggaggggcacagccctgctgacaccttgattccagacttgttggcttctacagctgtgagataattgatttctgttgtgtcatgcaccgaattgtggtgctttgtaatggcagccctaggaagcaaacccatcttaactgctggtctcccaccttcccaggtcattgcttttctctactgggccacaatgtcattccgaagctagttccccattgtggctgctacctccttccctctcctgttcctctttgcagctacttccccatcactttggggcgcactaagtcaggtgcaccccggggagggtgtgctgagtgtgtgtgggggtgcacttccaggttgggattggggtctggtcagtatgcaaaggcttctgctactaggaggtactaggaaggaacctcactatgggtgcagtcctgtttcccccgactggagccagggagtagatgaacagaccactcctccctcaaaacctcccataaagtgacaatggcaatgtctctaattcttatgagggccccggaagacagcagcattatctttgattagccaaagagaaacctgtgttccaagtgagccgggaacttgctgggtggagctaggatttgcacttaagaatgggtgaaccctgagccacagcctctgctgcagccccgggggtgctggacggtgggtaccgtgctcttggcaggacagatgggaacagttagggccacagggagaaacctgtaagctcctagaaccccacattctgggtccttaattcagtgaggtttttctcaacttggggcaaacctcgtggcgtcaggagaacagggccagagcctctatatagaacagcacatcttgctggaggcaaagccggactgtgacattctagagagccacgcggtgcagctgcaggcctgggactcagggtgccagccacggccctgggcagaggggctggaggagagtgacgtggccagatgcagcaagccgggggcaggaccactgcagaggagtgaagttgaaccccaagccaaagcccgggcagggagggagcagcagctggcaccgctttaccaccctgccttgggctcttcagcagacctcatcgagtctataaatagccaagtgataataagaacaatttcctggatgaaactaagacttcgggtagggcgcgcaggggcggggaggtggtgaggagcaggttggtattcttcttctcttctttacatttccgttgtgctaacaagggacatttacataagcttgactctgccaggagcccttccaacggatgggctctgggcggtgggtgccagtggcaggggagggaggggacccagctctaattaggccctctgactgctccccctcctccctgcacccagcgtgctcctccgcctcggaatgatgattaatgacatatttactgggtccaggcgtgtgcttttctgggaaataaaaattctggttcaagttgtttgttccacctaattagagaaaaagggagatgtgttcattaaacaaaaggagggtgaggggaaggcacgtgccccagcaccaacaccctctctgtccccgtggaaggtcccagcacctcctgggcccctagctcgcgggggaccccaggccccgtgcagcgggtatcccagggaggaaggctgggtctgccagctctgctgcaggacgactgaggggaggaaggtgggacagagctggggggcccagggggaaggctggagggagccctgcacctgcaggacagggcgggatgtggaggggcacgggggatctgcacccccgggtttctcttcccccattcctttctgatctcgcctctcttgtttcttttgcttcactccttttcagaaatgaatctcccctaattgtcacttttctcatatgcaaatggagcctctggactttgcagccttgaaggtactgtccaggagaacattctatcatctgcaggttctagtcgcagctccactccgcccctcccttccctgcttcccttcactgagcttggctctggggacacaccatgggcattgaacctcccacctcctgcttcagaaagcttcatgccttgcaggtgagctccagaaggaagtgagttattcatggtgggccactcactgtgggagccaccgcctccaaggcctccctccagtgtggtgagcactaacgtgctgccagcccccggctcgcccaggttgcccatgtgactgccatggtggctcccaagagtccccgaggacccagctcctgtgtgtgcagatatgggccaggggcaggcatatagatggcgtgtgtgcagcatgtgtccgggaacgagcgtgccagggcatacacccccgtgggtatgtgcgcgtacctgtttttgtctttgggtgttcatgggcctctgtccactgactgccgtgactctgcggggccccaggttctctctggacgctgcctgctcaggtgccgcctcagggctgtgcacccacccccactgcccctccctaagggcagggatttggcactcacttctctagttccccagcaccggcctgggaggccggtcttcccaggtatggttgtacacagtgtaccccaccccatggttttcctgcttgggtggcagtggctggccactctgctctttccaaagcccccagggcctcctctgggcagtggagagccaggctgagctctcggaaatgggtgggctggagggcagacaaggggtgggggcccaagcactggtgctaaatatggggtgcccgatgacaggcaaaccgtctggaaaggccgagagtagcctgattgcctggcagcaaggccgcctcgcttctccccgctactcaccttccccacctgctgggtccctttttttttttttttaaaaaatcatggctctgcttccccttttgatagctgcttggggctccccatgggctggttgccacctggcttgaataagggtgtgtgggccaggtggaggatgcgcagtgctttttgccccagtccctgcatccagccttgaggccagaggccagaggggtgcccttcacagagaaggccaggatgagcctcggccacacccagtggagactctaggcccctaagctgggcagataggtgcagggtgatgggtgagtgaccagggagggggtgcccagtggagggtgagggccctatgcatgtgggcacttatccctttcctgagtggggtctccagagctcctcttagcaaaggtggtaaaaggcgaggccagtggtcctggtggtaggggtagagggcaaggggctccaagcagacacagacacgactgtgcgtgctaagaccttgcaaccctcctgcctggcaggaagctgcacttaggaagggttctttctgggctcagcctgtcctctcgcccctcctcttccgtaacccatccttcctcccctgctgtgtggacttgggggctttccagaagaaagaatgtggtctccactctggcgccaggccctcagaagtatgaggaacagggaaggaacccactgtccccagacagcccagggttgagtctccaggaagaagcttggaggggccttttcctgctctgtgcctctgcagccgacacccgctgggagcctgcagtgggcactgcccaaggccccatccggcagtgtggctcgccctgcaccctggaggctgtgacagtggcctgttaaggagaagcatggccagcctgtgctgggggagggactgggtgcttcctctcctgcccttcctcctggggaaggggcctggtgccctccagggctgaggctcatccctcccctactggtcccatggtggagtcacagagagaatggtcggtgagcaacccagaaactttgagaacaggcctggtgttttatgaaatagctgtatgacccctggggcagggaactggggttccccctgtgggacaggagccaataatagtagctcacatttatccagtccttactcctgcccttgacagggtgcttctgatgcataatttcttgtaagtcactctgcaaccctaacagacatccgtgatcattatcactgcattttgcagctggggaaactgaggcagagggtgacatcaccatgttatgttacggatcccaggtttgagctaggccttcagaaccatgtggccagcctaactatgacaccgatgtctgcatatgggaaacgcgaggtccatagtggggtggaccttgcagccgtgtggatccagtgagggggtgacaatcccaacagcagtgcttgttgcaagctcgctatgtgccaggcgtgtttctcattcaactcctcacaagcaccccttaaagtgggtgctgctgtcgttcccattgtatggcaaggacagggaggcacggcaaggtgaggtcacgcagctggaaggtggcagagcccggatccaaattcaggctgccagctcctgagcccacggggataatcatccaccatgtgacagccactgagggcgtcagacccgacagcagccagggctgccctgaggggtcttttctggggtccttggaggctgcctgattttgtgtgtgctcccagcttctcttcctctctgcggctgatgctctggcccctcctcatatgtagcctctctggggaagtcaggagtgctgttggcctatggcagggctccttgcagccctgggggaggagggggtgggctgggtccctgggaggggaagcagaggggttggctcggacagcccccagagcctgctccataggagccctggattgtgtaacctactgggtatactccacatcacaggcttgtagcttctccctgcccggcacacagccccgtgcctggggaagctccactgacgtgtgcgggctctgctggtcacccctttggtctccatgagaaccactggccgtggggtggacagttaggatggtggatgaccatggtttggaggagaggcccagagaaatgaagtgccttgccttgggacacagggcctcttcccatgctcatgtccagggacacattgagggtctcaggcctctgctgctccctggacaagccacagaggggcaggagaccatctgaggtgactgtcccctgaggaatctgtttctcttccggagcgtctgatccaacaccttcattttgcagacgaggaaacagatgcccagggagtgagttgcctgaggttatgcagtggaagctggaacccaggcctgcgactgcctggcgctgccgttcccgtcacaggcccaggagcatggatcgggtcccccgccctgctgtgcagtagtatggtaccaggctctccgaggggccttcacaatgtagacaaggatgacatgttgagctcaaggtgatcctgggacaggtccagcagagtgaccctgacctctctctccacctgatggcatgtgtcctctgcaggacattgactctgctagggtccaggctggcccaagttcagggagggacaggacaggtgctcagactggaaggaaagcccctatccttccttttcattctcctctggacaactctctctctgtgttatatccttgtattacataacaggacagggtggcttcagcccaggacataagggagaggcttgtcttccaagaggcagccatccctccctccccctggacttgtgtctgagggaaggagtttgccctgggttctggcaccaggtgctgggttctttgatcggcagccctggagtgacctcttggcaggtggtcagtttgggacaggaaagacacaccctcagagtggggacgggcctgcctcacatcctcggatgaccaaggccctgcttatctttccaggattgcttagaggactggtgggtagggggaaccaggccgtgtatttccccagtctctgaggacaaggaaaaccctcagacctgaggcgagcgggcgttctggaggctgggcccccagctgcggagcttgggggaccggcttgccctaggaggagcatgggcaagggcagaggccagggtgtcaggaattgtggttccaggcctggcactgcccactccaccactgagaaggacagtcacttccccaccaggcctcaattttctagctgcagacaaaagaggttggcccaggtatactgtaaggcctcattcatcttagaggctctgtggtacattaaccccatctgggactctatgcacagttttgttgagtggagtttggtgggggctgtttaaaaatgtacccagaattttgtttttattcaggtagagggaggccaacagatcaggagacaactgccgttgaaaagacagtttgcggccgggcgcagtggctcagtcctgtaatcccagcactttgggaggctgaggcaggtggatcacctgaggtcgggagtttgagaccagcctgaccaacatggagtaaccccgtctcttttaaaaatacaaaaaaagaaaaaaaaattagctgggcatgatggcacacgcctgcaatcccagctattctggaggctgaggcaggagaatcacttgagcccaggaggtggaggttgcggtgagctgagatcacgccattgcactccagtctgggcaacaagagtgaaactctgtctcaaaataaataaataaataaataaaataaataaaaaataaaaaaagaaagaaaaaaagaaaagacagtttgctactcatagttcccagaggaaggggaggccccagggtcagttggggctggggtgggaggtgtggggagagtgtgggcacagcctctgttgtggcttgctttcataggaaggaatggtgaggtagggttggtggctcagcaggtttaggattggatagcttgaataatttccctgggccctgagctgtaggggtggtctgatgtgtggccctggggagatttagggtaggggtataatgtcctggactatggagcctgatgaaaaaaggctgtgggggcctgggctctggattggttggtctgctttgatataaagcctgcttgctatctccaggaattagcttaccctggtccttccctgggtctgcaaggccccagatgtcaaagcatcataaaatacacaacattttaaagacacaattaatacgggggccagttcagggtgcttccagcccttggtatcgtgtgtgaattagagaccagaacccctgttggtagacacagcagggcaagggctgttgggtaagggatcatgggctggatttcagccctccctggcccctgagccaggcaccttggagatggtggagcctaaacggcttcacctggcagccctggaaagtggccagatttagcaaataaaatacaggatactcagttaaatgtgaatttcagatatataatgactgtcttctttagtataagtatggcttgtgagtatgtccaatgcagtatttggaagatacttacattaaaaagttattatttttctgaaactcaaatttaactgggcatctgtcttagcccagctgggctgctataacaagatatataaactgggcggcttataaaccacagacatttatttctcactgttctggaggccgggaagtccaagatcaacgcagatttgttgtctgttgagggacagacacctggttcatagatgccctcttctcactgtgtcctcacaatgtggaagggacaaggggtctccctcaggcctcttttttgtaagggcactgatcccatttatgaagctccacccccatgacctgatcatctcctaaaggccccacctcctcatacttgggggttaggatcttgacatagaaatgttgggagccacaaacattcagaccgtgattgcatcctgcattttatctgcacccctagaacctggccactactgtccctgagtctcctcgtctgaccatggcctattgttagggtcttccccagcagttaccctaggacatagaggagagagagagagagagagagagagagagcacaagtcagataaaaggatggacacacatacaaatgagtaggagaaccacagcatgaatgagaaaaagtgacacagagtgagagagcaaaaaaagatacaaggagacaaagagtgagagaaaccaaaaggggcaggagagagggacagctgcagagagacagggcagctggttccctccccatccagcccccattatcccccctctacctaagcccagcccctccccagcagccccccaccatcctcctctctacctaacccccagcccctgccaaccagccccccactatcctcccctctacctaacccccccagcccctctccccagcccccaccatcctcttctctacctaaccccccagcccctctcctcttaggcccccatctagccccccgcctaaccccctctctacttaacctccacccctcctagtcccctcctaatccagcccccgctcctttagccccctccttacctagcctcctccccatcaactccctgtccacctagccccctccccacccactccccttgaagcccgtccacacccaccccctcccctccaggcctcaccttggagtaggtggccccattgatgacctctccctttcgcaaccagatgatggaggctgcaggcttggcattgtctgcgtggcaggtgaggttgagagggtcccccgcacgcaggctgatcacagggccccccaggatgacggggtcatcaggcggcactgcggggagagaagcagtgaggtcaggccgaggctcccacctcgggcaggacggcaggcaggctgggaggattttgtggagatggcaacaaacaataattatcacacattaataaaacgcatcgtccgcttgtatcgtaatgatgagagcagcacccacagtgatccctgacatgtgcactgcgtgcttacagtggaggatattcctgccagtcatcgcatccctgctcaggacctgccaggaggggacagggccagcagcctcagcctgcactcccagacccagaagcagagctctgtggcccaggcgatgtctgtggctgctttttaacttctttttccttttttcgagatgaagtctctgtcacccaggctggagtgcagtagcatgatctcggctcactgcaacctctgcctcccaggttcaagtgattctcctgccttagcctcccaagtagctgggactacaagcacgtggtaccatgcccggctaatttttttttttttttgtattttaagtagagttggggtttcaacatgttggccaggctggtcttgaactcctgacctcaggtgatctgcttgccttgcctcccaaagtgctaggattacaggcctgagccaccatgcccggccaacacctggttaatttttgtatttttagtagagatggggtttcaccatgttggccaggctggtctcgaactcctgacctcaggtaatccacccgcctcaggctcccaaagtgctgggattacaggcgtgagccacggcacctggcttttcttttttctttaaatgaagcactgtcacacctgctgtctgagttagtcctcacaacagtctggtgaggtcaacattaccaccccaatgacacagatccggaagccgagttccagcaagattagtgactggctcaaggtcacatggtggcagagccagggctggaggccaggcccagggaacctgggagcaccaggccggccccttccctggcagggagcagggtacagggcagcccttcacagtggagccagcgcttcggagggctgtgtaagcgctggcatctcctgagctcctcactcctccagagcggctccagccccttcatccccagaggcagcctgattctctcctgtcccagccttccactgcattttgtagtagggtcagagacgggtggctcccatcaagggatcctgagtgccaggaagagggccatccgcgtcggagcacggtctccgcagtgcccagcacagagccctgtgctggggaaactccactgacatttgctggccccactggggtcaccctttgattccgatgaggaccatgggctgaaggatggtggatgatcatggtttggaggagaggcccagaaatctgaagtaccttgcctaggacacagggcctttcccatgcttgtgcttggggacacgttgagagtctcaggcctctgctgctccctggacaagccacagaagggacaggaggtgaggcgactgtcctctgaggaatccctgtttcccttaccccaggaggagctgggcccaccagctctggaggctgagagaggcccagggcctctggacacatcaagacgtgagctgtctgtgtacacagcaaacacagaaggggtagttggataacgggggcgtgggaacctagcacaaagggtcctctctgcctggtggccagagaagcccgcccttctatgcaggctctgtgctcggggctctgggctggagaagttcagagctgaacagtcacagctccgggcccgtcctgactccactggctcagccttccagcctcagcctgcatgggaacttccctccccttctcaggggatcgccccgtcagcccttctcctagtccactccggcttctgtgaaagctccaggagggacaggaagccccagtgggggccggtaagaagccaagaagcaaaccttcagaacagctgccttgccctccctgcccggccttggaggcctgctcccacactaacagcacagcagtgccatttcctgaggaacaagcaacctcccagggcttccgagaagccatcactgaccccaggggcagcgagccccggactccaccgagatcctggctcaggaacagagtctgcctcaggcaaccctgcctggccctgggctcttgagccgggaggaagcaggcatgaatgggatggatggagaagacgaccccccagccgcccaccccacaccctttcattagtgcccatgggcctccttggggtgggcctggccacagggcaaaacggaggcggctcagggctttccaccaagtgggggtgggtgcaaccacttgtggaggaggggaattgcatctccacgcggtgagtgggggacttgcagcaggaagagcagggctcagaggtggccagccttcacccttctttcttcaaggcagcctccccgaccaggatggaggagctcgggctccatgagctagctgagggcctggaaaaagagccacgtggagccctggggacagcctggatacctggggcctcagccttcccagtgactgtggaaagtgcctgagagcagagggtggagcaggaagccccttctctcagggtggcttcaggtgcaaacgtgagagctcggaggatctgggaactgaccgctctccagcacggacatttactgggccttggacaggggtttgaagccttgactgcatgctcctctgcagaggttttaaaacctcactgcgggccacaccctgagcagccaagtcccagtctctggaggggaccccaggcatcaggactttggggagctccccagggggtcccatggcaggaccagctttctgggctctggactctgggctgaggggcaggagcctctgcttgctctgagcacagtgcagccaccaaggccttcccgagaatccaagacccagaggacgggcccttcctccttgtggctggagtgttgtgttactggaatatcggattagaggcagcgaggacgagggaggagggagtggggcgtgttgtgggagtgctcaggcacacgcacagccacgcacatacatccaccctcagaatggggcctgattacatcttcccaaataagtggttatcatgctgggtattcatgtagccaggcattattgattggtcttcgcttcactgcacaccagatgggggtgggggctgggggggggtgggggttggtgaggatggaggatgtttgggggccagcaggctgaagagaaatcagcagtcgctcttggcagctgtgtctggcgtggaagggggctcctcattacctccccattcagactcggccaggctgggccaggcagtggcgaggggaggaagtttcagagtggtccccgcttggagatgtattattcatcaccccctcgcaggattggttattatcctcaaccactatagagtttgggcttctaatttttaatcacaaggaaggtggaggcgttagccttttcgtgattaatccggagataaaaatagttgactgttttggtgttgtgcttgttgtcagtcaggaaaaaaatggcattaactgttggggcactgaagcctggggaggactgagcggatcccaggcagagtgggtccccagagctggaagccagcctaagaggccacagcgcggccttagccgggggtggctgagcgacactcctgcacccagctggctcctggggcattgattatgaaagaaacacatcatcgcgggatgctgagctctttacagtttactctcccattggccaggactggagcaggcagcttcagtctccctccctgctctgcccctacctgcccagctctgcagactttgccttgtttgggtgggcggtgggggtacccgtccctttccctgtgtgtgggagggagcccccaaaagctttccccaagttctgctgccaaagacaatggggtctcgggtggacaggtggcatggggagagggaaattgaggccagagagcacaagaggctgacccaaagttaccagtgacgagagcaaagaagggtgagggtgggcttgggacgcacatcctggctgtaactggagaggtaaagctttcatctatttcacgcactaaggttctctctaacctctatactcccctttttttagagacagtttgccaggttggccagcctcgtctgagcaggctggaaaaactctcttggtgccaggacaaggacagcactgagggaatttcctccagtgtccacttggtcacccaactgagacctggctgggcttccaggaattcctcgatgctccatcagcctgggatggttggtctctgagcatggctgatcggtggcagctggaggggtgggggaccagcagcaccaccctcctgcccccatactgcatggtggagaacctcatagacacccagccctttggagagcaagactggttctcatttgactcaatgagcagcgagttccccacaatgctggcagagtgggtctatcaccaacaccaaaccctccaggggcttcccgctgaaggagagtaggtgttgcctgcaagcaccagcacttacggccctcgctgcccctggggcctcggtctgttccaaccactccttacacagcagaccctggccccactgcgtctctgctgctcagcaaacccagctccttccggggccgggcttgccctgctcctctctgtctgtaacgctctttcctgttcctcactctgctggctcttcccgtcaatgaaggtgcagcttcaagagcccttcagtgactctccactacccacccctgcactttctggatcactgggttcatttattatctgtcaccgttctagaaaggacaacaaagaccttatctatcttggtcattgtgatattgctgtatcacacagtaggcgctaaagaaatatttgttgaatatattatttgttaaataaaagaatctcagaaggggagtggggatggggccggggggacggttatcatgggctttggcttctgaggtcagcgttttaaatcttgtgtgtgtgtatgtgtgtgtgtatatatgtgtgtacatgtgtgtatatgtgtgtatgtgtatatatgtgtgtacacgtgtgtatgtgtatatgtatatgcatgtatatgtgtgtatgtgtgtatgcgtgtgtatgtgtgtatgtatgtgtatatgtatatatgtatgtgtatgtatgtgcatgtagatgtacatgtgtgtatacatgtgtatgggtgtgtgtatacatgtgtatgtaagtgtgtgtgtgtatatgtgtgtgtatatgtgtgtttgtgtgtgtgcatgcatgtgtgtgtgcattgggtacagttgggaacgggctgcgtgagtagtgggagggaggagggcaaagcaggagcccttctgaggccagctgggacagcgctgtaggaactctgcgctgctgtggcatcagggttggtgctccctgtctctcctcgagagagggaagcctggctgaggggggcttggtgctgggagctgattctcagcctgtttctccgtggctgctgtcctctgatttgtctggaacataggatgggagagggcggcaggccgagcatggtgacagatcagagacacttggctgagtggggagaaggacgtttgtgggttctttgattttgttctgccgcagacccaggggctctgggagagtcagtgctaggagttccagcactgactacagtggagggaggatgccgaagcctcggggtgcatctcccacaccttcagcatcttctccatccccaggttccccgctgcagccctgcagtcagcctgccatgtgtcctgccctcctgcctccctccctcccaacctttctctcaccagcctcctccatgtcacaagctgaggctatgatagctgagtgaagccatacacggcctgccatcttagagctgatggggaggcccttgccactccaggccagtgcccaagacggacatgtgtgcagccttggcacctcctgggagcttgttagaaaagcagactcttgtgctccacctcagacctcctaagtcaaaatctgcctttgaaaagaccccagacaattcacatacattttcaagctggaggagcgctgctctaagggttccgaggtagaaatcatgacaaactgacaagtgctatgaagggaaggctcactggacaaagagcacgtgtggggacccttgatcccttcacaggctgcctgctcccttcgctcccccggggccggccagagaaaggggcagactgctccctgcttactagctttggagttacacgatcttgtttcagaacagcttcctttgtgtatgccgtttctttagcttggaatgctggcgttctcctggaccactggtcttctcctgggtcactcttacacaccctttgagacttagttcagagggcaccctctctgagcggcctttctagaatctgccagttgggccaagtgtatagggcttctgtctatgatcccacagcatcctgggcatcccctgactcactagctaccacatcctatggaaatctctctgtgtgtgtctcttccctgaaccatgatctccatccggatccccatctcccagcagagtgcctgcctgctgcacagggcacagggtggcatatgcatttgctgagctgaacttgacttgagtcgatcactttatgagccatatgattgtagacaagttatataatccgacaaccttaatcctcttatctgggaagtgagataataaaaatacctatcttgcagggttatcatgaggattaccttacaatatgaaagatacacagagaacattgtaaaaggctatacaaatgtaggttattatgtctaatttttaggaataatatttaggtttgtggctgtgtgaaaagtgctgagccaaggtcctctcattttattctcaatatcttttgaggcagggactattagggtcttcattttataggttaagaagctgagactcagagagggcaaattacttggcaaagaccacacagccataagtggtgaagttggaatttagactcgagattttgaccctacaacatgttctgttggagttagagcagctcccagactatccctgcagctgcagcagcccttccactaacccctgcctttgtcctggccctagagctctgcgaagcgggctctctgcctgtcccagggggcattcagacctggcaggtactctcctcccttccctccccgcagtctgaatttcagagggccccaggaagcatgagcctggctcgcagttggtgctttggcgatgtctgctaagggaacggacgaatgttgtttgtagtccgcccagctctttgctgccttttgtggttttgcccggttctctggttctgggccgcgtgtaatcccagcttccggtttcctcacgtatacagatgcgccacctaatggccacaatggagaactgcaggatgtagagacaagagggagctgacctggttttaagagtcagcttcccagtggtagccgaacaatgtttggagaaattcgtattgagcacctactatacgccaggccctttctaaacactagggacaagaagcttctgccctagtggagtttaccttctagtgggagagacagacaataaatgaatacacaaatacatacataatacaaggttaggtgttgataagtactagaaggaaagtaacactgggcagggaatagatacatcctaaattggcctccgggattccctcctggcttttctccttcctctctggttgttactttttgttttcttcccaccccttaaatgctggtcttccctagttagctcttgctggccatatctcatttgacacactatctaatggaaaaccttcacttttctgtgaactcaactcacatctttaagctgacgaattccaaagaagcatctcaggccagacctctctcttgagctccagagtcatgacccaactgtccacgggccttcgaagctcagcaggtgtgacaccacacccaccgcctctcccagacacccatccatccccatattctgtattttggagaatggccccactgtttggggaccaagtcagaaatctgggggtctttctggattccactctcagtcaccctgtcttgccaactagcctggttaaccctctgaagtatcgctcagatttgtctctttccattcccacaggcttcctggatcagccatcatccttttgtgcttggattacaatagtgcttctcccctccatctcctagtcctctgtgcttttccagagtgactgttacagaagtctgaatattcacctatccagtcaaccagtaattcacccaccatgtgctgaatgtctagcattcctctgtttcaaatcctctgaaagtccctcattgccatctaaatagtctgaacttcttggccactgctgactcttcggccttgcttttcatcacttcttacctcaattcctccttgtggataagagccacctgcatttgttggagtaaatcgcttttccccaattgcccctttccattttttatttatttatcttttttgagacagagtttcactcttgttgcccaggctggagtgcaatggcatgatctcggctcactgcaacctctgcctcctgggttcaagtgattctcctgcctcagcctcctgagtagctgggattacaagtgcccaccatcatgcctggctaatttttgtatttttagtagagatggagtttcaccatgttggctaggctggtctcgaactcctgacctcaggtgatccacctgccttggtctcccaaaatgctgggattacaggcatgaaccaccgtgccgggcctgcccctttccttttgctttgctaacttgaaggtcgggcagcttgggtttgaatcctgggtgctatgtttactggcttgtggccatgggaaaactgcttagcttctctgtgcctcagtgtccttatttgtaaaatatgaattaaaataacaaaaccagattcactgtatagttgccagggtcaaggaagatgtaacatgagaaaatgctttgtaaagggtctgatggatgatgtggcatgttattggttctctaagcagactgggctcattcctttgaaaggcgatagacgggcaggggagctgggacttagaagtcccagattgcccccttggtaaagcagaggtctatgtccttttccctgctttgccctgctgggagctgggtgaagaccctgctgctcccatgggtgattccacgctgccctgcctggcttggcatcccctccctctgggcccccccacattctgtgccaactgaggcacacactgcttatgggctgcaaaggcacatgtgagccccatgtggagcagagagatgagccatctcagctgagctcagcccagattgctgactcacagttttggagtggtttattatgcagtatctgcattcagaacacaatactccaagatatcgcatcttagaagttgagaaaacagcagaagcaaaaagtttactctccaatcccctgccttcctgggcgagagctagctgtaaaaaattctttgacccatctcccctgaaactaggtcatgagatcctcattccagagggatcctgccctatactcagaggaaagaaacggtgtacaggaactcaaagaggaatgcaggcaaggccttgctaagttcttctggtttgttaccatgaggtcatacccccttttttgtccaatcacatttctgcacaactgcccattctttgttgaacataagcctacaaatacacaattttcccatggcatttgggccttcatttctgaaagctcacataaaactttggttaaatacatctgttgcacttttctcttcttaatctatcgtttgttacacgggtgtcagctgcaaaccttgtaatggatgaggaaaatatattactttttctcccctgcagcagcaaaagctaactgatgtaacccagtagtcccctgctgtttgattcagaactgggcccacggcatcaactgtctctccacttccctccgatccattctccctccactatggccaggtgactgttctggaagctcggtctgctgctcacaatgttcaatggttcccactgctccagcacaaaaatcaattcctcatcatgggggccttccccggttctctccagtgaggtctcatctctgcagctttctcctgtgtgaccattaactcttctgtgaggatagcctgcccttttacaaatacacgctttggcttgtgaagttccctttgctgggaatctccttgcctgagtcttaactggctggaatcccagcctcttttcaatcagctcaaaggcctatcatgccttgttaactcttggttattctttaagactcaggctattgtcacctcctccacaaagtcttctctcaatctcaacccctgactctcccacctgcagcctctgcactgccataagaccatgtgcccgcctcagcaggtacatgtggtgcctggcgccattaccacctgttgttcccctgaggctgtgagctccttgagggctggtccttgccaaattctctctctagtacttagtacagtgcctggcatagtgagcacttaataaatacttgttgcctggtgccttgcctgatcccactgaattagaagccccctccccacctgagcacctcttacactggtcctcaccacatctctattgcattgacttgtggacctgtttcaggttccctacagttgcagggtaggagtcctggcgcctctttgcctgtctcccattgcctagtatgttaccttggatgcagtcataaaaaaacagcaccaataatatgaataatagctaacattgatatagggcttaccacacagcaagaactcttctgtgtactttacaaatatcctttaatcctcacagctctatataaggtagatacaatgacgatgcatattttggaggtgaggaaacagccacaaagtagtcaagttacttgcccaacatcacatagctagtaagcagcagagctgggatatgggtagggtttccagacttaacaaatcaaagaacagtaggccctgttaaatgtaaatttcagataaattaaaaaatggtagtgtaagtatgtttatctgaaattcacatttaacagggaatcctgtattttatctggcaatcctgtagatgtgttaattacatatatgtgatttaattaatgtaggtgtgctttccccctcttcagaccctccccgcctccacttaggtctatattaagaagatgtggggcaagatgcaaatgggatttttttttttttttttctgagacggagtctcgctcttgtcacccaggctggagtgcaatggcacaatgtaggctcactgcagcctccgcctcccaggttcaagcgattctcctgcctcagccttttaaatagctgggattacaggcacctgccaccacgcctggctgatattttttggtacttttggtggagacggggtttcgtcatgttggccaggctggtctcaaacgcctgacctcaggtgatccgcccaccttagcctccaaagtgctgggattacagctgtgagccactgcgcccggccacaagtgggattgttaaaggatgtggcatccgatatatttggcagcacaatcgcacagacgtgtctccaaggaggttggggacagagagaaaagaggaacaaggagcaagacgcaggtttaggatgatggcatgtagctcagaggaaggtgtgctggaggctgtttcagttctgctcctaacctgggggtggggggaaccctgaactagctgacttcagaggtcccctgcaaaggtttgggacactgggaagcccacttctcagctggagctcatattgtttaggggataagaagggaggccctgaagtcagagtgcctggctgggcttctggctccgtcattcactggccacgtgaccatgtgcaaattctctgtgctggatgatgttaatgtcatagatattatagtagctgttgtacagggctggtgtgctgtttaaatgagttcatgtaagagttatgcagtgtcttgtcccagagcttggcactgtagtaagaacccactaaattttagctcttagtattattgttgtttatttaataagtaactccacatgggggcagagtagcatattgcatgtgaaatgggcttgtttccacctcttgttctgctattaccttgttccatgcccagccctggactcctgagatggaatggtcagtaccttgcctcaaagcacctttaaaccactagagcgatgacaaggaggtcacagacccaaagatcccacagctgtacaggtctgatgggcagccctgctgcctttaggcaggagaccccaagggagggagggctagtccagtgggccagggaaagggagccaggtgctgtcagggtcaaagtcagcagtggcttggttcgctccttaaattaggaagggtgaatgtcctgtttatatttggttaaaccctgaaagagggtctgagcatctcagggcagagctacttgtgaggagacagacgtttcattaataatgagtagggatgtaagtctcaggctgtatgcagagtggaggaagggaggtgggtagagaagggagctgcagtgatttgcactcaagcagaccagtgtgcctgtgccggctccagatgacagagggtgctacgtggccgccgtctgcacagcaagggtgagagggcttgggagaggccagcagagaagggacagtggggtgggggagtgcatcaaactggagagaggaaggggtgagtagggctggggcaggaaggccagtgtgtggtgctgggtggcttacactcaccctcccagtcctgcggagcgagagactttctcctttctccagcccagctcctatgctgatggctgcaggatgggtgagagcgcttcttaggtgtgtttgcaggaataaccggcacatgcccccttgcagccgctcacaaagctctccagctggtttcgaccttaacctgatttggggtctcttttgctcaacacagctgggttggtgggaaaagcccatcatggtggctgccgtggacttgtataatccatgcttcatggtatggtgggcccttgcagtagccttatttcataggtgggtaaactgaggcataggctggccaaaacatttggggcaagtcacgcaactggcaaggactctggctcagatcctgctgccccaaccactcagtcctaactgcggtaccataggctgtgctagcaggaggatctgcattggttcacttcggtagctttaatagcatcaaggcagccatcctgacccagcaaagggccaggcagggacttggagtgtccccgctggtcccataaatagaagcagaactgatatagttggttttgctatgggctccccatccggtaaatccacctcctcaacgagcctcatagtttcagtaaggacgaaaatgaggccaggtagaaatcctgcctaccgataccctggagcctcagaagtcttagcagaaatggaggggcgcaggaagatggtcattacattaaggggtttaaaaaataagcacaagacattccagtagctttcttttgagatgacagattaggaatactgtgttttgcaggataaaagcatgcatttgttccatatcttggttggttacaggccagcagggcaggcaggaggagggaatagagaggtgaccatgagacagaagggcaaaaattaaaaagacaggcaaagaggcaaagacacagggcggggcgtggggtgcaagtcacctgctcaggaagaagatggatgtggggagacacacacagtcctttgggatggagcaccataaaaccaaatggcagtgttccaaggaaggaaacaagcaaaacactttctctaggcctcttgctacaaacactcatttcagggaatcccagaaaatcactaaaatatacctttcaactttatgcaaatttaccagatccactgtttgccagaatcctaagaggaaaaagtcaaaatccttttccgacctgagccttcttctttttttgttttttctcaaaaagtacaagcttctacatttgaaaaagggcaatatttttagaactcattagatgaaagtgttttaattctcatctacagtctggccttatagttattttttgaaatctcctctgttcctcatttttcacatttgccccattctggggagggaggcctggcctttttaccctgtggggacagtcactggaagtgagcttcctgtctttagccacagacaactccagagtggaactcagcagggagttggccgccccgcactccagcatgagtccttctgtcctgtcctgaaaggggtaaagagaaacttggtagcaccgcagcttccactacggggtgccgctcacagaaggcggaggtggagggagggaatggcctcttcccccagggtgtcttctttcgctccatcactgttgaggtgggatggggctggttttggcactagagtgcttacgatcagaataagccccttattcagaataagaagagcttggttactgggtaaggaggggactgtgggcctcctatgttcatctgagacctattcaccggggcagggagggactcctcatctggctctgattatccctacaattaagtttgctggtgttggtggggatggctttggggccacccaggcccctgcatctccagcccttggtgggtgatgtcaggcaggtgaagaaagggcacagcctttgctctcagacagagctgggaatgatcccacagggtgaccctgaacaagtttatcaaccttcctgagcctcagtttcctcacctgtaaagtggagctaatatgtgcctcgagtaatgcaggattaaaggagaagatgtagtaggtccgcagtcgtggaggcagcctgctggtcagcatgaagacaaaggctgctgctgaagacccactgccttctcttgtgtgaagatgagctgctcccctggttaaggcagagtggcaaggaagctcagaccaaatgcatttgtgcagtggaagagaagcaacatggaaggagccgcggcttccagtgacctggcctgtggcccagggagctgcagatggaggctccgtgagctggagcccacaccctcccaccacccatgagccacacagggaaagcctgctaggtgactgctctcctctggcctctccctgctcctacctgttccccacaggggatccccccaaaatgacgatctaatcaagttgtccctctgcttatggtgtccaaagccccacagcacccaggcctggccacctttgcagccttaccccgtgcccgtctccagccaggaagacgggatccttgccgcaggccacagccacatagccacgggcctcggaccctggatctgtggctctctcctccgagactgcgcttcctttcctttcctgacttgtggacacctacacgatgttcagtgtttgctcaaatgtgccctctgacctccactagactgcgcttaggcatctggagcgcagcagtcagtctcatcctggggtgcatcccagggctcagcctgggacctcagcatggggctgagcaggacggaagctgtagatggatgcgctgcgtttgcggtggagagccggctgcatgggaatcactgctggctggacccgggtgcctggctcgatgggagcttcctaagggaagcagccctgtcatgttcctctttgtctctctctcctgccccagctcagcctgcacggagcaggtgctcaacagatgagcaccccatcaatgatggaagggtaagaagagacgcctgcatcaggtgggagttaggtggggaaaacaaagcttccagaggggatactttgggaggcgcagatctaggacacattgataagcatggagtgtcaactatgttccaaaagcttcctgatggccctattgttactccatcttggattcctgggtcaattttgggagatgctgagatctgtagtccataagggcattgctggatgcagatgtgtgaatcaccataagtttggacccaggacagctggtgtcccctggctttcctgagaccttggacgtgccccttcccctctgcattccccactctccaccttccaccacccctttctcaggggcccatcagctaggcctagcagcccttggatccttaatcacctctgttcttttgctggctctctctgaggcttccctttcagctttgatgagcaactcacttgccatggaaagtgtgttgttcatggcggatcctctatcaaaaaacaggatggtgtcgagttgcagtgggtgcgctgggatcagtccgggttaaaatacgtgggtctcagctcagatctccatccctggcactgtgcaggaatctgggcgtgttagtgctgcatacgttggggaaaatgagacgtgttgcttggaagcagcccatgagctgcttcgaggagtgaacggggtgaggtgtccagtgttgctttgaagtgaaatgttttggatgtgccttaaagtcacagttagctcccatgatgggcattcgtgtttgtggccagaggcatacataatccaaatctggtgtataattgagaatattatttgcatttggctttggaatgcattgtgtgtgtgtgtgtgtgtgtgtgtgtgtggcgggggcgggggaggcaaggcagctttactttctgtgtatgtttattttagactcccattagcattaatttgcattcactggacacagccgctagggagaggtgagcagagctttctccccatgaagtattcttcagcctggccctgtccgtgagccaggttattggaaatagaccatgtaggcctgtgttccacgggtgctcagaaaagaccatgtaggcctgtgttccacgggtgctcagaaatcctgggggctgagatacaacctcagtgaacaagccactgggccagggatgcagagctgtgtttgtggtgagacctgggagcgactcctggactcccggttccaggctgcatggccttggatacgttaattagttatttgagcctgtgtcttcgtcataaaataagagggataataattctgtgaaggttaggagaagttccatgggatggcatttgtgacgtccccagaacagggctcagtgaatgctcattccttttcttgtctctcctccctcctcgtctcccaaagaatgggtctgccttcttcatctcttgcgagtctgggactccaagggccgagcagagccggcagtagcatttggagtcaaataggaagacgccactgcttccttctggagtgcaaggtcaggcagggatgctcatttgctcttaagggtgcagggggtccacaaatgcctgaggatccacagcccacctgcacgaggagggggcgtttggagggtggaggagagcctgttgtctctttggagaatggggcagggctctgtctggattttgggtccatcccgtagtggaaaggggtcctatgtgaacagaagggagggcttcagataatcctgaaaccggaatcccaaagacaagccctgagtctccaggccaccactttctacctgcgtggactctggcgagttgcacctccccgggcgtcagcgtctgcatctgaaagtgggcatggcggtgaaaccacctgagggtcaggaaggctgagtgaaggccagaagcctgtgagcctgaaactctgctcaggtgtccgaatgtaatgtgagcccaaggagggcgggcgcgtgctggctctgagcgggtgctttattgtgtgatgggtggggacacttgctctcagggggaaagaaagcgccctctcttcctgcagggctggctgagaactaattcaaggccatgtgactctggctaaagcctgcatcctggttctctgctcccatctgggccagactgttggactccagtgttgtctgtcccccgagtcgaggtctggggcaggtaaggaggccatatcaggaacacctgcccatgtctgtccccagagagaagacccaggagttcaagcatggtgcagagaagttgagcaacatgcccaaagcagccaagattaccgtttctttgtgctccccacacacagatttggatgtttttctttttttcttttttctttttttttatatttatacggagtcttgctctgtcacccaagctggagttcagtggcatgatctcggctcactgcaacctccacctcccaggttcaagcgattctcctgcctcagctgcctgagtagctgggactacaggcgcgcaccaccatgcctggctaatttttgtatttttagtagagatggggtttcaccatgttggccaggctggtctcgaactccagacctcaagtgatcctcccgcatcagcttcccaaagtgctaggattacaggtgtgagccaccacgcctgggagatttggagtattgatagagggatttcagaatctggacttttattgtctcacttcccttcagtgagccaaagggccccatccttgcttacctcagtttcctccgggcttataaaatggacaaaaggataagttgcagagggccaccgaggaactgggaggatgatctatagacagtctcctcttcactgaaaggggaagatgggctcaggctgcagcgtgagggagtgaggttagacatctggaagaactgttgttggagacacagctggggaagggaggtcaggcctctttttcccaagcctgttcccctacccccgatgagggatgaggtggatgtgacaaggtgacatgaccctaaggcagggggatggacctggtggctctgcaaagcccctctcagcccctgtccactcaagtacttcctcattagttttgctgaagttacttccctgctcccagttagcccctgtccgtccagttctgagaggtgtttctatctgtaggggccgaggggctaggggagcatggggctggagtgggaaggaggaggaggagggatgaggctgccaattgccaccgccacacagcaagcgtcacctcagctgttggaggggaacagccaccaggccatttttatgacttcctatcaaactttgataaattgactctgaaagggccttttcttccaagcagttcatgcctcagtgactgttaatggtgaaatatcaagatgctgagggggctctgagctggaccgtgcagggaggactggcttcttacctgccccgagacccagctctttcctcctcttggatgctctggagagggagggggcaggactagatagagacctccaggcagatggcaaggttggtctccagaaaagacagaccaggggatgagggtggaggaattaagttagacatgccgcagaacttcctggccgtgggctgagtgacccaaaaggccgtagaacagcctcggtgctgcggctaactgacagggggcaggaattggcactgcttgttgcacagcaatttccctgcagggattgacgtggagcgtcacaaagacagtgaggtaggcagtgaggtaggcagagtagcaacctgcctctatctcatggcctctcagggcaggcagcagccctcctggactcaggaggaaagggctcagtggggaccacaggcattgagcccaatgcctctcaggcatcatgcaatgagaattggagctgggctgggcgcggtggctcatgcctgtaatcctagcactttgggaggccgagacgggtggatcacgaggccaggagattgagaccatcctggctaacacggtgaaaccccatctctactaaagatacaaaaaattagccgggcacagtggctcacgcctgtaatcctagcactttgggaggctgaggcggatggatcacgaggtcaggagatcgagaccaccctggctaacacggtgaaaccccacctctactaaaaatacaaaaaactagccgggtgtggtggtgggtgcctgtagtcccagctacttgggaggctgaggcaggagaatggcgtgaacccaggaggcggagcttgcagtgagctgagatcgcgccaccgcactccagcctgggcgacagagcaagactctgtctcaaaaaaaaaaaaaaaaaaaaagagagaattggagctgaacctgaacttcaagtccagagaggtttccctacagcccccctcacccacagcagcctgcatcttctactctgcccccagctggccccgcctgggcaaacacatggtgacagggcagtcgctggcccagagctgcttcattcctacttctcccttccttcaaggctggttctgggtcccggaaccatcctttcctggttcaggctgggtgcaggccgtccagcaccacctctctgactcaaggctggaattagtggggaggtgagtgaggctcttgtctcgggcacaaactttaagggtgtactcaaaaccccagtaatggaaataaataatatcttaatgcaaattaaacaaatcagaatgaatgtaaaaatatccacgatgaggaaaatatcacaattttaagtaaagacaggattagggagctgcagttaattaagaattgtttaagatggtcacttggtcaagagaaatggtcaaaatgccaattctctcagtcgaaaatgagataagcaaagaagtagatgattactattactggtgagttattttccattacagccaggaaagtaaaatgaaatacattctgtttttgctgtaaataaaatatttaagtgtaacataatgttggggattttaatacacctgcttttaaatgtttcaatatttttccaactacttcaatgttctggaaaaaatttaccacttaaagaatactttaaaaatataaatgaggtgcacgttttccctcttgctgcagggtctattgtgacttggcttggtgctgttgctgatcctatctttgtctaatattttgatattttgcttatcatggattttttcacattcatttggatttttaaaaatattgctttaaaatattatttgtctagattattgattctttgggtaccctttacattttgtgcctgagaatgatgcctcactctgaacttagttttattctgttcccagagagggaagctgcctctctatcctgtccttggtggggataaaatggaaaaggatccctcctcgggccctgggacccacctggggcatgttcaggcctgaaactgttttggggcggtgagcgctaggacaggcgcaggctgccaaggaaagatggatgggctcccgaggcccacagacagagacgggcagccactaccgagctcatccatcgggacccctgtgggatgacactcaccttaatcaggccacaagggccccgggcctgagggatgcgggtggcgtgggacggggagaagcgggtgagcagacgctcctgtaggctctaagttggtgtctggagaggagtgagaggttcaaccagggtggctaggctgtgcactggccaattccagtgggcactgagcacttagctggcccctcttaggccctgacctccaggcaagtcccaaggtctgttgctcggaccctgggctgtgctgtgtgtggggaaggactagcaggaagggaggagacagatggaggaggacacttagggcagggcctgcaaactggctcttccttgcctttcaggaactcccagtggctttcccttgtttgcagagtgcagtgtgacccatcagcttgacttccgggccctctgtaccctggcccaagcctctcttgccctctgagccccagagatcctctacatgaacctccctctctgcgccctacctccagcaccctctgacctccctgcctgaccccaggtggttctgctttctccccaaagcctccctcgactgtctgtgttcctcgtctccgctcatccttgctggccgggtttctggttgtggctgttgtgtgtgtggacgtgttgctaggaatgagggcctgagttattgtttatacctggccttcctcctccgggtctagcgccaccccagcagcagatgcctcaggaaggaagcgaccctgttgtgtcctccctgctgtgacaccaggtataagcagaaacttatggtcacagtcaggaccatggaggaggaggggcactcagagattcacctgccctctctgagcccatgtgggcactccctgcccttctcaccgctctccttgtaaaaggcagtgctgtgcagcagcctgaggatcaggacactgggactctagtcctgacactcagcaaatggcaactgcatgctaccaggagctcaggccaaacaccttgggattgtccttgacttgccctttctctcgtatcctaattgctgtgggctccacctttgaaacatgcacagatcatcctttctcagtatctgcactgctactaccccagcgctccagcccctagctgtttgcatctgcatagcccaggcaacagacatgtgaccccagcccctcctatgtctgattgcagagatccagaaccattcagctaagccaggctcagtttcttgacctgcagaaactgtgagagctaagaaatgattcctgtaattttaagccactgagcttggaggtgatttgttatgcagaaattgacaaccagacagattttgcagaactagccagtcaactttcaaaggtactttgtgctcggaacattgagaggcactgtgctgtttgcaaaatgctttctatacacgttcatctttctctttaccagaaccctgaacactggtaaggcaggcattcttagtcctcactttatagatgaagaaactgagggtcagagaggctaagtgatttggacaagggtacacagctgaaaaatgaaagggccagtcttagggcctaggaattcccatgataagttcagtgccttccctgccaccccatggctgccatttcttctcactcccttcacaaatgagaacccaaggtgttggccaagtttggagggaggggtgggtgtgatggaggcaaagggaaggaagaccacatccacagggtcttgggaggtggggtggagggacattcctggagaaggaggctaagtctggggtaggtgtcaagagactgagggctactcttggcttcttgtatctgccaaaacccaaacagaagcgctcagaaatgttggagggcctgcgtgcgaactcaaggcctgaggctgtaggcagggagtcagggctggggaagctgggctcagccaggggactgagacataggtcacaaatctaggagacttctctctggggcctctggaagctggggccagttctccagtgcctcaatgtcccggaattgcttcttggaggccaatgagagtgggcagaactgagcaatggaggaggaggcccacccttgctgtagggaaatggccaaggaaatgcaccccagcctgggaatcctgtcagggagtggggtccagtgcttagccagagcagctgcatacaggaccacacgtgacacagaggcatgtgaggctctgcatgtgcctgggcttaaagcctgcttggctgtgtgtgtgtgtgtgtgtgtgacagagagagagcgagagagtgtgagagtgtgcatgtgtaagagagtgtgtgagagtgtgagtgtgtgtgagtgtgagtgtgtgagagtgagtgtgtgtgagacagtgtgagtgtgtgcgtgacagtgtgagtgtctgtgtgacagggtgtgtgtgtgagagagagagagagcgagagagagtaagacagagagagagagactcccttttccccaaaatgtcaccaaggggggtcattttctgtgtgcctgccatctctgttcccagtcaccagcatattgcaagtcaaagggaggcctttccggtaatttgagcatttccaacaaataactctggtctcccagtgcaccagcctacagtggccgcagggccacaacgcactcttcccagagctgctagagctcacctctgctcttcagctcagattctagttggcatctgttatcacagggaactctctctggatggagatgctcaagctcagagaagtgagcaaactctcttctggttgcacagcgggctctcagccttcccacttctggtaagctgcttgaactgagaagtcactgatttttctcaccagatgaagaagccacgccagtgcacatggatgcatgcctactaatgttcagccccacctccaggtgctctcttggggagggaggggcccctataccggtcctgggtgggagtttagtgtagctcctccttcagtcaccaagcactttctctgtgccaagcctgggcctgagcctggagattccaagaggattaagccatggtctctgatccccagagagtttgtgggcccccgtggaatacacacagccccttcctaaccttcctaggccctgcagataagtgagtcaggcatctggctcagtaaaaagtgtcttctccattttatggacaaggaagcagaggctcagagagggtaaatgacttgccccaaatcacacagccagtaagcctgcttagtagctctactgcatcacactggtctggaccaagctgattgagtgaaagggggcagagttggggtggccatcaaacccctaaaacccgaggaggggaagagaggggtagcacaaaagaggatttactttcttcccccaaaatgatgtcatcagctaagacaaaaagaaaaagaaaacgcccattttctcactccaagtttccccctcattaattttaatctaatttgctcataacattcctcagtaaacagcagcctctctttaataagccaggctcttccccccgaccctgcgattgtgttcctaatcagccagtgtatcaggaaagacctgctgctaattgtcgctaggcatcacactatcctgtctgtcaggtaaggggtggcagcgagagataattataatcagatctaattagtaattataaaagatcccgactagaaattgttttcagttaaatattcccagagaggtgctaatggtctccggggcatgccaagtgtcacagccaggaggggaaggggcccgtgacctggcaccctgtgacgacaagcagaggagactcagtgatgagaggaatggtgtgtccatggggacagagctggcctggcgtcccagtatcctgcttcctgggaggagcaccttcccttctgcacctaaggttgagtccccctcccacaggagcacctgcgtgggccctcagtaaatgccagttcttcacaggctcaggacctcgacgcacggaaacttctggatcattaaagaagctgtgtgggccaggtgcagtgggtccgcctgtaatcccagcactttgggaggtggaggcgggtggatcacctgaggtcatgagtttgagaccagcttgggcaacatggccagcatttaatgcaaaaattagccaggtgtggtggcacatgcctgtaatcccagctactcggaggcagaggcatgagaatcacctgaacctgggagacggaagttgcagtgagccgagattgtgccactgcaccccagcctggacaacagagcaagactccgtttcaaaaaaaaaaaaaaaagctgtgcgttgctcaggcagcatgggatatttctgctggaatcgtcattgcattgaatgggattaaaggctttacctaggagtcccctggctaacgaaaatccattgggtgactctccgccccactttagtgcctcctgcctcgggacttcccctttctttttcatcgttagtaagcatctgcaaactcccggttgccctacttactttctgttaacaggacctaactacccaacacttccctgccttcagattcacgccccataccctgcatggttctgttcctgggaccctcggatcaggcgatgagctctcttaaacacctaggacggctccacactgcccacagccaaattcagatgctccagcgtggctcaaagccctttccactgagccccaacctgttgactgggctgacatccgactacacttgctcaagcattgcacgccaaacatcccaaacgctcacgttagggagtgggggcagggtgggcgtctatctttctgtgcctttgattttgttgctatgattacgttttcattttccagctgctaaaatcctacccattctaccaagggagagttcggtagttactgaagtcttgttactgaagtcttgtgaagtcatcccagattttctgagttgaaatgaacacttcctcagtattgtgcttatatattcgagggcttcttttatcctgcctgggatggtagtgagttgtttatgtcttctccctcctttggcagtaaactccttgagggcacagagggcattttgctatttctgcatcttcccattgggtctgatacaatgcttttgcacatcgtaagcatttaataaagatgtgaaggataaacgagtgaatgtattaatgggaagcttctacccactgactgcactatgatttcaatgtaaatgcttctgggaagccgacctctagttccccaggtccagatccttgaacctgtctttattattagatgctgttgggttgtcggagtacgattaggtggaatttggccagtagttgcaggaatctcagcctccccaaagccacctgatgtgaggctagcgtgactgactgaggagctgtatttttagtcttatttaacttgaattaatttaaatttaaatagccactgtggctagtggcttggtgcatctcagctgagagaccttggagccaccactatgtagggcagcctggagagtccagactcaaagcctgcttggtgtctggtgagcctggctacaagcgactcacattaatttagttgaaaaacaggatgtggctggacacagtggctcatgcctgtaatcccagcacttcgggaggccgaggcgagtggatcacttgagatcaggaattcgagaccagcctgaccaacatggtgaaaccccgtctctacaaaaagtacaaaaattagctgggcgtggtggcgggcacctgtaatcccagctacttgggaggctgaggtaagataattgcttgaacccaggaggcagaggttgcagtgagctgagatcgcaccactgcactatagcctgggcaacagagtgagactttaactcaaaaaaaaaaaaaaagaaaaagaaaagaaaaacagtatatattttcactgcattcttatttttttcagtgctgataccagatcagcatactcataactctgttaaccagaatgggagactaagtggggaaatgccacgctctgaccatgtgaggagttcaagtataatttacttcattcacagcttcttgaatggctgctgctggtctgttgcatttgtccacctgtttgcatctgcatgcggatcccaaatgtcagcctttccccttctgacgccctccacccgctgccgagacatctccgtgtagctttcctggctctgcctctcccagcctcctcctctgggtttcatttccttgctgtgagccttgtgcgaggcaggatatctccagtgcaaggacactactggtggacagctggtccgtcccacacttttctctgcacgtctgaggagtccaggaggactggctgaggctgcaggcaggaagctcagttgggtgaacccaggcaaacccaggagtcagcctggctctggccctagcttgaacgcctcggttgtagttctaaagcctattcatttcctccatgttcacatctttaagaggggaagacggggctgcagagggagaggagccagcttggggcctggggtgcagtcttagagactaaggaggctcctctggggagcgagggtgcccaggtggggaaggcagagcgcaggtcgagcagattctaccgcagcccgtcctgggtcctgttgatgtgctacacattgcagggagcattttcatcccaggcggtgcgtgacaaagctaggatttgaacccaggctgttcaactccaagttctgggctctttaaaatagggcagttattagcagggaaggaacacactgcccactcatctatgacaaatcaattaatttgtccaaattccactcatgctttcaaactcacttaaaccctccttaaagcctacacttgccaactcgcctggccctgggcactgcttgcctctgcctgcctttgcctccttttcccgcttctgttcctagttcaacccccacccacattgtgagctccctgaaggcaggtccatgtctggggtgggccaggtgaggggtggaaaacatcgataccagtgacttacatgcacccaggtgccaaggtaagcacggacgagtggggactggtgggccacatcccgcccaagggagcagccattacataattgtttgcaagcaggcaaacaggcataaactgaccaggtctttgtaagagaagccagaaatcagaatttttttttaatataaaaccccccagaatcttaaacatggataatgaatgtaaaaaactctacagatactccggaagctaaccggatccatccatgtgcctgccctggcctccccttaattgtcagctgctgcatatgaatccaggttcagccattcaaaagttctctgcccacttgaaaagggtctcaccttgggcagatctcatgctgcctagcacaggggatgcatccactcaccgcactggaccagcacaccagctagggaagcacagtttgagagctcctgggacctgtcctggctgtgctgcccacagcccctcctccactcctcctggcaagaggaaacaggacagctcctcctgcccaggcacagtcagaagaagctgtcccttctgggcaggcacacctcagagggaaagcaattcaattaagccctggttcacagcgagtgctaaaaacctccctctggagaaccattttctgctatagatttttaagaccagcagctggagaatcactcttcctttttctcttttggtgctgtgtctctctagtcaataaataagtgggaaataaagtatttgcaagaaaatagaatgcagtcgaaaggtaaattgtggacttaaaagcccctaagagactggcgcagacttggaaatgtttcctagtttgacacctcttgcttctctaagcccagcttctggctctccgatttgcatctccaaaaggtgatctttaaaactgatttccttcagttgcatttcattggtgtagaaactaagcaggctgttgcattacagtaataacatcaacatttcacctgccttcgccttaattatttttctctcttgcgatggaatccatttaataagatttacaggtggcaaggaggtggggtgagctggtgtgcggctcagataatcggccaagctgatttctccctcattgggtgtcaccagtataaaaacatgaactaaaagctttgcagcgcttaagtaataataatgtcagcatttcacctgcctccccttgattatttttcctccctcgttcttgccacctgaacctgtttagataagattgccacacagatagaaaccaagggctctcattctcttagataagctgctgtttttctatggtttggtgtgaaaagggagtgttgctggcagaaaggctctgtctcagatcttcctggtggggggcgtccgagcctgtggatcctgggtggaccaaaggcagcaatggagtagggggcaggtggctgttaaggtggatgtgggcactcgggtaggtaccctggcctgggagcagaggaggaaccatctctaaacatctgctctctcccctagatgcccctaggggatccaggcagggacgaatgggtttcatttgttgagggggaggggttctgattatgcagcactaggcaagtctccagtgtggtataaaaaacatttgggtagccctagctttacaactagttagctgggtggccatggggaaggaacccaacccttctgagccatagtttcctaaaaacaaagaggtggtttgctgtggactgaatgtttgtgatggcctccggctgcagttaatatattgcaactctaacctccattgtgatgatgtgggaggtaattagggttagatactgggaggtaattaagctcatcagggtggaaccctcctgatggaattagtgcccttgaaagaggaagagagagaatctccctctccctctttccctccctctccttctctctctgtctctctctctccttccttccttccctctctctctttctccctttatctccctcttcctctttctccctctccctctttctcccatgctggaacccttaactcaaacttccaggctccagacacagtctggagaaataaatgcttgttgtttaagccacccagtctatagtatttgttatagcagcctgagctaagacattggtctggattatcttaaattttaaactttaaacttttggggacttactgaatgactcctttgagaatgtgaaaccactccccagaaatgtgcacatatattctgaatattgcgtccaagctttgtagggataaaaggccccacaccaaaaaccttggcatcatctgtgacccctctctttctctcatagtaactgtccactatctctgctgctgctattccagcctgagtccctcatctcttctctgtattactgcaagagcctcttaacagaggctcttgtcttcccttgtcctcttatggtctcttctcaacctagcagccagggtgagtcttttaaaatatcactcagatcccatcgatcctctattgagaacccttccatgagtgattttctcttcaaatagaaatttggctctaagatccacagctgacttcgtcacttctatgagtctttgtttacacaaagtcagcttctagaggaaaaatatgaattgacctatatcaagtaaagagattggactaataaaaatcttcccataaagaaagccctagacccagatggcatcattggtgaattctatcaaataatatcaatcctttgtgaaatcttctagaaaatagaggaggaataaacacttccctactcatcctacaaaaccagtgttacctgatactaaagccagacagacataataagaaaagagaactatagactattgtccatcatgaatttagataaaaaccctttaagatattagcaaactgaatccagcaacatataaaaaaagattatatgccatgaccacatgggatttttatcccaggaattcaaggttggcttaacatctgaaaatcaattactgtaatacactatattaatagagtaataaataaaactatattatcatctcaatagatgcagaaaaaaacatttcacaaaacccaacacgatgtgtagtaaaaactctcaacaaagtaggaacagatgaaaacttcctcaacctgatataggtcaccagtgaaacattttctgctaacattatactttaaaatagtgaaagattggatgctttcccctaagattggaaacaaagccagaatgtctgctctcaccatttctattcagcattgtactgtaagttctagccagtgcaataagacaaaaatgcattaggttggaaaagacaaagtaaaactatctttcttcacagacaaaatgctcctgtatgcagaaaatcttaaatttacaaataactattaggtttaaaaaatgtgtttatcagccaggcacagtggctcacacttgtaattccagcactctgggaggctgaggccggtggatcacttgaggccaggagttcgagaccagcctggccaacatggtgaaaccccatttctactaaaaatatgaaaaattagccaggcgtggtggtggatgcctgtaatcccagctactcaggaggctgaggcagaagaattgcttgaacccaggaggcagaagttgcagtgagctgagattgtgccattgcacttcagcctgggcaacaagagtgtaactccatctctttaaaaaaaaatgagtttagcaagatccaacagtcatacacaaaaattaattgtgtgtatatatagatacaccatctatatataatcttagcaatgaacaatccaaaaatgaaattaagaaaatttcattcacagtagcatcaaaaataataaaatgcttagggataaatttatcaaaggaagtacaagatgtacactgagaactagaaaacactgctgagaaaaattgaagacgtaaaaaaataaagaggcattccatgttcatggatgggaatactcaatattgttaaggtggcaattaattctaaattgatctatagctttcacgcaattcctatcaaaattccagcaaccatttttttgcagatgttgacagactagtcctaaaattcatatgaaaatgcaaaggacctaaaatagctggaaccattttgaaattcactgtgggaaaggatagtctttttaaacaaatgatgtcggaacaattggatatctgtatgcaaaaatgaatttagggccttcacaaatcactaaaacttaaaatgcaccaagattaaatataaaaactaaacttgtaaaacttatgggagaaaatacagtagtaaatctttgtgacctttgattaggcagagttcttagagacaatatcaaaaacacaatctataagaaaaaattatcaaactgaacttgattaaaattaaaagtttttgtgcttcataagacaccattaagtaaacgaaaaggcaaactacaaactgagagaaaatatttgcaagtcgtatatctggtaaaggacttgtatcctggctataaagaactcctataacatagtaagacaaatgattctatttaaaaataggcaaaatatttgaatagacattttaccaaagaagatacacaaatggataattatcacatcaaaacatgctcaacatccttattcattaggggaatgcaaattaaaaccataatggataccacttgaaacctgtaacagtgttggcaaggatgtagagaaactggaatgctcatttattgctggtgggaatggatacagccactttggaaaacagcatggcagtttcttaacaagttgagcataaactttccatattatgtagccattccactactaggaatctactcatgaaaagtgaaaacatatagccacacacagacttgtttgtgaatgttcatagcaacaattttttttttttgtttttggtatttttagtagagattggattttgccatgttggccaaactggtcttgaactcctggcctcaagtgatccacgtgtctcagcctcccagagtgctgggattacaggtgtaaaccaccacacctggccagcagcattctttataatagccccaaactggaaacaatccgactgtctgccgactggcgaatggataaacagaatgtggtatatccatataatggaatactattcagcaataaaaagaagtgaactacagatacatgctacaatacagacaaatctcaaacacatttttccaagagaaaggggctagacacacaaggccacatatgatatgattctactcataccatatatccagaaaagccaaatccaagaagcactgcattggttgcctgagactgggtgggagtgaggattgacaagggatcgttttagggtgatgaaaatgttctaatactggattgtgggggtggttgcacaactctataaatttattaaaaataattgagttgtacacttaaaatggatgaatttaatgataatgtagagtttacccaaataaagctgttaaaaaataaggggaaagaaaaaggccacttccccatgaggtctattccaacctctcaacacctcctttccctaggaaacccaacccctcacactctgctctactttttttgaatagcattgatcaccttctaatacactataaagttttcttgttatgtttttcgtctaactccctccgctacaatatggttcgcggaggtaggagtttcaagtctgttttcatcgctaatgtatattctcagggtctagaacagtacctggcatgtggaaggcacatatacagatgctgaaagatgaaatgaatgaagaattctggattaaagggctccttcatctctaaaattatctaatcaaaggtttttgagggtctttctggcatcttcttgtgtttcttagcagacctgttgcccaggccatgttggcattttgggctgaacctggacgtgagacggggaagtcccgggggaccctggctagggctcagcgttgtctggaagagtaagaggaccagctctcccttgcccatgcctcgtgctgcctctagctatttcctttgttgaccttagttgacgcatctttaaaatgagttctctccagcagcctagtgacttcgtttgtgtgcgacaaaggggaagggagcagtgggattgggggtagggcagagatagtccttcctggggggtggctgtgtggccatcagccttctcctccctttcttgcctgcaccactgaagctgctgggtgatctctcagctgctaacattgtttctgacatattttcacatgaaaacctcttcctttatataaacatttataaacacctggatcgacttgtgaaagtgtgacacattttttggaagccagttttttcgggttgtgggactcagctatttatttttgtgagatggaggcttctgggtgcctatgaacctcccccttggaaaaacctccttcacacggacagaacaatttagaggctcagagtgatggagaaagacgcggcaggtggccgcccagaggatgatactgaatgggatggcaaatgaatgctgcgggtctcggggctccccaggtccatctgaggaggaggggctgccaggaagggtttttggaagccttgggtttgctcttcgagccgactccccgattccatgagccctgggatggtggaagggttcaagcagggctcctggagttcccaggggctaggaagaaacctgtttcatagtgatgattttagggggagtcaggcagcagagagagtggagtttggaaaagaggaggggcataattgagcataaagggccagggtttcagagccagaagcgactgcattcagattctcgttctttacctttcttgtgtgtgaccttgggcaaggtaatgagcctctatgtctcagcttcctcgtccgtaaaaggggacacgggacctgcctggcagagctggtcagagggcagatgaaggcatgcgagtgggttcctcagcacagtgcctgtcatagagtggcagctcaccagcgtcacccttgcccttctctcttctctccactcgagcaactcacaagctgccctttctgtgcatagaaggtgtggctgaacttagatctcctcatccctgcctagtggggcacatgcagggtgcagctcccggagtctgggaccatcaggacctctgaatgggggctttgaagctgtgtccagtccctgtctttcctagtacctatcagaacttctcatgagtgaaagccagtctcctaggcatgagcatcttatctctgatgaaccccccagctttttgctctgacatcatgccaccgtttctcatcatttcatgggatataccttctgctcctgctggggaccctcactcacaagccctgttctgcctggactgattctcaccttgctctttcacccaggtgaactctcagtcttggaatgccctcacccctccttcatactcaatcacgtctctgccaccctccaagcttggcttcaggtggagttcctccaggaaggtagctgtgttgaacactcactgcctgaccttttcacgttctgtccaaactctgagacattattttagctggtatgtaggtcatgaggttgacattaggaagaacatatcaggttctccatcctcttttttcctttttttccccagccattctgtgtgtgttcataaatgtgacattcccatgatggacccagattttgccagcagtttgcagaatggtaaagttttgaattaaagtcaacagcttccaactatctgtcactttcctgccttgtggcatcctgccaccacagaggcaccaacatatctcagcactcaaattgggcccagcgtggtagctcacacttgtaatcccagcactttgggaggccaaggcgggggaatcacctgaggtcaggagttcaagaccagcctggccagcatggtgaaaccctgtctctactaaaaatacagaaaattagctgggcgtggtggtgcacatctgtaatcccaggagattcgcaggagaatcacttgaacctgggaggcagaggttgcagtgagccgagattgtgccactgcactccagcctggactggacaacagagcaagactccgtctcaaaaaaaaaaaaaaaaaaaaaaaaaaagaaaaaagaaaaaaagaaaaaaaagaaaacacacactgctcaaattgagaactttggatctgggctaatatttcacctggggctgaaattgtctgggcagagcctgcaacaaactgctctggggacagctggataggaaaggaacatccttaaatggttctggctctcttctctctgaatcttcccctctcttgggccagcccatgacttcactcagctccagaactggcagatttgctgccatcatctcatctctggagatgaatctatttccttcctatagaaacagcatgcaagaaaactcagcttctgcttgaatactcccagagacaggaagcttactacttaactgaactctgttagttttaattgttgagataagaaatgtcctccctgacgttgtttccttccttccttccttccttccttccttccttccttccttccttccttttttttgagataggggtctcactgttgaccagacactgcaccctttgcctcttgggtttaggcaatccacctgcctcagcctctcaaagtgctgggattacaggtgtgagccactgtgcccagctaccctggctctgtttccatcctccggagctccagagtaaatctattgtgcttctttagatatttgggagggaccctattcccctacatcttctctctagtgagctgaacctcctcatttttaaaaattgtgtacacagtatctctcttatgtcttttacaggcactgcgtccctgttagacttcagggactttgcactggccatggtgctgaccaatcacaggctgcccaggccaaggattgggtctggtgctgctggagatactgactgctcaactctctctctgctgttgctcctcttcatctactcccatctcccatggcctgagttaaatcatgacagttgtcctggtgcctccagggctagtgcacatagggaagtaaatggctgaaattgggaggagaggaacacacaagggccagtggctgggctccctggagatctgcagtgctgtgtgtgtgtgtgtgtgtgtgtgtgtgttggagcagaacagagagttgttggttgtgcctccatctctagagtctgcagggatgtcaccaggtatgccatgatgaggagtggtttcaagagctacacaggccaggcgcagtggctcacgcctgtagtcccagctacttgggaggctgaggcaagataattgcttgaacctgggaggcagaggttgcagtgagctgagatcacgccactgcactccaggttgggcgacagagggagactccatctcaaagaaaaaaaaaaaagagctatacaaagagtggaccccccaggctgcctggagaggcagtcggtcatgggtccccaaacacctctctccactggacctacaacacaggtcccctcacagcagcaagataacaaagctgtggccattcccactccaaaggcagcaatgcatctttcctctgcaggacactgaccatagctgttagtcttggctcccggctcatgggcattgcgtcttctgcttctgtggtgtcctatcctgccccgaaacagtgggggctcccttaggctctggcccctgccaatcttccaggacctctctttctctccaggcttggcctccgcgagtctgccttgggttgtgtgactttgtccctaaactccctctgaggatgacacccctccgtcaccccactggctgccggggggaaggcttccatttagtggcattttcctttctcatttcatgctgtaatggagattcattgccagttttaaatccataatttgctgtgaaacccttgttttgggcctgggctgaggtcggaacggagaagcggcgggttatttttagccctcagagggctccctgtgcagctgcagctcccctgggcttcccccagggcgggcctcagacagcgtcctgggtttgacacccaggatgcccaggaagctggagctgggacaggggtaaacacacacgtgggactggctggcctgcccctccctcagttggctctggctctgttcctcctccatttcatgagatgagggggaatcagtagagaaacagggcctcatgccgatgagtctgtgcttccattacccccctctttcctgggcctgacaaggagtgagggtcagtacttcaggcctccaagaatgtgtccatttcctaacagtgactgatcccctgaccggatgttcttgtgtctttctatcagggcgacactgatgatttggctctgaggtgtgtgtgttaagtacctgcgtgcaccagcgcatttgtccttgaggcgaagctgtccatgtgtgtatccttatgattggcacataaatggggaatcctgtcaatggccagtggccagcggggcttccagactgaggatcccagtagggcaccaggacagaggtgggctcttgctgtgcttttgcaggcttgtggggatgctgaaagagatacccaggcctgaggagcagccgtatgaggggtaagtgggtgaggggcctcctccaggcagctgccccccgcatgttataggaaggggcttagatttcacttgcagccctggagctgatgattccatgtcaaatggcagacacccgaggatcgaggtcctgacttttgcaaatctccacagtctgagctcactttttgctgagcagttgagcctgctcagcatctcccagggtcacgcttggttccagcagctgaagggtatattatccttgctctcaggaggaagggaagaggaactcagggaacaatgcctctcatgccccaaccccaaaccatgagcaaatgagagagaatcacagtcaacccgtgaagtgggtttaacacttcatctctcctgctactggctccaccatggagagggcgggccctgagagattaagcatcatcagcccctgtctcacagctggatggtggcaggactggggcaggagtgaatgcgtcccagctccccagtgagggccgtttgtcctgcttgggtctggagagtttccaatgccctggggatggtggtgacacactccagaacttcccagggctgccctgaagagcctgtctcttggtgatgggggtgcagccactggggccaggcaacagcaggaggctgaacccctaccataagcagtagaccatgagtgggctcctaagaacctccccagcttcccttgtcctggtgttgggagcaaaagatgctggggggtatgggggctggccctgggcatggtcatttgggaagctacccccagatttcagtggcgagtgggcacttggataggcagtgtcgagcttctgggcccctccagaaatcgctcatggtggcactggctggggtagggtggggctgtgcattccttgcatcaggtcttctccttcttggagaggctcctgcctgcccttctccacactcaggcagggaagggaaaagatgcgctgagtttgcctccatccctgagggatcctctcttcctccgggccttggaagtcgtttaatgcttgagtgtcctgcccccacctcatttcccaacatgagggacgaccccaggctgggggagagttttgacatccagccaggctgtgatgaggatgggagatggagtgggtaaagagacagaggccatgcctgcccatggtaacatgcagattatgggggcagggagattgtggggggcgaccttggagtgcagcaggagggcagggctggggcgacccgcacacctcaactcaatggctgcaagacctccagggagaccttctatctcatctggcccccaacagcaactactcagcgtggcattatggcattgaacccacagggtggacctcagggagctataatataacttagaggtgagagactatatgtcagcctcagatacccttcatggcccccagctctgctcactttatcacctgcccagcaggtgagctccgagttagatgggaggctaaggtggtgtcagtggccaaagggagaaagaggaggggaatctgcttctggcccaggggacatgggggtagtctgggctaccaggaagggagctgggagcgagctggtggcaggggtggggtgtgtgtagggggagcgagatgtacaatagctccgacacagctcccatgtggaacctcaggagataaggatgttttctgctcctgtcttccgtctctggctcgtttgctaccgctatttgggggtgattgcagggtaatgaatgttgcaggaaacagccacatagcacaaatgagatacggcactaagaccaggccagggcccaggcaaaacacgcttaataagcagataaggaaatcaattctgcctttcttcccaggtgtgcagcctgctgggaggggcctgcaggaatcatatcttcctgccttgcttgatacatgggaaagcttctctaggaagcaaagtctgatcccccgggatgcaggggttgcttgttggtgtctcataacattgtgcaataatagcaatgatgaaaacagttataatactagcagccaatgctgctatgccttgctgcataacaggcgctattctgagacatgttttacatatattatttcattaaatcctctcttcaaccccatgaaagcagttatgattatttccctcattttacacagaaagaaacaggcacagagtggttaaataacttgctcacggtcacaccagtggcaaaatgatacagctaggtttcaagtgcgggcaatctggcttccagaggccaggcgcttagccacattgcctctccaacacaacacaacacaacacaacacaacacaacacaacacaacacaacacaacaaaacacaattgtcatccgtgtttggggcttactatctgccagactctgttctctgtcgtcagattcagtgtaaactccccctaaattttccctaagccttgttatttcaattgccatgaggaacatttactgaacacccagtatgtgattctaggctgtgctaggcatgaaggatgaaagatgctcccaggagacccggtgggggaaacagacatgaaaacagttactctcaacatagcgtgtcgagacctgtaatcaaggtgcataaggaggctgggcgcgatggctcacgcctgtaatctcagcattttaggaggctgagttgggtggatcccttgagcccagaagttcaagacaagcattagcaacatggcaaaacccggtctctacaaaaacaaaacagaacaaaacaaaaaaacaaacaaacaaaaattagctgggtgaggtggtgcatgcctgtggtctcagctactcgggaggctgaggtgggaggatcgcttgagccagggaggtcgaggctgcagtgagccataatagtgccactgcacttcagtctggatgacagagcaagaccctgactcaaaaaaaagatgcctaaggaagtgaaaaggaccacagggggacagtcaggccatgtgggctccagagaaggcttcctggaggaggagttgtctgaggtgaatcttgacagctgaacacaagttagccaagggaagaaaggtaggaagggcactccaggaagaaacacagtgtgaatgagggcccagaggcttggtgagcggaaggagatgccagctgcttgttagtgcgggagcaggttggcggtgggtctgaggctggggacacagctgggggctggcctcggggggccttgtgtggcctggcagggagcttgggttttgttctgtggggacactttctcgcccctgaagaacccctcagactgtcacctactgatttgcctttttatgtcagggtgactatggatgggtttcttgcaaccagtttctggaagaatggtttagaagccagcaccctcgaggtctgttccagctctgccttcctttgctggcagactctgagttattcaccactgttctctggacccatctccccagaagattcatggatgggagattgggggaggctgccaacgcggtgggctgaggaggccctgcagctctgctggtagagctgtggcaaagggagcttgtggttttgaaaaacaaactagttaaggacacgtcacagattggaccttatctgttttcctctctcagtatttggggcttgacatcatttaaaaagatgccctctttatttgaattgacttagtctccctcttaaataattcatgttgatttaggaagctttatttctaacgggagccacaagacagcagagttaatattagaacgggccaggaagaagagggaaatgaggagggagactgggaaaaatgcccctcttaataattaatctgatgccaacatcccctcctcccacttctgatccccccatcctgctctactttttcctttccgtagcatttattaccacctcacatcctgtacagcaatgcaatttatggtttaatccgtgcatcacttatcgaccgccttctctctgccagaatgcaagctccaccagggcaaggatggttttctctttcgtttcctgatgaatcccacgtgtctagactagtgcttggcatataacaggtgctcagtaaacatttgttgatcaaatccttggtaccatttcctccctgccctggatgtcccaacaccttgcttcccaagtttccaggaagttgaagagatcaagtgtaatgccacccttacaactctgaccctgggacagtttcaatatttttcaaccctgggattcctgtaggtggaagaaggagcagtctgcatgtatatgtgtacacaactttaaaatacaggcggggtggctcacgcttgtaatcccagcactttgggaggccaagatgggtggatcacttgaggtcaagtgttcgagaccagcctgggcagcatggctaaaaatacaaaaattagccaggcgtggtggcacgtgcctgtaatcccagctactcaggaggctggagcaggaggacccagaaggcggaggttgcggtgagctgagatcgtgcctctgctctccagcctgggcgacagagccaggctccatctcaaaaaacaaaaaacaaaccaaaaaagtgtatgacacttcactgttagagattgagagagagagagagaaagagagagagagagagagagagagagagagagagacagagtgtttaatgtttacaacaattctatgacattggtatttttaaccctctattttatagatgaagaaccagaaacgtcattcattcattcattcacgctggttatagaggcttgagccaaagaggcccagttccagccttaaggaccttgcccaaggtcacccagttagtgagcagcaagagcatattctacttcctggcccagggctcttcctaccccatgacagctctctctgcacatgtgcatgggggtcctctgaagcccaaccaaactgagtcttcggagagggctaggtctatgtggaagctggctacagaggggtggttgggggggatcctttgcagggaggaccagggtttgaggtccacagccaaggccaggaccccagggctgaacaggacttggagaggtcctatctcccagcctcaaagtgggatgctgtttaagccaccctaatcagttttcttctaagcctcggtcactgcgccaatcttggttccagggagggatggcccaatttcctaaaatagttggtacagcatgttggactccttacagtggaagtcatggccttttgggagcgagacagttctcagcgatcatcttatttatcaccacctctcattttacagatgaggaaactgagacccaggttgagaaacagggccactgtcacacagctggacactggtaaaaccaagaccactgcctctaagtctaatgctgtttccgtgacgctgtgattctccagatgttctgcaggtgaaaagacgcctgtcttgaccctgggctgagtcaagccatagtccttggcagctggctgggccacagagggcacgcagcctgaccactgattgacctgacctaaaatccccagtctttgcctctctcagctttgcaaactcaggccttcccccgtctttccctcctcatttcctggctccctccttctgcctcccgaggtacaaatgctcagctccgaagttgctccttgcctgattgcatctgagagctggaaacacaacgctaattaatgtgtctgtgactctaggcttggctgccaggccgagtccccatgccttccctagggcccagcggctctgcgagctggccctctggcttcatctgagcacgctgccggcagatgcatattttaacaatgcacatctgttggctatataatctctcgtatttgccctcctcacttggtacttcgatggaagacccccgggggcctccctctgttctagccaaagtgtttgctttgcaattttgccggaataccatctgattctgctttcgcgtcttccgcaggttctaatcaggctcttactttatttaattaaaaatctatctcaggcaaatacagactaaattaggaagctctctcattcctggaacacagggaaggcagccccccttggggaactggctgggacattttcccgggctgagatgtcacagcaaagcagatggggtcttggtagggaaggcggctgggccaaggagcagaaatacctctctcccatctgtgggaacagccactctctccattccccttccccagaccaggggtccccttccagctggctgggtcagctgctgcactgggggcctccttgcagagcagtaggtggggtgctataccccaggacactcagccaggcggagccctgcaagaccagctgggttggggacctgggagtgtcccagggagtcagcgaggactgcaggcagagtgctgggaagcactgtcttgcctggggttttagtttgctcaggatgaatggttttggtggagctgcctgaaaggctgatggacaagatgctggctgaggctccctttctggctctcaggaatttcacggaggggaccctgctggggatcatggaaacttcctctgccctccttccgctgatctccagacttgaataaaacatctcccccatacaaacccagctctgtgcccagagggcggtgtcaggccatgccaccggagaggaagggggagcgaatgccttttagacatgacctaagacaaaatcgggtctgttcaggttggatcctgaggccctgctctgagaagcctggcccctcaccagccagacagatgagatgctgctggcatctgggaacaggagactaggcaaagagcttggagctgaaaaatctggagttgattttgaaggttaattaagctgtgtcacctcctgtgagtgcctttgcctctctgagtttccattctctcatctgtaaaacattcgaaataatctggacttttaatacgttggacttttttacgtaacgtagagttgagaggaaaggaagtgtaatgatcatgtcaggactggggaagtcaatacagccttaaggatgagatgtggctccacctatttttggttcctgtgaagtcagaggagtggacaatgctcaggttcctgtggttccagcatcctctggcccctctagaaggtgtatgagtcggtagaggcagattcttctgaggatggaggggctgagccatctctgaagatgaggagcctacaacttagcaaatctgttctggcattttgcaatcctcaaaatcagaaacaatatgaggccctaattcctcctcctctcctcccacaacccccacaccacatggcagactcattctcattttagtcaccgtcttgggagaaatgagaacggcgctgctgcctttaataccccaattactcctcggaaggcccgcttcccggccatggaatcccaacttatttacccccgctggaacaggtttattttctcattcctttcatcgcaggcctggggagactcaaaggttgcaggaggtttctgaggctggccccaagtccctcccccgcatctcaagaagtcaagctccgagcttggtaagtggtcctccggggcctgtctgctgcactgcttggaataatctgccctggtgtctttggccatgtagatctgaagataacctgacatgcttttaaatatttcatctctgagcagctgtgtgctttagctgccaggagaggaggcagcaccccagctgctgaccctgttgtcgaaccttcacaacagctgctaaggggtgggcctgggctttcccacttccctcctgcacgcgtgcctggcacagactcacgtgtaagggggcagcgaggtggggcaggtagccctggagccctggccaggagcccatgggccaagctctttgcatctgtgggccttagtatctcatctggggtaacagtccctgtcccaccgagcagcgtcaggaacagcggaggtcatgtgcctgaaagagcctagagagctacggtgaactgcttggcaaatgtgagctctcatgacttatgtgcaaggcctggttctcagcagccttgatcctcggtaacatttggccagaggagggagactcccgggactgaactctaaatcagaactaggcggtttaagaggtcaccgagcccattcccctgtcttcaggcaagatgatccaggaacgctgggctcctgggaacataagatgaagaaagatcaaggggaaaagtatgatttggaataaggacctgaaatgaattttcctaggagggacctgtcagccaggattcccagggagcaatgaggggtggagaagtcacgggggtcactggtgtccacatggatactagaatcatggggagaatcgggctgattctacagagaaggtggaaagatagggctttgttagcaccggagtgggggtcagttcagaaagaagggacccacagcctgtgccacattcttcctggcacggagcctagcctagataacgtgtgcagagcatgctttctgatggaataaataagcatgtaggagccctcattagctgcctaaggcaccatcaaacacgccggggttggactgagtccgctggcattggctgtctggtttactagggaaagagccttcgcttgtcccgtttgggtgggaaggtgggcatggatattgtggaagcagcagtgtctggagccctgtgggatgatccccagaggggagtctccccatgtctgaccaaaaaaataccctcttggagctgagcccttggtgcttcacgcagtgtcccagccccgtgtgcagatggttcttacccaggactgtgaggcgtgcggggcgggagcggatggcggcctggatggcctggcactcgtacaccgcatcgtcttgcagctctgccctcaggatcttcaggtggtgctcccctgacaggtggttccctaccaccaggtactgtgggtaacctgtggagacaacaggcaggtcagggagctggggtggggtggaggggacacccatgacaaagaggcacagaatggaggacccaagcaggggccattctacaaggctggcagagcgggtgattgctcagggctctgatctcagtgcaaggagcacaaatgcaagagctttcccaaggcattgaaggtgttggttctctctctctctctctgtatgtgtgtgtgtgtgtgtgtgtgtgtgtgtgtgtgtgtgtgtgtgtgtgtgtgtgtataagggcatttggtctgtttgttagtttttgagacagggtcttgctctgtcactcagattggagtgtagtggcaggatcatagctcactgcaggctccacttcccagactcaaacgatcctcccacctcagcctcccaagtagctgggactacagacatgcaccaccacgtcggctaatttttttatcttttgtagagatgggatctcactatgtcaccctgactggtcttgaactcctggacttaggcggttctccctcctcaacctcccaaagttctgggattataggcatgagccaccatgcccggccatgtaagggtcttgttggtttcaagtttaggaaaatcggaggagccactgttagaaaggaaagagggagaagagatggaaatgctaagcgtggacagacaccgctggcttattattctggaaagtggtgtgctcagcactgtggtctaccaagcagacatgcattttgataagatagagaggagagagagagagacagacagacagagagacccaggctgagaattacagagagaagacagtcagagagagaaggaaggaaaaagagaaatgtttggaaaaggatcaagagtgactttgcaaaaattttgtttcaggatggacaggaagtagaaatctaggcccgcccttccagtgtctaggaaccttgggtcactttgagtcacagtggaccctgtctagtcattcctcctgtcccgccagaagccccaggtcctggtgacgcacttatgaagtgctcaggacgcttaagaattgggggccccttgtaccatgggcaatgaataatagataaataaaagtttgagaatataaatcattaatcagcgttcctgctgctgtgtagggttgaatataaatgccaactgaagttgtggctggccaccttaggcagatcctctctttcctgggtctcgggccctacacctccctatttctctttccatccatctcctcactgaggtctgccctcccccgagtccctcagtgtgtggatttacaactggactccaatccccgctgtctttcatctctgtcccggttcccttctctcctcagaggctgccctcggcttccactcccctctggcagccccaggctgctcctccttttgaaggaccctcaccacacagggagtgttctcagacgggtgctgtaggaggatgagacgggacacattcagccttttaaagagaagatgagggcttaagcaagtgagagagacagaacaaagacaggcagggagacctgcaagagctcgcctcaagtatttcaaagaatctctcagtgtgggttgggcatgttcctgagctcccaagggcagcaccagcaccaacaggcagaattcacatggggaggttctttagaatattctcaactgtttgaggtatccaacaaggatctgggatgccagagagtgtagtgaggtccccatcactggctgtattcaagcagaggttggatgatcgcctctcagggatgttgcagaggtgatttctacaccgggtgaaagatcagactagaggagcttgaaggcccctctcaccaccataagtgaaggttcttctggaggtggggcaggcctccctgggggtgggctgtacaacgggccaccagcacttgttcctggtcaggcgaggtagctgtgatgatcctctgccagccttcctggcatgctctggagtgcttcctgtgcagctgggcccttcagactcatgtcttcatggctaccatcctcatcatgcaataaaatggccctgtcctccccagctgtgcaggcctggccagaaaagctcacaaggccatcagctgcacccctgagagcactgcctctcctcctgcccacacttcccgccttctgctgggctttgggaatgagcccaggtaagttaagctgtctccccccagggccaggagaggggctggaaatgggttctagcccaatcctctccctgctgccgctgccttccttgtagctggctggctacccccagcccctccagcccagcctctggatcccactatcctgtgattagtccctggtctcctgcaggcatcttggctggagcttctgtttctgttgtcttgcaagctatcagcagcaggattttgctctcacgagctgctgaaaacatcagtgatgggtttgtttgtatttgcctaattaggcagtgagctgtgatgctatcccaaggactggcagcatctttgaaaatcagactcagaagcatggattctgagaaagttctagctccttccacattatcattactctctcttgctactcccaaaggaggcaaaattacttagagtctgggttctatagtcgaattgcctgggttccaatgccagctggatcacttcctagctctgctgtcttgggtgagttactttaacttctttgtgcctcatagactacttactatgtgccagtccccattttatggggacaataccagtacctcataaggttatggtgaaggttaaataggataatctatgtaaagtgcctggcacattgtaagtagtctataaatgccaatttaaatgaagagaaaggtatgtcataaggtcaggtggccaaagaggtctttatctttagaagggagagaagacagagtatctggaccctttggggttaacaggcaggtctcatgtgctgggattggttatatagttgagtcaatttctttctcagttgtgactttgtttacctgtcaaacaaaggggaaaatccttcttttctccctccggatcgctgtagatttatgagataatgtctgcgaagtacctgagcttcttagaagaaaaatgtgctatcaatatgaagaagtgcatttataaatcattttctttgactggttattccagctttggtgactagaaaaacatttaggtcttcaaggagcgtatcatttctgggagattcgggggggccacatgggtacagtaggagaggacagagatgtagcaggctgaaatcccacaaccctgggcctcagtttccctgtaggagagctttcgcggtgttaagggctctacaagtacttgctgaattgagttgagggctgtcctgcctgtttccacatcaggcaagcgagcagagttaattgagcatgtaagtatctatcatgattgccatgatgctatttttgggacaagtgacaaaatacagggcaagtattttatcaggagtttgaggtcattggctctgtatggagaggcaaaccgagtcaagctggagaggacacaggccccagtttgtcagaggccattgttctgcagccctaagcaggtaccagtcctggatcccagaaagccattcatggcactggatgctagagggtcagttatccatgctgagatgaccaccgtatgcactatccctgctgacctgagcctccttttggccactgacccagcaagaccccagtccctgacggaagttggaaacccactgaccgggaccccagacagcctccttaactagcggcagcgctcatcccagctcggagccattcagtgcatgaactattctagtttgggaaggttgtatcattcctggagtttctctagggtaaaggcgttcggagtctctgaaattggctggttcccataacagttaaactttatggcagcacagtatattttggagatgtttttgtgtattttttccatgctcagctgggctgcagcgttcaaacctcgtgcctgctattgaccattgctataatgtttcaatatacatttttggcaagacataactcacatttaaaaatattaatttcccaaccatcatgttcctgagtgcacttcgatttttattttcctgcagctgtacaccatgcgagaggcaaagttacttctcagctgaataatatttttctctcctcctccacccttagctattcccaaatcacaggggaatgacacccagaggtccctgcttgtgaattttactgtgtacgccaagcctagcaaacaaccactgcctacctgtaggacagaataatgatagctgaagggtgtgtgaccagggggatgagccattctttttttttctccagggaagaggatggattggaaaagcgtctgtatggtcttatgggatcactattcacaatagttaacaaatgatctgttgtcagcactggccagtgagttcacgtgtcagccatcaacaaccatgggaactctcactgcctgtcccagggtagctttgctgaataccagcctgcccaagccgaacatagttggaaatttatttttaatacttcctgtcttttcttcccatctcatgatggctcctaagatcaactaggtgtctttgtgagttttcagtttacttggttccctttaatgggtgagaagcctggaagaaccaggttgtgacttgtatttccttaataattgtgccttaataaatgggggatacatcttgggccaagacacaggaacacttgatttctggaaactggaatttacatgaatcatgtttgactttggagtaggtgcttgagggcaatgtcgagttaggttaggacccaccgctagaaggagggtttgcttatggttcattatgcacatcaggggccctcagagtctagggatgctgggtgcagtgcttgcctagcctgactctgcctgaggagttgcagtgaaagctagagattcgatactcagacacctgtgaagatgggtgctccctaggaaggtggatgggtgagtaaggaagtgatggccccaggcccaccccaggaggtctggaggtactcacttgagaggtccctgcccacacccagagccaagccgtccttgatccacagaacgaagccatcgtattcggggatggcgcaaagtagcgtcactggctgtcccgacaccaccacctggtcctggggctgctggctgaaggaatagacttggcctgggaaggagacaaacacaatggtcagttatctgccggctacaggggcgagaaggctcccctccagctatggaagcagagcagggctggcgcaggagactgagcctcctgaagcacctggctttcctgctgagggtctggtagagcttcctaactggtctcagccccagctctattccctcctatgggggcctggctcccagctccagcccctctgcccatcagtccctaacacatggactggtctagccacaccccagctccctatgggccatctccctccacctttgggacgtgccacttcccatgcattggtgagctcctacttaatgccatgtgctgggcatgcagtcccacaccagggcagaaacaggagagagagagagagacctctagctagaaacattctgtggtggctgtgtgttaagaagggggtcgatggagagtggtgcggctttggttaaacctgagaattcaggaaatcattttgttgtttcagtggctcctggggtgggctgagggccaagttcagaggggtgggtggtggtgcagtatggcaggaggtgtgctgaggaggcgtgccatcctaccgtgtcctccctgtccctttcttttctgcagcagaccttactccagcctcacaatcacttgggaaaaaatcattatggacaccatgcctcctcaaaacgagatggccagaatcatcgaagagagtcagttgacattattttattaaacaaacccatccacaatgcttacaagatgccatgctctgttttgaggctttaaaatattagttcattaatattttcatcgtcataacaacctaaaaatagtaggcactatttttatccccattttccagatgggaaaatgaggcacagggaggtgaaaaatagtaatgggagctgtgcttgtgaattgctcaccaagtacggcgcatgccctgactctagttatcaccgtggcaacactcgaatggggcattgtcaaccccatttgacaggactttgggaaacggaggctcagggttaactgaattgcccagggaactgtctagtgggagttggggtgggtggtgcggtgaatccaagtctttctggctctgaagaccatgctctcccctactgagctatgctgtgtgcagatccccaagcctggccttggagggagttgctgatgaagaggtgtgatgtgatctgtgtctcctgggagtccacagttgagtggacaatggaacattgacattcgctgagcatctggcccacagtacaaccagtacttcatacaacccctcctgtaatccacttaattatacttcagggcagaaaaagccccactttacaacaaagaaaccaggatcagagaggcacagtaacctgcccaaggtcacgcagctaatgagtgttagagcaggggtttgagcaggggcccatctgcattccaagccctccctttttcctacctcctgctctacagacccagacctaaccgaggcaaaactggacctggcgctccagctgctgatgctgtggcctctcctccccaacccgggagagtcaggggcagccacagacgtcctggacactggctgctgcccatcttggggacaaaaagccccaggcttgggccacacctaggactgagctctcagcaacagatgaccccaagagggagacacttggtgtgtatcaacccaggggagcttggatggcagcagagcttggggtggaggctccccagaaggaggggtgcagattcacagtggagagctggggacaggcaggaaggtggccgagttcacaacctgacaagatcttggcagggtctccgaggagtctcattaaaaatcaaattggccttgaattgtgggagtaacactttttattctgatttgagctttacaaattagatttcataggacattttaatcagctatgtatggtaggttttttttttcctctctgtctcttcaagttctctgttgtaattagactgtttctggcaccaaaacagggtagaaaaggagggaagagatgagagaggagaaggggagaggagggagggactggagagagagcaaaggagtgaagtgaggacgtgggagagaagaggagagggagaggaagaggaggaagcaggggaggagggtgaggggcagcatggagagggagggggtgggtggaaaggactccttctctggctccttttactctaatgatgatttcacagctcatccttttatctcaaaatctttcttacaagaaggacagagtcaaggcagctgcagtaactgccaaagattgtgctatcagagagaattatcaggttgtcaggtggacgtggagggggttataatgagagccccttaaatgaagcagtgcccgagccctctgagatgtccattattaggaagcacccacagtgggtaaccgtcccggtctctccccgtcctgtgtcctcttggaggaaggcgcgggaggtactgggtgagggcccccggggaagtggggtgcaagaagcatccgagggccaagggtaagttgtggaccggctggagcccccagggagaggagggggctatcaccatggaaaccaggctctggaggaaggcaacgctgggaagggggatcagttgaagcaggccatggaggtggactctgagtggccacagacccttttggtgggtgtctcagagccaggggtggcagcaggcacaagatgcctggaataagacctggggtctgtaggaaaggagcctgatgggatggggctgagcgggagagggccttttgagggggagcatctcccgatgccatctgagcaggcttggaggtgtaggatcccacaggttgcagtgagccaagatcgccccactgcactacagactaggtgacagagtgagactcggtctcaaaaaaaaaaaaaaaagaccttcctagagcctctcgcattctgtctgcttgatccacttggcttttctatggaaagactgtttctggggaagatgagtacacaggaaaaatccacccaaaggacatgatttacaaattattatttttggggatgggagacagtactctaattgacaatgtcccttttcagtccaattttaatttttgcacattacatttgagtcactataattacttttctcttttaaaccaatgagttttttttttttttttcaaatgaatcttaaactgttactgagtatctagagtggataaaagttgaggtgctttggatgaaggtggagatggagggatggaacccacttttttttttcatccatctgacagaccttagggcctctcctttgggctcaagagcccctcagagcacagcttttgagccatggatgtaagttattgccagaagaatgctcctcacccacccactctttcttttcttttgagactgagtctcactctgtcgcccaggctggagttcagtggggcaatcttggctcactgcaacctttgcctcccggttcaagtgattctcctgcctcagcctcctgagcagctgggattacaggtatgcaccagcatgtccggctgattttcatatttttaatagagacagggtttcaccatgttggccaggctggtcttgaactcttgacctcaagtgatcctcccacctcagcctcctgaagtgctgggattacaggcatgagccaccatgcctggcctctacttgctttattttccccattttcttttctactccaaagaagtgaaatgcaagtgagcccaaggtcattttctgcagcctcctggatagtgccttaagtagacagtgagctcctgagaacctgtttcttccacacacacactgaccggaccctgctgtgaggcaggcactgtgctgtctggtgaggagcaggggaacaggcctggccacccctccaggagctcgcagctgtgccccctccccatcacacctgggcgtctcagatggagcacagagtaggtgcctcacaggctcaggtcctgctctcagtggagatgtgacacacccagcaccttccaccggcccagggtttccatcttctccgcttcgcattttccctgatgatgttcccctggtgtgaagccttggcggccggtgcaatctccccttcccatactttatttttatttttcttttttttttgagacggagtctgactttgttgcccaggctggagtgcagtggtgcgatctccgctcattgcaacctttgcctcccgggttcaagcgattcttctgcctcagcctcttgagtagctgggattacaggcactcaccaccatgtctggtaatttttgtatttttagtagagacagggtttcaccatattggccaggctggtctcgaactcctgacctcatgatccacctgcctcgacctcccaaagtgttgggattacgagcgtgagccaccatgcccggccccatgctttgttttgagtctgtcaccatcactgagcctagcccagcaggctgtacatctctcagacttcccctttcctctctattcccactgctagcacccaagttcaagctctcgttgcctcaacctgggctcttgccacagactctgaatgttctctttgcctgatccattaatgtgctgaacctggattttccgtcttaattcaccacttgcttcagggttcccctcttttaaggggtgggacctctcatggctctccactctctgcgggacaacgcccaacttcccatgctggattctaatctccaaaatccagctccttttcttcctgggagctccacagcacccccgtgctggctagtcactaaggtcacctgcctcgagttctcctcgatgtttcattgtcctgggatgcactgcatccccccacccaaggctcccccacccaaggccccccctaagcaaccccacctatcattgaaggcccagttctctccccaggcagctcctgtgacccagatggaatcttcttttttctcgtcttctctctatattctcatcttgcctctttttcatcaatttctccaaacctttattgagcacctactatatgtcagatgctgatgaaacagaaataaggaagaaacagtgtacacttcttgagggcaggggccacagctatcttttctgtcttgtgttcccagctgtgggtgagcaccggttacacgtctgtcacatgtgcctttgtacttagagtttgcctgctctggttggtctgctgagatcggtggtcactacaggaaaattgcttttgcattatgaactactaacccggcagatactgttcagagcacaccacacaggagaaaggtgagaaatcacagggtgggctggagtctctaggaatcaggcttgacaggagaaaaaaataactgctgttcatggaagatttacttgatgccacatctttggctgtatacgttgtttctggcatgcagattagctgtaattaaccacattttatagatgaaccaaggctcacagaaatgcagggacttgcacaagttcacttgattagctcaggtgtcactcaaaccccaatggtctgggtacagccctattttctcaccactatccgatgtaggttgttgaatcaagggtctcaagcccagattttgattcttaagcaagtactcactccaccaacaaggcagcctactcagattatttatctatttttatatttatttatttatttattttgagacggagtcttgctcttgtcgcccaggatggagtgcaatggtgtgttctcggctcactgcaacctccccctcctgggttcaagggattctcctgcctctgcctcctgagtagctgagattacaggcacctgccaccatgcctggctaatttttgtatttttagtagagacggggtttcaccatgttggccagactggtgtcgaactcctgacctcaagtgatctgcccacctcggcttcccaaagtgctaggattataagcgtgagccactacacctggcccagatgatctaaagggaggtagaagatctttagaatgaaaagtgatttcttggtttttccctcagtttctgtgtgtaggctcctcttcacctattggtcagtaacactgaaacggttgagggtaaagtttagtactggccaccataggaagattaaaagaaaggaggtgtactagttaccattacttataattattacttaaaatggctatttaatataattatattataatatagcttataattatgtatcataaatatttttattgctataaaattagtaattgctaacttttctattttttaactttttgtagggacagggtcttgctatgttgcccaggctggtctcaaactcctggcctgaagcaatcctcgtgcctcagccttccaaagtgctgagattacaggtgtgagctaccatgcccagctagtaataggtaacttttacagaatgtcaagcatataataaaagctttacctggattattttattgactcactaaagagtcctatgagataggtaccgtatcacacctacgtgaagatgaggttgtctggggcccacagcactggcagtgagaagggatatgagcccagcagtctggttccagagcagcctctttgcgtccttatttggacttcgcccactgtgcctctagtcctcgcccccaggaactcatagaacccaccttagacctccctctcccactgcccttggccagtactgaaaagtctcaaggaaactcaggaagaataatgtacactagctcacttcatcagttctgtgtataatgtcctcatgaacacagttctctgggtggatcagagttgaccagctatccaagagtgactgaagcctatgttcaccttctttagctccctgagaaggtgagcgcagacctgcaggtcctccagtcacccttgaccctcacaaccacatcactcactccaaagaacccctctctcccttcaccatttggactggacaagccccttgggatgaaggcagatagtgcagtggtaatgaatggggctcaggaatcagactgacctgggtttgaatcctggcacttccatgaacttgctgagcctccattttcctatctgtgaaatggggacaataataccaccaccttgtggagatagagaggatgcatctgggccacttgactccggggctggctcacaacaaatgctcaggggaaaccgaccttcttctctcaaagccaccctctgtcctgaacaccaggccgcaggctgagctccatagggctgggcgacgggaagcgtgacctggaatggcaggtggctctctattggtgtgaaagggggaggcaagggtggacttttaattactatccaatgacttattgaagagacagttttcactaaagacaaggatgtactctctttgcaggaggacctcagtgtagcatccatgggttctcaggtgggtctcaaggctggtgtttgtggtaggtgagctcaggtgttggaagccttggccagctgctgtgagccatgccctgtgggggagaagaggtgggagaatgttcccccagggctgcaagggggctactggggtggaaggggtagggggcgtctcccgggccaatgagggctggcttggctccgcatctgactggcgctgaactagcttccgttagtagaaaaaggctgcgtgtgcatgaacctgcctgggcatggcagaggagcaggcctgggaaacacagcggtctctctcccacattcgcttggttaggtggctgcagaagcaccttcctgctcgccgcctggaaggtaggtcatgttcctgaaagcgggaggctctgcggggcagggtcccagggttctgagacaaagccctttgtctctgagtgagagtccctgtctgggatgcttgcccccagcctgtgcgtctcccctgcacacccaggctgttgtgacctgcaggggccgagagagcactgcgccatctgtcccgggggccctttagaccactgggtaaggcagctgcttttccctttgaggagagtggcagaatcagaggagagcctgggtctgccaccccctcgtgccaagttctctgccctacctgagaaggtagaagcttcaggagtgggagcaggaggtcgaggtgctgagcaggcagggccttttgcagccttgtctccaaattgcaggaagcagtggctgtttctggctgggaacaataaaggggaggggggcttggatgaaccctgtcctgatgggccacgtggcgtccctgagtcaggacagctggcactgttgccagtgctggtgagtggctggtgggaggaagtgtggaggtggcagcagcagtgacaggtgtggcctggcctagggaggtgggcaggaggtggagcatttggtggccttttgggggctctggttatggggcagagctgggagcaggcagatggcatcctcagatcagtggtggggctggatgtcttccccagttgtttccccaccctcctccatcgggactcctcctgactgctcttcccaaaagccccctctagatttccctcctgcgcttactcctgcctcctgtcagcccacccggcttccaacctggatgcagcgccctcatcttaatctcttttctgggactcgcagcacacattatcacggaatgaaccatcaccatctggctcccaaagtccccaccaacttccagtgaaacattgaaatgcagaagaccccatgtttctctatgacttgcacacctgtggccccattctgaggttgcccctcaatccctaattatttcctgagggggaagagtcattttgccatggaaggcgcagattacaagggccacgtcactcggtgtgatggtcttagggcagcactgcagggtgctgggtcgggtgtgtgtgtgtgtgtgtgcacgtgggtgtgtttgtcagattaactgaattggcctcaaccccaccttttctccagccagacatttgctgcttctattccttatcaagcacttaagattttggttgagggctgggcccggtggctcacgcctgtaatcccagcactttgggaagctgaggcgggtggatcacctgaggtcaggggttcgagaccagcctgaccaacatggtgaaaccccgtctctactaaaaatacaaaaattagcgggacatggtggtgcgtgcctgtaatcccagctactcaggaggctgagccaggagaatccatagaacctgggaggcggaggttgcagtgagccaagatcgcaccattgcactccagcctaggggacagagtgagactccatcacaaaaaaaaagattttggttgaatgaatttttctaggagaatccatagaacctgggaggcggaggttgcagtgagccaagatcgcaccattgcactccagcctaggggacagagtgagactccatctcaaaaaaaaagatcttggttgaatgaatttttcttagttttacagaatgttggaaagcataggccctggcagggccatcttggggaactttggaaggaacagtgatctggttcgtctttggggtccaaaggccttggtactatggtgtgtgtgtctgtgtgtgtgtgtgtgtgtatcggataggaaggtggcccagtatcctggtgcccatagaggctgggatctgactcagaggagccgttgcttactcctccctgccacccacaactgccaaccctaaatcttctagggatgcattctggaactccactgtcccaagtctattgctaccccataggcacatgtctctgcactgtggttccacagtggtggtgagaggcacagatctacagggcagcatggactagtacaaagagtgtgggatttgggatggttgtgtaacaggggagataaagctttgatgcagactctgccctggagcctgatgtgggatcgggggtgctgagtatcccctcatggccctgggcaatgctttttttttttttttttttttttttgagtctcgttctgtcgcccaggctaaagtgcagtggtgcgatctcggcttcagcgcaacctccgcctcttggattcaagtgattttcctgctttagcctccaaagtagccgagactacaggcatgtgccactatgcctggctaatttttgtatttttagtagagacagggtttcaccaagttgaccaggccagtctcgaactcctgacctcaagtgatcttcccactctcagcatcccaaaaggttgggattacaggcatgagccattgcacccaacccctgtgcagttctctttccatccatgcttggaggcggctcagaggcaggcaggaggtggctcaagggtgggctcaatccctgcctcccctttctccactggttatttggcctggcctttgttccagcagcagattgaggggacatgaccactccccttaggattaaacccagtcagacctggacaggaagtgagggtcactaatataaggatggaaatgcttgtccttgcttctaaggagcctggtgctgacacatgcacacacccgcctgcatgcctgtgagtgtgggcagcccagctgaaaccctgcctgcacccctcaactctcaggacattctgtgaaactcgctgagagtcttggatggtcacatttgaccacaggttactggattacaagggataaagtggtctcatagagaagtcatataaagcttttcaggggtttaagagaatcttgcttcaagcaagggagttgtggggaggaagcagagaaggcatcctggaggaggaatcataatatggggaaagtaatggaggagaaatgtcattctggggtaggaaaaaaaatataagcaaaaacatgagtgatgggtcaccctctgtcacctgcctggagtacctaaccgatgggtcacctgtcggagcctgggtcctggacagtaggaagaacacagggtcagtcagccctaggaaggaactctggccctgtacctagcagtgtgatctgaggccagtgactcaccctttctgagcttcagtttccctatctgaaaaatggggatgacacgcctccctggcaaagctgctgtgagcatgagaggttttatatgtaaatgatcttggtagacaggtgtttcacaaagggtcattcttactttcgtcactatccacaagtctttcctgagcttgggactgttaaaacaggagccagaggagcacctgtcttgcggagtcccagagctgagaacggaggctttgcaaatctgaagttgcacccattagaatgctgcatgggtggtgcaggagacagtgggtgagccctcccattggctctgcctctttcttgagcttgggactgttaaaacaggggccagagcagcacctgtcttgcagagtcccaaggctgagaatggaggctttgcaaatttgaagttgcacccattagaaacctgcatgggtggtgcgggagacagtgggtgagccctcccattggctttgcctcttctgctcatccgggttggcttcacagcctcctggagtgttgtgtcagccatgcaaaaagggctcaaatgtcaccatctgccttttattagtgaccaattggagaaggcttaagaatacttatactggggttatttattgccggctttctcccagcctggagcttgtaaattgcctcttatgagattaagggaagctgcccctccagagaagcaagcaaataggaagaagggaaggagagaagaagtcagctcagtggctcctggtgacatcagaacaatatcgggtagggtgggaaagacaagggcagcgtgactcagttcatacctcgaaacccaagtcttgaattctgctgtgttcctgctgctcagcacagggccagcatctaacacaggaggatcagctttgagaaatttccagaatgcccagttggtgacctgctcggggaacaggattgggggtgatagagtatgttctgacccactgactgacggataaaaatggatttttatggaggttctagggggtttcagtcactgtttcagctctcaggatgccatggtgcctcaggcatgagcaggagccacctcagcaatctccaagtccccaggttgggtgtggggtgtgcaggaggggctgatatgtcttccgctgagtaggctctggagctgcggggaggcaaatatgtgcagaagaaactagaataaaaagctctacaccataagcgtcagagtgaggcacaaagtcccaaagaaggagtcacagaagggttggcttctgaaatggccaggatgaagacaaggtgggaatgttccctggaatggggaacagcttacgtcaagtgtggagaacagatgtgttcatggaataaaagcagcagtgccacatggtctaggcttgatctctgaccctgccattatggctgtgggtccctgggcaaattgcttagtccctctgagcctcagtttccccattggtttagcaatcaatacttgttgagttgtttgtgagaatgaaataggtcattctctgtgatgtgcacagagccctgcctgccttccataatggcagctggcagtatcattacaagcctagcaggctgggtgcacggagcatgtgtgtgcagactctcttagtacagcgcaaatctagaaagtcctggtgggtcagaccgtgtgggcccttgaacgtgtgccaagaagtttgtacttcatgagaagtcatcaaaggtttttgacccacatgctcagatctgagttttagaaatatcacggtgatgacagggaggaggatgaatgaaggaggataatctgaagacagggagactgatcagcaaggttttgctgtcatgaggactcaggctaacgctgcatcaatggaaagaagaaatggatttaggagccatttgggggtagaactgatagtacttgaccagggatgaggaagatgaaagtgtgaatggatgatggaggagccatttgctgctcaggaggagaagcgcgcttgaggtgaggcagtgagttcagttttaaatgtgttgatggagaggggtccagaatcccccaggtgatgctgtcccagatgtagttgggtcaatggttctggagctgggaaggaggtgtgaagaactcacactgactgagcactacctatgggtcaggcagtaggagaagtattttcaggtgtcctctcacttggtgttgacctgataattcaactccaaatatggaaagttatagatgttgttgtgactatctaagagggacaaggttactccagtctgggagtgttgggagtagctgccttgggtgaaacatctaaatcttgttgaggtttgcacaggttttgaaccatatcgggatggcaagagatcatctaacctaatcttctccctttagactgggattggaaatataaacagagaagccagaagaaccaggcaggggtagaagacagggccttttctctattgtctgtttctccttgatttctactgggagagagacaaagaaacactttccatcccagcatcgccacctgcagccattggtagcttgattctgatacacacgtaaggagaagcttgccagtctcatgaacattacagaaattgcactagaattttacttggacttacaaaaaagaggctgactgctcttcccagggctggatgagggggtggaaagtctgagggcacattcccctatgcttgttcctcacccgggctgagccagtgtgggcagcctgtgattctcccagcctcgcacttctctcccaggacacaaaatccaccaaggttgtcctggacagtgtgggtctttaacgaagagcaatcgggctggccgaggcagggtgagtccaaagtcactataaatcctttgcctactgatgatcaggctcgcggcccctgccaaagcctgcactgtactcattagtggcagggagagggattcttccatcgatccagccaaggcctggatgccacgaagacactgataagtgctgctggaaatatgggctcttcagtgcccatggcagagcccatccatccctgcccgaggtcacctggaggtctaaatgagacaggacgggcatagcagagtgggtttatggtgggggagtggagatgggagatgctcgacagcgcatgaagcagagaccctggctgtggtctcaggcctgttgctggccagccatgggaccctggctaagccccctttcttctctgagtctcaggctcttgtgtcttctgactggaatgtgccctcactgagccggcaccttgggatgtgttggagcagcatggaaggaagagagtggcactaaggggcagggatggaactatgccattagctcaagagggagctgcaggctcggctatgggcaggctcggctacagcagacagagtgcccatcaacccctctcagagggcgtcagcgtgggcaccaccaggagaggctggaggctaggtcatggattggctgactccaagatgcccagcacctcttgctcccatgtctaaggggtactgtatggacacatgaagctttgtccttgtcctgggcccagaaggtaccagttgatgctgcctctgccacctcttagctgtgtgcccttgggcctgactctttaactaagactcagatgccttatctgtaaaatgcaaggtttaagcgccttcctcccaaccctaatgcttgatgttctaacttatccaaaatcctatttcgggggtggggggtggtcctaaggttgaaaataataaaatcaaggtgcaaagaagtgaaagcaagtctctcaaggacacttggccttttgggggctcagatctatatcctaaacattaaaaaaagtaaacaaaataatcatttatgctgctatagccttgtcagtcagagacggttctaaaacttccatgtgcatgaggatcacctgggggactggctaaaaataacagtttcctgggctccaactcagagattctgggatagtggctctgagctgggtcaaggaatctgcattttaatagcttctgggtcatccttctgcaggcggtttctgggccacatcctaagggcactgttgtgtgcccacagcacgggcttgtgggcctgggttatttctagttcaggctctgtcactgggtggccttgattaagtggctgtctctctctcggggtgcgcattgatgttcccactgcacagtgaaggcattttcacaccttttgaaagttcatgcaaccctttttgtcagtgaagtctcacagggaatcccagtgtataaaacggtggaggcagagctgaggcagcgcgggaaggaccgagtcctgccctcggcagccctgcagcgggccctcaggaccctctgtgcaatgctcaaggattccaaaggccctgtgcagttttgatgctcttcaggtgtcctgtgaaggaccacgtggctatatcccactgacggtgtgaaagcaggcccacccggcgtgcactgagtgactcaggcaggctggtctgaagcacgaggtgccttggtcttgctctctgagcctgcatggagaatcacagctcagacctggtgcttatagaggagtcttctcatggttcctggagttgttcccaactggacacagaccatcttggggcaacgtcctgggtttctcccctcttggagaccaaatacaatcaactcttaattatctttgttagtggagaagagcagggtgtgtataatctagaatgatggacaatccaaaacagtgaataatcctaagtaacattcattttcgactttggaatgcattttgatattcacatttgaatatggatatgtttgatgttctaggaatttttcatacttaaaaaaaacactcaacccaagggtggggctccctctctgcctcctactcagctgaggggagaacatcacctctgggactggcccaaagctacagtcaggtgcaccccaccttccccatctcctgtctttatggctcacaccttatctaggaagggagggggatattaacagattttgcctttaaaggacttttattccctttggaccttatgcaaataagagtaaaataagaagctgtgaaatgttaacagaggacttcattaagcaaacttggtgatagcatttgccaggaatggggacaatttgccaacagatacttgagtgctgactatatatgtgtcctaattaaaaaagtgatacttctcactgccctgggattgtgggccgtcttctggtgggtttgggatattaaccacaactaactccgatacaaagcacttcacatacattatcttacctaatccaccttcatagcaccccgtggagcaggtcccatcatcagcccccatgtagagacttgaatatcacagctccaagccagatgtcccccgtgaatataccctcccaattctgccctattctactccactctgcctctcctgtcaccccccaaacagaggccctgcaaagcctcagctggtctgcatcaatcaaagagaacgaagcaaaactaacttgccattactgccctagtctctctgattgttggaagtagagatgtttcaaggagaggttttgtgctggaagccccttgaaaggatggagagggagtgtgaggactgccggagacgcccagcctaggaggggaagctttctgcttttccagcaggacagaactccttagaagcaggtgtagccctggctcatatccaccatcctgagaaatagaaaatctttcccattttacggacaaggaaactcagagaggttaactaacacatccagggtcacagggtgtggtagaggtagggtttgagccatttgactccaggcctggctttttttcccccaacagtagccggtcagcagagggtgtttgatctgtgtggtttcctcttcagaaagcagagactcactactgtgccccctacctgcccccagctgagctccaaaaacagctataaagctgatgggaagccgataggacagcccctgcccttcctgaagaccacggaaacctctcccatggtgcccttggggctgagatcagctctgtcaccaatacttcagggcaaaagtcgttggcaccacttttaatcctaatcctgtgtggccttattcagaagccctttgcaaaggccgatccctagccatagctctctctgctcggccttgggctgggtgaataatgacttccatttcctgccctgctggagccttgggtctttgccactgccaccgtggtgctgagccacttatttgttgtgagatgacccaaggaggaccagccggtacctgctaggcccttctgctggggcacggggtcagggggcagcacatgggcatgtggccccactcctgtctgctccccaggacaactctattttccagcatggagtgcccctggaggtggcgacagctcctctaataagagagttactcatggcttcactggagagaagagagcagctttcaacccccctctcctaaacgcaacgatatttggtaacatgcggcatcttggggagagcattcatgtctgtaattagttactgtatatcacggttagtactctgctcagaatttacggggcaaataccatttaactgcacaataactgcaggtccttgctgcttattgggtaatttactaaggctggaagaacggggcaggagggattctgaatgggaggtattgtaaccccttgaatcaaactttatgagtttgggtttggcagggaggcagctgcttgcagccagttctcttctctttgttttgcagagttggctggcagactgcttccttcccttgatttattgcaggatgataggtctgggactgggggtgggactgcccggggctacctggggctatggaagggactttccatagagggtctttggctgagagtctgcagcaggaacccagagtcggtgtcctgggggctccatgcaggacagcaaatgggccctgtcatttatttactccctccacggggctgctttttgtatctgggccagtgggtggagagtgcagggagctgtccttggttggcagcatcaagataatcgcctaagccctttcttctcttgcaagtccgttgctgcctgggaagcagccattcctggacacttggccgacattcctggccttaatctgcttgagcaaagtctgtctttgtttggccatgcactgtctaaactcctctaacctatttaggccacagagaggggagaagacacaataatgaaaaactcaacgtgcaacattgccttacgcaatctaataaattacttggtacccggctgccagctcagactaagcccaatattgcctgcagtaattatttggatcaaatgcagtttatctgcttcatatttgtgcttctgtgctcagtgataacttataaatgtcattgtggtgtttatttgttataatgaaacttaatggcattggaagccaagagcagaactggtggggcggcaggtttaaaacaatctcttcatctcgggagaaggaatgagccaagataacatgaaactgccctatagggaagagatttgcagagatagtggtgtcctcgtgctgtgtggtggacgggagtgagccaggagctttgagctggcaccaaggggagccgtctttgcctccagagatatctatctggatcggggagacatggctgagcttcaccctgcactgccccatctgtccttgctgctttcaggggtgggaggtgttcagtctttataccacctgatgcctgcctgggataagagatgaatagggatggaaattagagtccctgggccaggcacggtggcccacgcctgtaatcccagcactttggaaggccattgagggaggattgcttgagcccaggagttcgagaccagcctgacaacatgtgagaccctgtctcaatttttaaaaataaaataaaataaaataaaataaaataaataaaataaagaactcctggatgactgcattatggagaacaggccttcagggagaaggaagggagcagggttggagaataaaggaggatatcatgagggcccagacagaaggtggcaaggctttctcttctggttctggagggcattggtggtaggaagcacagagcatgagcagaacagggaagagctttcaagggttgcagggcagggcccccactggcgctgcagaagtacctgaggcaagggccatttaatgtagaactcagggttttggcttcatacagtcctgggctctgctatttcctagctgtgtggctttgggcaagttatttgtctttcctaagtttcattttctttatgtggaaaatgtgagtgataatagatacctctcaagattctggtgatgattaaatgaagtgatgtgtgtaaagtaatgactgtggtgtttggcacacaggatatatgataaataaggggctgtggcagtgattggcacatagtagatgttcaataaatgttgaatgtatccatgaataataacacttcccacttgtgtgcattacaaaaccctcctccaaacagctgagcttggatttagacctcacaattgttcagggttgatcttctcattttacagtgggaaatggaggcccagtgaggttatggtaacttgcccaaggcttcccagctggtagatggaatggggtcttagttctcctacctcccagggcaaggttgctgccaccagtccaccctggacagctcccaatctgtgctgggagactgacctcatccttcctgatgagctgcccctgctccttggagaccaggcacagagcctgtgctgacctccccagcacaacctgggggcagaagcaagcgggccgctttctgtccatttcatcttaatacaacattcagcattcactcataaaatattcattttctctcctcggtgacatgctcatgcaagtctcctaacatcataaatatggatgaagactattagtcatttttatttatctcactagccccttccctccccagcacaccttttgtcttgatctcagcacaaatgggactgaattggggctattaacccggatctctgataataaagccttgcatcctgtggtgctttatactttttttcaaagcatcacgcaatcgtgatgcatattttctccttacaacaaatgcgtggaggaaagagggctagcatcatgagtatacccatttcgcagatgagaacatagaggtcaagagagatcaaggtcaaagtcatatactgagacaggaacagaactaatttttaaaaaacattattattgttatttgtttgtttgacctccaaggaaaggttctctgggacactgagtgtgtttgcttcacacaaataaataatctgtatagtattttacaagtttataaagagtgttcacccatgttacttggtgggtccccacaaggcaggtatgatttactcttgtttgacaaagctcacacaaccagttagtggcagatctgggctctaaaacattatttcccaaagtggatttcagggaccactagtcctgacacatgctgcaggaaaaatgttttgtggtcaaatgagtttgggaactctgtgagtcatatcccctttgggtggcttaccatggcctttggtgtattagtgtctctgagaagttctgcaggaaagactctcattttgttaggtctcatgtagcttctccccaccgtgtctaatcacgaaggctgcatctgacggaaaacctattaacatgctacagaaatgctgcctgtgtgtacgcgtgatccctcctcccccgtgtgtttggaggcagtgaggattagagcgtggctgggagaggagcgtgcaggggtaaggacggggtaggggacccactgctggggactactagagctgaagctcccctcctcaggctgtgtcctctctttccctctgggcagtgcagaaaattcactcaatattaggcacagtcagcccagcccatatctggggcaggatcagaggggccgcctgagtggcggagtggggggtctgtggtcagtgaatggtgggagatttggggacggcagtccttggccatggggaaaaatcaacagggacccacaataggggcttagtcaagtctgccctggacgatggtggggaagtcaccctatcctcgtcgcccagacacaaagctcccgaggcagggtggaagtaagaaggccaggctttggcgttcagctggcttactctaacatctgtgtgcctttaggtgatgatctaatctgtctgagcctctgtttcttcctcctcagaatgtggataacactacccactttgtgacgtggtgaggattagatggtgcaagtgtgcaaaagtaccctccttggccctcgtctttgtgtgtcagctccatctctcttcccctgcttttttggagcccctcagtcagaacaaatagcttcccacctccagtcctccacgagcctgtcatctgtacctctctttagttctcccatcgccctgccttctgccattttattatatgcccatctccccaatggacctgaagttctctgcaggctgctgctgactctctcagtgcccacttgtatctgcaggcccgaccatcccgcgtcttcaggccaacctcccattgccggtgtctggaccccttctcttgagggctttctctttagttgcggaggccactgtgccctcacacagagcaggccagacctgctgggagacaacaccctcacccagcagcactccacccatgccctacaggagctggtgcagaaataccccaccgcttgggtgccctagctgtgaggtggtgttcaatagcacttctcagagtttcttactgggactgggctctggctgcccatagtggtagcaggtttggggtccccccatgccgatgcctcctttcccatgtcaatttccaaccctcccgctggcacctctgcaccttcatgaggaatgactacactagcgctcttgcttagggcctgcttccaggggaacctgaggtaagataagggcatcctccaggtgtcattcatctctgcgtacacagtgggtgctgatgaatctctgaatccagcagaaatgagccataggaacagcgcaggggtgactgtcaatcaaggcaatgacgtcagtgggctcaccacgtgggtgggtcctgggagcaacgagatagaatacctgctcccttccacatctggaagcatccacagccacactcacacctctgtaccttccccacctaatgtttagtcaaaccttggcaggcacagaggagctgaggtccagggtcctttctctatgagctgagaacaggttagtgttgtgttttgagatccttttatgaataatggttgagaagtgctgctctttagtactaagaatagtggttattcctagtgcatttgactcggagatggggactattccattgctctatttgtcccacactcggtacacagttactgaaactgtcaccgtgtcctatattccataggccattatgtgtatttcaaaccgttatataaatggacttgatttggcacttctgaatgtcattaaactcctcccataccagtaacaacacagtttccatagaaacgaatacatttcagaaaggaaggcacagggaagaaagcagatggagttagggggaaaacgcggccccctggttcctacttccagagcacagggcccggcactgtgacatgagcactctgtggaggtggggcaagctccttcaggtttttattgactccctttgataaaagccctggataattcatctcagcctgaacctgctcattccagcgcacggctctaaaaactttatggcaccgcaagccattaagcgccttcgtttattccaacttctctggggctttcttcagaccctggggagagggctgggggagggtctcagcactcaaagaattctgtgatgaagcctttgaggctggctggggatggaaggaagaagcagagagaagaaaggaggcctccccggtgcagttgacatagtggagaccccaggatcttgccagtggctgctgtccaagtcactgggtcccctcgtcatcagtaaagctagaatgcgaaaactgcagcctcctggggtggaagcggtgtggcgtttggagagcctggctgaggagctgcccaccgcctcggcaggctgcaagtttcttgtctttggagggattcaagcataggttgcaacagcctcttagaataaaacatctcacagggcttatttctccagaagccatgctggacactcctctcctggcctacagtgtgattggattctccttctctgtttccaatagctacttattcatacccggttaccgcaactgcgacattgtattgtagttgctgacgtgtttgtctctccccgcaagacagtggtatccttgggggcagggactgtgtttttacatgcacagcgccaggcacagagcgggtactggacacatggttggtgaataaatgagcattccgccgtgttcacagtctttacacacactggtacttggcagggatatggaaccagatgacctttggtcccttctggcctggagaatctgtaatgataggggtctaagcctgccctgactacacccgggatttgaatctagatttctcctactcctaagccacagggttacgttaagaatattagtcgcacgcctgtaatcccagcactttgggaggctgaggcgggtggatcacccgaggtcaggagtttgagaccagcctgcccaacatggcgaaaccctgtttctactaaacatacaaaaaatcagccaagtgaggtggtgggtgcctgtaatcccagctactcaggaggctgaggcaggagaatcgcttgaacgcgggaggcggagcttgcagtgagctgagatcatgccattgcattccagcctgggcaacaagagcgaaactccgtctctgtctcgagagaaaaaaaaaaaaagaatattagtcgcaatgataaaaggaaaaccagaaccaaaacagccacaaaaacagctgggtgtgaaatgttggagaaaactctccccaactgcatttttcctctacactcaccacaacagtccacacaggagacctctgtggccaaacaggtgggagcagcggacaccagctgggtgtcctccaattcaattctgacactgtctacctggagatagtgtcagatcccacaggctgggggctcagtccccaagacttcccccacaccctggcacctgtcacaagttcaggcttccagaacttctggcagacccgctgcaagttgggggttcccaagaccttctgtttgggtttgattaatttgctagagtggcacgaagacctcagggaaacacttacctatgtttacagtttattctaaaggatattacaaagaatacagatgaagagattggggggaaggggcaggagcttccacgccctccctgagtgcgccaccctccaggaagctttacatgctcagctgcccagaagctcccgaaactcagtccttttgggttttcatggaagcattccttcccctagggtgtgaggcgggactctctcagggaagggtcttaagacccacaatcagaaagtggtgaaaggttagagtcctgcgatggggcaggggaaaggagggccggagagagatcctgtttcccgaggcctgcccctgaggcctaacacacccaacatatggcaaaagactgtagcaagggctatgggagttatgagccgggaaccgtggatgaaatccccccaccccatgcgcctctatatagaaacatgtctagatacatcatcacgcctcaggccatgccctgactttcaaccactgatcccttacagcaaaagaatatatatgatcatttaacaattagtccagtgcactgtattgcatgaatgtctcccagggtgaggccactcaggtttgcaggcttttttttttttttttgagacagagtctcgctctgtttctcaggctgagtgcaatggtgtgacctcggctcactgcaacctctcctgggttcaagcgattctcctgcctcagcctcctgagtagctgggattacaggcatgcgccaccatgcccgactaatttttgtatttttagtagagatggggtttcaccatgttagtcaggctggtcttgaactcctgacctcaggtgatccacccgccttggcctcccaaagtgctgggattacaggcgtgagccactgtgcccagcctgcaggctttctttagatttgaagaaaagattccaaaaccaggagtggtcccagcaaacacagcttcccccttccaggcatctggggataccaagcaaagagacaatgtcctcttttggttcgagactctttccagttgttaatgtagtattggatttccttcattttataacccatttttcgtttctttactctcaggtattattcctcattttctccactagtcgtttattttttacctgcacttttccacctttggaagggacattgggttcggccactgtgtggtccagatggctgctggcagcactagtccagccagtgcctcccctcagtccattaccattcatacccgggaaggttacgtaagttccaaacgagtggactattcttaccaccaggccccctagttggatttactcttagccctaattttgctagacagggtgaaggcacctcccacccccatcagggccctaggaattctgacataaggtttaaaaacacagtgacagttttttgcttagaagttatctctgtttccagcacttgtagttgcagccctggtcccgggatcactgcatcacacaggggagagagaaaagtttttttttttttttttttttttttttttttgagacagagttttgctgttgctccggctgaagtgcaatggcacaatctcggctcactgaacctctgcctcccgggttcaagtgattctcctgcctcagcctcctgagtagctgggattacaggcacctgccaccatgcccagctaatttttttgtatttttagtagagacggggtttcgccatgttggccaggctggtctcaaactcctgacctcaggtgatccacccgcctcagcctcccaaaatgctgggattacaggcgtgagccaccgtgccaggccaagaaaagcttttttttttagctgagttgggaaagaaagaaaaaaatagtcattataccagtgtactccttccttagcaagaattgcatagttatctagcatccttcccacatcctcttccccagatcagccagaaaaacagaggaaaaagtctagtggggacactagtaccactcatggtgtgtgtgagcacactcgtgaaggcgtgcaagccagcccttcatgcttttatgtccccattttagacaaccaatatttcaatagcctgttgtatttctctatcaaattcttactctaaggagatctctctgaccattgctggacattatgggcttacagtgtgtcccttggtctgaagaaatgatggtcagctgtccaaatgcatacaatatcttctgttccatttttttttaaatgacactctgagcacttctatcttctactgagtaaggaaagcccactccagagtcagtgtctattctaggcaagacccatttgtagacccgcagcaccagtctcacttgctagctgtgtttagagccttcccactagggaatcttccacatagccactggcagtctctgtctctcttgctggcagacagaatagctcttactggcattatgtgcctgagagggtgcaaagggaacatgtccagattcagcccatctctacactgctgcggtgcctccatatctacccatttcatgagcccaggtggccacctcaagggagcagctggggctatctgcgtgtcgattcccgtcaccttctgaaccttgaagggagttcttctgatgggaactgacttgttctgctttaatgcacccctcaaatttccatagggctgtgctccacatgggcatcccattaaaaggccaggtttccattgcccttctgcctggccactcggccaggccattggtcactgcccatgattcagtaaaacctaaacacagaggcctctaccattgttcatttttttccatcactattaggaaaacagcatgcaattcagctcatatgcagacctgtatttaccttgtctgatcaaagtagtaaccttcgaaacaggttggtgtccattcacattggaactgctgtctgtcaaccaaacagctcctgagtcaatcaagagctgttcataatgcactgtccacgtgttgatcgaatccagcagcacctcacacagttccagagtcagttctagggggagaagaagctccctgcctgagagtgtcttgtccttgaattccacaggcagcatgatcctctagaaaccatttccattttatgtactcttctgggcactgctgtccccattagaatgtttctctgacatcaccgaagacaggatgagtatttcaggtgggtcctgcgcacccaccttccaagacagctaaggtttcatagcaaggcagtaaatgccctcaagtggaaattctctagtccgaagtcctagcagttgctgctgggaggtgctcagaggtgtttgccataagccccaggaattgctccatagaagtatatggagtcttcccaagaggaggtaaactttctggggaccaagacaagtgcccgctgcctgtgttactctggatgaatcacatccctttcctgagtcttggtttcctcctctccaggtgactgccaatgtttcttttaaaagtctatgattgtcaaattatccagtcccagcatcttggagctactgactaggggcagagaaggtcactgtcctcactttgctgacaacatctatgcaaacactgtgttgggctcctgggatctaatggagaccaaacagagccaactgactggtaggggagacaggtgttattaacacaaaataactgggctcccagctaaaccccacccttaagcctggaactgcagcccttagtgaaaacaggtgactcaatttttctcccaattgttgcttttttggcctgccacatccctatcctgtgcccatgaaaagacttcagctggcagagtaacacaagcggctgagcgtcagggatacaagtggctgagtggtgagcagggcagcaactgggcatcggagactatggatagacgaggctaacttcagacagtgcagcttcagggaatgattgccttcttcctgcaccatcccctttccaactcctcattccgccaagagccccttccatctcccaataaaatcctccgcatacactacccttcaatctgttcatgtgacctgattcttcctgacactggacaagaagctgggtgccgagagggcaggagcttggacactgctgtggggccgcacagagcctgcttctgccagagatgagtgactggccggttccagcgttcattccctctggttcctgcacttgcttgctcacacactccctctctcaagcagtggccagaggtaggctgagtgaaacaagccactccagttcccacccacaaagagggtcaaggttaagggaattatcccatctcattagtaaataattgcaatatgaatgtatatgtacaaactgaactcagagctctgaaaggaaggatctggttctacgggagcatgtgacacaggaactggatcttgactgaggagggatgggtcagtggaggcatcactggagcagagacttgagctgtgatttgaaggatgagcgggaattaccaggtgaagggtttggggatggggtgagcgtggcaagcagggtagacacagggagcagggtagacacaggccctatgacaggggccctgcttgaggagcagcaggaaggcccatgtgactggagcgcagggtgtttaagggggtaggatgaagtcagaggtaggtaggaaccagatcacgtggcaccttgtagaacatgctaacaatgtgagcattttttttttttttgagacggagtctccctctatcactcaggctggagtgcagtggcacgatctcggctcactgcaacctccgcctcccaggttcaagtgactctcctgcctcagcctcccaagtagttgggattacaggtgtgtgccaccacgcctggctaattttttgtgtttttggtagaggtggggtttcactattttggccaggctggtctcaaactcctgacctcaggtgatccacctgccttggcctttcaaagtgctgggattataggcgtgagccaccgtgcccggccttcagtatttttttcttaaagccattgaaatattttcaaaaggaacatgacatggtcaaatttgcatttcgaaacactgctctggctaaagtgtggaaaacgacctgggcatggggattgggcatgatagatgcaaggagccagttaggagagccctgatgcagtccaggggagagaggctggggacagggtctagggtggtggcatgagatggagagaggagggtgggtacaggaggcactcaggagataacatccctaggacttgctgaggactggatatgagtgtgagggaaagggaagttataaaggaactttggctgggtgcagaggctcctgtctgtaatcctagcactttgggaggcccaggtgggaggattgcttgaggccaggggtttgagaccagtctgggcaacatagtgaggcactgtctctacgaaaatttaaaaaattagctgggcatggtggtgcatgcttgttcttctggctacttgggaggctggggtaggattgcttgagcttaggaattggaggctatagtgagccacgatggtaccactgcactctagcagaatgaaaccttgttttggtgaaaaaaagaaaaaaggaacttggcagggtctgcagcttaggggtccacagtctaagagaggcaggactcctggtaggaggtaggaaaggtggctggaggaatgggctgagaaaaagctttggaatgttccctcagatcctggctggagagtggaaacggcaggtctcttgttccaagacactgagcgaaataaataacaatcataaagtgccctgtaaatctgactcttgccataaataataaacagggatattatacaaataacgggctttgcagccccagtggaagaaaacacatcagtaagaaaaatgaatttagaaaaaatgcaccccaaagccccaactaacaaaatgacggtattagccaacatcccgggggctcggcaggcagtggaggaatgggctcaggaaaatgactgtggcccttagcgcgagccagactgtacggctgcaacagagtgagaagtgctgccggtagcagggaggcctgctcatccctgggtcaggtccccaggccaaggaccctggcctgctgcttcccctctgccctgagaaaagcacagctcatcccacaggcctgcccgactctttccctgccacccagcatatagctgatatggcctgagttcacccttaatgacagatgggagaaagaaacacggatccaccttcagaggctgccaaggaaagccagtctattgacttttttgtactggttcctttggtgaccaagacatttaaaattatgggatgggctgtgagaacagggtgtgggctgggtgttgagatccaagatagatttttgaatcatcacattttagagacatacaggtcatcttatgaaacatgattccattttgcacatgagaaggttgagatcttagtgtctagggacttgcccaagctcacacagccggctcctcactcttaagtgctcctcccactacacatcccagctgtggggcacctctctttctatacgaggaaacagtagaagctttagactcatttttttattagtgtacgagggtgcataaagaacaggctctcacgccatcataaagaactttagagctgtcgaagaaatgagattctcaacctcccagggctctgactcccctgtaaggctgggaagtgaggacaggtgctgtgggggaggggcatttgcacacagagcctggactgggaccacagtgctgttcgggagctgtgggccatgcaagaggctgctagttatttatggaaccagctttccccttcctgggtgctccagctcttcccacacagggtagaggtctccagtcagcaaaagctgcctttgctaatcactcacaagtatttcgtcctgaaagatgaaagggacagcacccagaggcatttctgctctcccttggtctcttgaagcagacatcattgcaatgctgaaagtccacggaaaccgacacccaccctgatgggcagcccaagaaggcaccagtgtgagggaggagtaccctcctgtgcaggcccccctctgccccaaggggatggctgaaggggaggtcaaaacttcggtgcctctgcttcttccctcctttaaatatcctcttcctcatttccccttctcaagagtcctgtggcctgccagcttttctggtcccccaggaatggtcttctctggtctgtgtccctcactccaggtctcccctgattttctgcaaatcaactcaagttttccctgtgttctgccctttcttctccctgccttgccacttcctctctttccagccaccctgaaaaatgaaaccaagctgaagtgttagaggctttccctctgctcatggtctcagcctcctcttccagaagtctaagagccctgggtgtctggagccctgggctgtggtcctggctcttccagccacttcatatgggccccgggcaagttgctgcatgctcttgggccatgctgtgttattgggttgcactgtaatctctagagttgttgacaggtctaacatagaggaggcctgagctctctgaggcaggcacagcccctcccctgatacatgtgacagccttctactctgcctgggaataggatcaggtctggggaagccatgtgctttgagaaggtgagtggtctggatctccaggagagagaggtcataaagggggagggccaggaaggggaggtgaaggttgtgtgcgtgtgtgcacacatgtgggtgtatgtgtgcatgtgtatacatgtgtgcaggtgtgtgcatgcatgtgtgcatgtatacatatgcatgcaggtgtgtgcattgtgtgtgtatgtgtgtgtgcatgctcatgtgtgtgttggagatgtggctgaggaaccagtgagagtaaactggatctacttaaagatgtcctgagagcatgggctggcagtaggtggggtgaggaaggagagctggtacagaaagaagggaaactacccctggggaaggcctcctcacccagccctgcttccacgacttgcctggaccctactcccaggaaggggctgtagcactggaactggaagaaagcctgagagtgagcaccaaggtagactctaggaatcacccaaaacagggagaccattttgtggactgttccacatctgtgtgctctatctgaggcgctccttttcaatacctacctgacacctgtggggactttgtacattcctccattgtcactcagggccctagttaattacctaaatgaaagttgagcgactactccctatgtgcaagacactgggcgaaggcccagggagaggagaggaaggaacaggagtctttgccctcctccagctgattctctacatgggactgacagcacatgaggaagcagaccaataaataatcacacatcatgataggtgccactcgatacacacaccagctgctgtgatgagcacagggtgcagggagagggtgtctgtgtaatttaggtagatggaaggcaggatctctttgtggaggtgacacatacactgagatgtatttttactgtgagctccttgagggcagaaaatgtgtcttactctacttttttttttttagatggagtctcactctgtcactcaggctggggtgcagtggcaggatcttggctcactgcagcctctgcctcctgtgttcaagcgattctcctgcctcagcttcctgagtagctggggctacaggtgcgcaccaccaaccctggctgattattattatttttttttgtatttttagtagagacagggtttcaccatgttggccaggctggtcttgaactcctgacctcaagtgatctgcctgccttggcctctcagagtgctgggattacaggcatgagccatcgtgcctggcttgtgtcttatttttatagctccagtgcttagaacaattctggcacttgtaagaaattggtattatttttatggtattcaatgactgtttgatgaataactgaatgatcactcatcagcagttcctatataaagcacatgtgcttaatcacatgaagacaatgatctcaaacaaatgtgatattgttatggctagtctgtctttacttcctcctttcttgcctgccctttgttgatttctgtttgtatctccttttgatggctcaattgtgttgggtccacacagtagaggacacacacgcacacacacacatacactctccatatattaccaaccacctccattcctgcaaagactgcagattctatccacgaagctattaagcactcccaaatagagcaaacctctcattgactatcacgtgcctccttaaatgatctttgaatagcattttctttttattgctttgtgtagtttaacggcaccaattgcaattactctaacttatgataaaccccagatctataaagctcctgttcattcattattttcctcttgctccttctcaagctgttattttttggaatgtagtgaggagggaggagtggagagagaagaaaataaaaggacaccaaattaacaggaaaacaaataaaatagggaagcacttctccctgggtgacaggcaccttattagatactgttaaacagaacaaatatgctttaatacagcacaagtaggtcttttatatttattctaaatgggaaatacaatgatcatcaacttatctttaagggaagaagaagctaattgttctaatatctcactaatcctagcaactgggagaaaaataattgtttttccctattttaccaattgttcaatttataccaaggtgtgttgtgtagcatggacagagatttctatttcttgatgtatgtcatggctgctattccattttaattattaatatgtggaaattataattattttgagtattggtatgagataattataaatataaaacagctccgcatgctttctgatgcctttcttatctgcagacatgttggagtttgggcgtatgagctttagagagagagaaatgtataatgtggtacttagggcagcaaggctggctggagtggaagaagaggagcttcctccctccagagccctccctctccttcacctctgccttccagctctccagagccaaagctgacccacctgtgtctctcctctgccccactgcctcaccctcctcttaccctgtctctgagttgttagttgagatttctaactcatcacacatgttggctcagcttgcatcccatcccctcatctcctcagccacccagaagctgaggtcagatatctggagctatgggtttcaattccagcccagctcctgactttttggcttccccaatccctacaaacctctttcgagcttctctaatgagcatcgccagcaagagaacatgtctattcagcaccacggacagaggcacgctgtcagttcccacaaattagaagttactgcctagcagtcttgtcaaggcagtggtgttggggagggaaggggaggctgagaaagagaaaagtcagtaaaggcaactgactagcaggacacagaaaatgcggcccccaactctggttgtactcagccatggggttcctacaaatgggaagtagctttttgatgctgttggcttcaggcaggcagcaaatgggggaggtgatcacttcctgtgcttaattgtgctggcctaactcttgtcagattgtcaccatgatgggtgctggaaacaggtccacagctggcaaagtctcaggcatggggagcgcatggggatgtggttgtcgtggtcggggttgggaggagagacagctgaggagcttggaaagagggcactgagaccatgctatggggatagagatggtagaaagaagcttcctccttcttgctggaatgggaatgaggagacatgggccctgggccctggaaggggaggggtccagcccatggcaagcatggctggtgggagccaaggcttcatttgtctgactttaatgaataaatggcatccccagccattgtttatctacttttgaatcctgacaaatagtctgtggcatctgatggagagggttattagctgcatggagacagatggctagggatggagaggattggttctttattacagcagacccgtaagtgacagcactcctcctcccagcctctatgccaatgtcaacacgtttctcaagccttcagtgacccaatgaagccagtgcaagaggaagacagaatggcctctgagtaagagggaggggtagggtcagtggagttgggaaagggggcaggtttcctagggtaagttctttgggaataaagacattgccatattcttctttggtattctcctaagtgcctgtatagtgctgtttattcaacaggcattcaagaaacatgagtgatggaggaggcaagtagagaggtctggattagaaatgaaaataggagcagatttaattgggctggctgtggggtggggtgcggaagaaatggtagggaagagagaggaagagaagtaggagacacaaagggagaagggaagattgcataaagaaaatgcccctgaatcagcatcctgtgtttcaggcattcactatgcttccccatgtgattgtacaaatggcttcatggaaaccaaactggtcttcccactgtccccttctgagaggtcccaggttcttattcctggttcctctgtcctgtggctgtaggggagagcttcctccctccagattactcccgagacaatggggaggttctcactgaccttcattcattctccgaaacttgtccttggccatgtagcccagcaccagacagcatcctctcttctggaggcccagctctggaagagaagcataggtgggtgagttgggaatgggaacaggtcaggcattgttggggggccctctgcagggggctgtggagcttgttgctcttataaacagaggtgcttttgtttagccaacatttatatggaaattgttatgttccaggcataagtttaagccagcaattcttcattttgattctcataacaaccctgtgaaggatgtttccccattttctatcatccccatttatagatatatgaagttagtggcactggatgaaagagctagcaggtggtaaagccagagctttgaacctaggcagtctggctctgagtccatgctcataaacataactctgggttattgaggccctttgtatctcaggcttggggactatgctcagatcaacttgggactgtggccagacctgccagggatgatgcagaatctatccagtcgtgtctaggatggaacagtgcaaccagacatggtgggtgactcaggaggatgaagtgattgcgtgagtttagggcagcggggcgacacagaggttaaggtataggcagaagagctctctctaccttttggagagggtgcgtttctggtgctagagattcctgtgccttcctatatcaaggcccaatttagcaccatcatcaagcacttatgaaatgtagacttagagcacaggggtcgagatagctgagagacacggactccacagggctttgacccagttggaaaaacaagatggaataacaattccaggtagcaaatgcaagagataacttttttatttgcacagtattttgtaaatcagtgtccattgtgtgtgtgagcattaaattggagtccatctgcctcacaagaaggcaagctttcctctctggtatttgtgctttatcctgattcatcttaatcactttatggatcctgaagcaatagcacactaatttttttgacccccctctacccccaaacaactcactgaggtgggcatatgggccactgcaactgacattatgcagatgggaaaattgaggttcaaccatgttaaatgacttcccacgattgtcttagacccccaccccaccttgtagcatagaagtcttacaaatgtgtcagctgccacaaacttggtaaatagataaggaatttgatttctggaagagggaatatgactgcagctcttcctggcccttgccagggtttctgggctcctccctgctccttcctttgatttctcagagaaagagggtcccaatgagtgatgcatcacagcaccttctcccacgacaccgactgcctccctgaacccagccagtcagtgtctaggctcaagaggatagacggagcgggtcattcctctttctcctcttccatccaccgtctgcagcccaggtccacccaccaagcatagcaggatgaaagagagtgcagggcccatgagacacagataagtcaagctcaggggctcttgccctagagaaaaacaaaacatggcaggaggtggcagaacgccacggcccagggaggtccctggctttgatctcctgattctttaaaggggtttattgactatcagtaaagagcagagaagcagatctgagggcactgtttccaaaggcactcacttctcttccttcccctccacactggcgtctgaaggcttagccaaaccgccctcacttcaaacggtcttacatctcaggcacccaaattgacgatgttaagttccctcattcaaggccttggccctttcttcaggggctcctgctctgtcgcaggcctcatggatcaaagcccctttgatgtttacttactgtatttgtggattctttctaacaaccaccttcaagaggcaggaatgcagccttccaggagggggccagtggaagtacaagctgcgaggaggtgctgagctccctggaacaatagcctctcgagggagactgtattgaaacctcaacacgctgacgacaggcagagttaaccagcccattgtaattgcacacgcattgttcatcattagaatgatacaattgctgacaattcctattatatttttgccattgacttcgtatgcccatctaaagcacatcagcaatggctcctaatgagaaagggagtttgggctcctggactaagcccaaactcaatccaggagcttgggagggaggcaggggagcactgagtagggagggcagaagatactggatggatttaggccaatgttccagctggtcttctggactgtgactgaacgctcaggcaaatggaagggcgaacaattctcttacagatttagagagtgtgagcaatctgttgactctggattgtcttagttggatagagaactcaacctctcctatgccacatactaggacaccccccagggcaactgcttgaggagaggctgtgtggacaagtggttatgatataataactaagagtctcactgattatgtttgatttttgcaaatgagcaggaaaagaagttttaaaaaacctgattaataaaagaaattgagaatgaggcaatttctcaatgtatttggctcatttaatttgacacgcgtgggttagtcttaattatttaggcggctacgttacaaggcgctaataagcacactgcagaaatttattaagtgcgagggctctctgactgagactttgtagagaagtggggagaagctactgggatctttgcaagaacgagcaggttggaggatgagtgaagtgagaattagttaattgtccatatatgaaaatttgggatgtcctttggagagatttgcaaagctaaattaaaggtcattgggttcacatgagtgtgccagcagggagtgaagtgggggaagggaggggatgctggaaacccaagtggggaggtgaatattgtccaagctactaaccacagagagaaccaggaggaagcaggaggcaattgctttggcttggggagactctaccaagccaaactaactaggttattaggagagagatgatagaacatgacagaaagaacaggaatctctctctttgtgaggtagatcagccaccaccagactgtcaccttccttgtcccatagcatggagatgaatgggagagtcagatcacagatgcacattttggaacagtaagatgatgggatcttctccaagtaggctttgggggtgctgtctttggctttatcagtagcagaaacacccagatactctaaagctggctatggaaaaataattaccatgaaaggagtcagccctggcttaaaaggaaagttcatagcaaggaagtccagggtcacctgcagatggggcagtggagggcactgtcccaggaacaaggaaggtttaggaataccacctgtgcaaggaaaaatggattggagtagggtatgtttcttagggagaagataagtttgcacccttgggaactcctggcctctggactctgagcaactgaagtgtcaggactgtgccttctcctgctctgagcccgtaggaccaagcacagtgcctgacacatggtaagtgctcaggaacagtctgctgacttaatgaaagggctggctacaaaatatgggactgtgaagggttccttctgactcgggtcagaatgaaaataagtgggcttcactgtagcacaatgggtttaggttagcagaggttggttgtagagtgaatgaaacttgtagctcattggaagagaagcctagataacatagtgggatttcctcctgggagaaataaaaggggatggctttttaaatgggatgggttttcttccatttcagagggtgcagatgggatgttttctagccttagaattccttcattcttactagtaatgtagtgatacggtggtattatttcatatttgtgggatacttattttttaatgacgctgtcatattccctttctctttagatgctcacagtaagtagctctgtgacacaggcaagtcagaaattatctatttcattttggtttcacaaactgaggctcagaagtaaagtgacaatttaaggccaacacactagctggtgatagtgcccatgctggaacccatggctgatttttggcttggttcttagggtaaagtacggggtcgcagagctgcagatgctgcaaatcaagacagaccagagactagagcacagatcagcggtgtgggctgggacagtgctataggtcgaattcctcaccaattctgtgttcccctcctgcaccaaattcgtacattgaagtcctaatcccagtccctcagagtgtgaccttgtttggagataggaaatttgtagaggtgatcatgttataatgaggtcattaggacggacctttatcctgtgactggtgtccttatgaagaggaaaatctagtgatagacacatatacagggagacgctgtaaaaacttgaagacagccatctgcaatccaaagagggtgcctgggacagatccttccctcccagccctcagaaggaaccaactctactgactttggacctccagtctccagaactgtgggacaatacatttctgttgtttaagccccacagctggtggtactttgtaacagcagccctagcaaatgaatatagacaggacagggaggagtgggtcttctctgaggcctggcaatttccactggccatggttctctggaacccagcccccagagcacaaagctgcctgcagggagcagcatcacactctgctaaggagaccccagggtggctaagatctgttgggagtggcggccacaagtgacaggaaagagggaaggtggggagagaaggctggttacgtgtctgcatgcctggcacccagcggcaagctgggatgccattagcattcctgcttccagggtgaggaccgtattggccaggacagcacttgctggttgcctggttgccctgttcagacattaatgtgccctcaagtaactgcagatggagccggtgacaacggataggcaccagcctctgctacctcaccatttctgaggccatcaagtgcatctggatggctgcttgtagaaggccttcctgtcctgtccccaagttgcccagtcacaacagttcaggtgtgcttgctgaagactaaccccttcccacctgaagctagtagactcgagcacgtctctggaagcctatcaaacaagaaacagaaattaatggcaggcagtttggtgtggctgtagcagaagaaaaaagatgagacaggagatctagccagggaccagatcctggagtagccaatgagcctcacccaggagtctgggctctctcttaaaggaggtgggagccacgcagaatgctaggcaggggaaagacaggtgagacttgcatttcataaaggatcccttcagcactggtgcagatgatggatgggagatgagctcagagaagggaggctggctgggagaccgctgccatactccaggtgggagatggtgggcttgcatctgctgcttcttcctgctctctgaagatggccagagatcagaaagcaagggaaggaccctcagttttatcctgacattcatccctgccacgttgacatagagagcaggggaggggctgaaaaaatagctcccattccccagacagtgcctgagatcatctggaggagacaccagctgggtttggttggactcacagggaggccacatggggcaggggaggtttcagaactaacagagctggctggagccatgctccagcacttaccagtgagcaactcttaggcttctctgagctttggtttcctcatttataaaacgttgattctaacggtaagaccctcctcacatgattcatatgaaaagcaaatgagccaacacatgggcaaaagtgcccagaatgaagtacctaataagggtgagttcaataaatagaaacaaaataccaaattctacccccctcgtttttttctttttcagatatgaaagtggagatgcagagaggtggagtgagctctccagggtgatataatgagctattaggttgcatacttcccaggttagcacgtagccaacagtgacatggactggaaatgtgaggccagtcaggaagaccagccaggtggctgtcatgggagaggccaaggaaccagagagcttgggaatggagaggaaatgatgaatcagagacattccaagaagagacagtggtgctaagtgacagagtgggtcaagcagaggaagagggcaaggatgaccccagtgtcttttgtgggatataatggacaaagagacatgtctgtatcagagtagggtgatgacaaaggaagcctattaagtcacaggtgataatggtacatttctggacttactgtgttcgaggtgacaaggttctaaagtgaagaggacttggatgatcatgtgagaaggagttctaggctgaagaaatatttttaaccagttgcgttgacctcagagggtaaacattttgttgggggaaacagcagttggatcctgtgggtagactctgctacaagcattaatcctacccctctggaaccaggacacattaataaatgtgactggtgtaaagtccaaggcacagacactcgcaaagaggccactaagtgctgggcactatgtgcaagagaaaaaaatagtaggcaaacttcctagcccaaagatactataatccagttggctatacaagacatatacttaagaaaaggtaactaaaagtcagagacaggtaatagttcggtaaagaaagtcttgaggcagcacgcaagttatttctgcatgaatggcaattcttactgcaggagtccccaggaggaaaagacagcttcaggctgtgggatggtgagggaggtccttgcaaaaggccttgaaagctggagattgtccctagttttgtcttagttttggatgtctaccaatggccctctcattggtttttgtctatcaatagccatcagtagccattctgcccagcgatgccattctgattgcagaatgatggggtcttctgtttggaaagttttcactttgattctgctaaactgctttctgcatcggttctgcctactcctattttcagcataattactcatatcccaggcaataataatgcccatacatcatgcaaagatcataattttctgatcaacctctatcataaagaggactgaagagtggagtagcaaaggtatattaatcctgactagtgcctggccctggacctccaggacgagtgataaatgtttaattagcccaataatacctgttttataatttttggatctcattgcttgctaattctaagtttactaaataactataaactttacgttgttgtaaagacataattgcttcttcattgcttatttcatatgagttaattatactagaactaagtttttccccattcatattatcaattagttgttttaaactattgatttgtatttaattaactatgctattacataccaattaaattcatataagaggaatctgaaacagctgtggtcttaaattacgtttttgaaataatgagttctataacatttcatgtcaagttattgtcagttaggaagagttgacaatcatttgtgataattccaaaaacttgttgtgacccgccagcccatctcaccagctccagcaggcagcaagcctccctcacacacctgctgatcacgtgccgatcagcaccttacagcttggtaagcagtggcagtgcctaacactgggataaccctttgccagccctgccttctccagcctgctccagccatgccattatttggctggcatagctctatcccccatgcggccaaggcaggcattatcagcaactcctcaccaccagctgtggggtctagaattatctgtgctgctatgtctcagatcctgtgtgcctgcaggaaatctacatgcccatgtggtcatctatccttcggcttctccaaatctctgctcactggcttaagtctgtacatctcaggtgggaaaaaagacagcagtcatttgctgagctgcaagggacatttaacttttctcatctcgtttcaccctcacaacacctttatgatcacaggtgttattctccttgttgttatttagcgagagattgacactttagaggagtgaggagtttgtcctgagtcccacagctggcaaatggtgaggcttgccgtacacctccatgttggtgcttgttggtgcgtcgtgccatgctctgtctccattctctgtgagattcgactcccaaccaattcggagtctcagccctttgggctggctttttgataccttgcctagctcttatcatctttctctccttggagggctgggttcctcccctaccctcagacactgcctgggatctttctcccaactgatgaattgcctggaattctgacacagccatcagctttctctggggcacttggccatcaacatgggacccaaggttggcagagctcaccccactcctctgtacactgaaagtgggacactggttactatctttgggggctgggtgcagcccagccttgcccctctcccttggccagcatcaccaagtgtctgccacctgggaccaggctcatgtagttcaccatcacaatgaaagctgccatgtgctgattgcttatgcttcattagtctctgggctgagcactttgcatgccttaccttctttattcctcatcaaaactctataaggtaagtgctgttattattcctatttgacagaagggaaaccgaggatccaaaaggttacaaaacttccccaaggtcacattgctagtaagtgctgaggttagtaaagctaatcatgaatgagattctttggacttccagtataatccgtttgtgagaggggtggggcggggggatgttaaataatgttggttaaagaattttacgggaaacagttttatcccatgtgcaaggatgcctcagcccgtctctgatttaacgtatctaattccaatgagttacttgctaggtgggggaacagagaaataggatcatgaaggccattcctgtcctccagtctgtcttccacacaccctgtgaggaacaggggctgccaaaagccatatgcctgagggctgttagacttttcctaacagaaagttggaagtcgtgactagtgtttgaatggggccagatgctcgacagctatgtgtcctacccctggggaggctcagcctggtccattcagtccatcatggctgggaggccaggcaggaaaaggcatttctgctttccttatttctagaaggaccaagagttcccaaaagactaagactgaaggcaataaggaggcaggcaaagtcccagcctgcctccaagtattcccttccccagcccctacagttctcttgaggccaagatctttgcaaagccagaggcccaataacaggttatacatacaagactgatttgtgaaattagtctttgcccagattagtgaatgtgtggattattagctttgctgtacaggtgaggctcagggaagccaagcaattttcctaaagtcacacaactgggaaatggacgacccaggattagaacccaggcccatttggttccagagcccaggcttgctgtgcccttcttccaggatgtggtcccaatgtcatgcacacagcccagctgaccagcagagaccccagtgggaagaggggaccccccccccgccaagcaggtgctgctgatggagtcacaggcatcactgtcaggtggtcaggagcactgagaagcccttgtgggagtgaggctcctggagagcccctttctcagggactggagaggcagggaggtggggtgaggtggggaagcgtggagaatgcctgcctactcagggtgtgcaggcagcaggggcggggctgctatttagtgatgggcttacaaaccttcttgtcacctatttatggcccacataaaactctgatcactgaggattaactgaagagggtcctagcagggccacacgctgactttaaagaattgatcactggagtcaggcagtcatgtccagcccctgccctcaagcccctcacatgctgccgaatgagtaggggtagggggagatgtctgctctcacttggcacaagggaagggggcagagagaagaacaaaatgtcctgcgagtggggagtgcagggtttttaggggtggagatgtgtgggctaaggtccagtgggctgggaatgccccctccacattctgggtggaaaagcggcacaggagggaggccaggggacagcacgtccttgcccccagccaagtcacagtcacagctgcctggttcacagtccagtgggcatgcgttgcctcgcggggtgggtcctgttcacccaggaatgctgcgcaccttcactggggtggaaggagggagggctctccagctctccttgctgtctctcctccctcacacgtttccgcagagaggactgtcctctagggcattgtaacttgggccaccttgggagctgaggctggtgaggagcagaggatgaggaactggtgagatctccccaacagcagagccaagcccaggcagctacccgcttcccccacccaccccagcccacacagcaaggagggaaagtaggcggtggggttaggagaggacccagcggaaaaggcagggaaccccgctgtcctcccattactgaaatcctccttgagccttacataccccattacgacgctgtatcctataattaaattgaatctgccagttacctctcagcacggcagcaattcaaactcattggaggctttgtttattttcatttatttatttatttagtaattatttatctagctatccagagagctagatggaggccctagcccaatgtttcttttgtcttcaaaaacaagaaagctcaaatgcagtctctcccacttcaggtcaagagaggaaaggaataacagagaccacagggtggcagcagatccgcggggggacctcttgctggggggatatcgctgggacagggttaaggtcaagattgcaggggaagttttgtctgcctgccagtcatggtctggaccctgctcctgattctacccattctattcttgtcagagatactttatggaaagtccacacattccagaaagctccatggaagccccttacaggccccagacaaggggcttcattctgagggactagaacatcggttgcggaatgtggaaaccaggttaactgagtattattggcaactaacacacctgcagagctttgcagttgaagaagtaaatacatgttcttctttaaccctaaacatttatggaggacactgaggatgagagaggttccacaacctcccttgctcaaaatcaccctgctgctaatggcagggctaggatttgaccacaacgcttggggtaaaaccaaactcccccacctccttcagagccccatatccaagctggtggcccagcaacaaaaatcaaagctcttttcttctctttaatgataacctttcagcagtgagtgggcaaaggagagcatgatggctttgagtatggaatcaacctcaaacaggtccaggggagcgattctgagccaccagccatcactcaataagaacatgaaagtttatttaccacgaggccagcccagtgggaggcagattgctactattagcatgccaaggactgcacagaccctgcacgtcaatagctgagccccagagaagtgaccccttttggggttatccaatctagcagccccaccagagcaaaggacgagggtggctgggatagtgtgtgcttacatgtgtgcacgcatttggagaaagggaaggaattccagacttgagatggctccttagacttaaatctcccttgaaaagaaaatgctgcttatgaaccacttccacccttgcctacctactcctgccaacccattcatttgtttattgatgagctgcttaatacttcttggaataggaatgaatagtacgagaaaatacctgggtccacactggcaattcctgggtctattctggaacaatcatgcttacaaggttttcggtgcacatgggaggtggggatcagtgtgtctctgggacctatttacccctatgaaccactggggttcttgactcaggctctgtcagtccacagagggtggttatggcaatgtggaggaggccggtggcccagggcctgaactgcaggagaatttatacttcttgttcatctggagaaagttctctggccagaggacacagtgagggagcctggtttaaaaaaaagaggcttaagctaagaagcccggggagtaggaagttctatgctaccctggcttgaagctttggacagtcggggcaggttctctcttggctcctgaggccaagagaagccagcctaggaaggttggaccattgatcccacagccctggggccttctcacagtagtgtgggtgtcacaaccacctcttagctcttgatcagagatatccaccttcagtctcctcaatgtgtacaatggagaggtcttgggctgcaataaggactggagataatgtatgtacaatactgggagggaagggtaaagagagttgtgttcctaaaccctgtctaaatgtatggaaccaaggccggacacattgtaagcccctataaatggtacttacttataaatataatatattattagaaagtacaggggtatgctaaaagtcaggaaaataataagatactctaagattagcctgaggaatccagttctgtagcttgaatagagactgctatgttgttggagttaatacccacagcagctcaaggaacagctttgttcagctctcagaggaaggggctgcctggtggctgtcctggggccgctgttccttctatcagggattctcacacccctctcaagcatcacatttcattcatagttcaagagcccccaagaatctcctctgtgtgtggccttctccacccctacccttgcagatgggcatcccctcctctggacaccaccccccgccaactgccttattcatacctcttcattcattcatacctttgctatgagactcccttatagatgcgaccacggttttgaatttttgctccaaccctcccagactgtgaggtgggaaccatctctattaatctctagaacctggctcagagccaggcacatagtaggcactcagtgcacatgtgtatgtgacgagtaactccacagacagggatgatctactctaatgttcaacagattaatatttgatttagcactgtgtgtcccttcaaaattctgggggccaagatgagggctgaggtctgagatctctgctggtttgagaatgggacttcctcctaccttcatttgtccttccttttacagaactataagtcagcctcaggtatgggtcagctttatgtagttaaccttccagtcattcaggtttttatctttgagtttattctaatttcattcattcattctcattcattcattcattcattcaaggagagctcactctgtgtcagttctggctgttatggatattgtgatgaacaagacagagaagaatttttgccttcccaagcttccattttagacagcttctatgtagttcctttcccttacacgtaatttagaggtaggaagtttcatgtgggtttgggcaaattattaaacatccctggacctcagcatctccatcttcaaaatgctgtcaccaaaccctctctcaggctggcagtgtgccacccaccacagcttggccttgcatggctggtgcttggtaccaccagttggtttgaatgtgggtgcacgtgcatgtatgagttcattaatttgcttcctttcttctcaggcacttagatttttgatgcacactgagagggtcctttttaatcagctgaggagcaagggattcctgagccacaaatgaggctctccctactggaatgcagaaggaaggacaagagatgagcctttactgagatgctgctatctgctgggcactttacacacacacagttatgccatttagtccacactgtaactggggagggagttgttgcttcctgtgcttctcatatgagaaaactgaggctgagagaggctcaagggctcccataactgaagacccgtgccttcgctgctgccactcaacctctgggtgggggatggggtgctcagtccacgtggaaggaagagagaaatagaatgtcacagagctctctttcaataaagggctcagcaaaatgtttgtcttagccgcgtttcctatcgacccggtgtgtggcacatggattaagtatgcagtttggtggtctttaaaggatgaacattttctctaggatcaataagctgagtgagtttgggtctgaattcatcaaaatgtcacctgaaacaaattcagtatcaggacttctgcgctcaggtcaggtcgatgggtgggggcagagacaaaacccagggaataccaggtctctgggaaaaaggtccagggcatctgttggacaaatttgggtctgataactcagagtggggagggggtcctagctggcaaccagcatcctagaaactaaccgctggcctggtacagtggcttatgcttgtaatcccagcactttgggaggccgaggcaggtggatcacctgaggtcaggagatcgagaccagcctggccaatgtggcgaaaccctgtctctactaaaaatacaaaaaaaaaaaaaaaaaagattagcggggcgtggtggcaggtgcctgtaaccccagctattcgggaggctgaggcagaagaatggcttgaacccgggaagcggaggttgcagtgagctgagattgtgccactgcactccagcctaggcaacagagtaagactctgtctcaattaaaaaaaaaaaagacactaaccgtcctttctctggtctagacgtcatccttaccttcagagagaatagctgagtgagaagctgtgtgaaactgcccagttctagattcttcgaacaaaaagtgtttttgaggttaatcagtgccattctcacacccagtgctaaaggattccccctttagcaccttggagaagtagtcacactggtttcccttggatcgttctaaagacagggagctcattactttggaagctgtggttttcatttttggagagtttaaataattttagagttcttctatgttgagcttaaatattccctacagccttgcaactttgcctcattagtcccaaatttgcactgtgaggcaacacagaatgagactaatccctcttccacccaactactgagaagtttaacagacaatcttttcttttccaaaataaacaacccttaggatgtttcggtcctgggatgcttgcagcccaggaaatgctccctccctctcccctccagcttctctgcaaatgcaagactctggcttcattccctggtccttcctcagtatctcacaaagaaagaggagggcaaaatgggaattcattggaagagatccttggttcacacgctaggaaagaaaagggatgatcttggtcttggcgtgaacttccacatgaacgtgactccgtgcctacctgctaataagagcgggagtgtggattgtgcacataggtggggacggggtgagaacttggggtgtggcgtgtccctgtgggtggacacattgtgaacagtaagtatcatgaatgtgtgacagcatgtggggcacgtgggtgagcgtgtatgcatgtacacaggctgtctgctcaggtcctgggggagggactcagaatccgcctcacacccatggagagttctcgcaatgggtatggcaaacttcctgaccaacaggcttctggacttctgactcagcaccagtcctgctccttctgtctcaatgactgtcccctgtccctggagatgtaaaagttccaggctctcctaccacacctaggctggacttactgattccaaggtgaaaataagccatcacgtattgaccatctgtcagcaagtatctaccctgcaaaatacttttcacacactctctcacttatcctcaccatgcctagagatgggactttgtctccatgtgacttatgaagacactgaggaccagcaaggcgagacaactgtttgaggccacacagcaacagaaccagacctcgatcaaacccaaagcccgtgctctgtccgtgtgctgcctccgagaagccatggccaagaaaggtctttgcaccagagctcaccaatgtctcggagaggtcctcccttcctgccagccattgatgatcctggaggatgaacgggtcgtctaaaacagatgacgctggtgcgggccccagggagttccaccaagagccttaggatttatcatgtgggagggtagttagttcccaaacgcaggtgagtataaaatccaatttcttaaattgcatccagggccaaggggtgcaagctgctctgtcagttatgacttcctcgggtacctgagactgtagctcctcatttcctaaatcctcctgcttgttgtctgagcttttagccctctgatttacttattagatttctactgtgccttttctctgcagagtgctcagtgtccccaggaaccactctctaatttaacgaataacttctctcatgagcaaatggggtccgggttcatgcaagaagccagtggaagaggagaactggggagacagagagtgagaaaaggggcagaaaaaacagggcagggtacaaaggaggcaaatgcaccacctgtggccctagagtggggagcattgaggttggatggcatttgtatctagagttgcacctggatctggacaatgcttccaggttaccactgctggtaagcaatgtgcccaaccaccctctctgctctcatgaccccctgcctctctccacctctgcgtgatgtttttctgttcgcctgtctgtctccttgaattgtgaggtccttaaaagagggagccaagtcattttttttttttgaggcagagtcttgctctgtcacccaggctggagtgcagtggcacaatcttggctcactggaagctccacctcctggattcacgccattctcctgcctcagcctcccgagtagctgggactataggcgcccgccaccatgccaagctaattttttgtatttttagtagagacggggtttcaccgtgttagccaggatggtctcgatctcctgacctcgtgatccacccacctctgcctcccaaagtgctgggattacaggcgtgagccaccacacctggcccccagtcatcttttaacacctggcacttgtcactgtgtctggtccacagtaggaatttaacacatacttgctggagaggccagttacggggcacagctgaaagcataaagatgcactgtataacatttcagcccccagaggacccacagttggggagacaaaggatagccaaagacaccatggctgggctggccagggaggtcttcgtggaggaggctggactatactgggccacctagaatgctggggactggtgaaccggacagcaggaggacattctaggaggaggaatggcttgagccaagggttcaggttgcgatgggcaagggggtccctgagtggaaggcaggacctgtgcagggaagtctagaaaggtcagtggaggcataccgtggagggctttgagcacagagggtggagcctggaatttcttctcctgtgatggagcctctagttcgccctggcccagccccatgtgctgtctggcacatttgtgcactgccctcctgcaggagggggcctggcacagtttctgtgcaccctggacaagcagggccacgtgtgggccaggactgctctgccctgtcttctcctctgattcaggaaggaagaacttgccctggactctgtctgtctaaaataacctcccctccccatccccacatggccctacctgttcccggaatttcctgttttttttttttttttcttccttgactttacagtctccgggttgcacttgaatctcaatggcatcatcccctttcagtctttgcatgtgcttcataaagaaatgactcttttgtgcagatccactgcctatggtgaagtaggtgctcatgtaaatgccaggtcctagctctggaaagggttagacagcccttctcaaaccatgcctgcaatgccagtttaaagaacatggaggcaggacagcagccatgggaatgaagggtggcagataaaatcagtgccccagaagctctggggcctcctctcattgattaaattttcaaatataattttgctatagttagtggggggtttagagctggtcacattatattgaatttttttttgagacagagtctcactctgttgcccaggctggagtgcagtggtgcaatctcagctcactgcaacctctacctcctgggttcaagtgattttcccacctcagcctcctgagtagctggggttacaggcacccgccatcatgcctggctaatttttgtatttttgtagagacagggtttcaccttgttgaccaggctggtcataaactcctgacctcaggtgatctgccctcctcagcctcccaaagtgctgggattataggcgtgagacaccgcgcctggcctatattcaattttaaaactttcatttatttttaaaattgaaactaaaagttgtagatctatttatggtatacaagacattttgataaaagcatacattgtggaatgaatacatcaatgaattaacatatccattacctcacatatgtatcattttttttttgtgcatggtgagaacatttaaaacctattctctgagcaatttccaattataggatacactgttattaactgtaatcaccatgtcctgtaatagacaggagtctcctcttgaaccagggttatgtctcagaaccagagtaggaggagaagcacctcacacacgagaggctctgctgtcctgacgtggcacggaagggaatggaagggacaaggggaaggtgctggaaaggggccagctatgaactgagcacaggtaacagaccacacctgacctcctggatccctagttacacaagggcatgtattcattgttccattccacagatgggaaaacagagactcctggggcttaagcagcctgcccagggtcacacggctatgtgacagaagggctggaacctagatcctcccaccccaaagccaggctcctccctgtgatctggccctggttttgcctgtgtgattcctctggccttactgggtgatactgagccaatcgtggagcctctctgggcttttgtcttctcatctctcaagcgaggggcatactctcaactgagcattctttgcatggcctgtcctctcagtcaggccagaccaggaccagctcctgccattgtgcattgcaaggatgcactgcttgctagtgggcctgagattcaccagtggcaacacagaggtgccttcaccagccttgctaagctctggtttgtgtttctgcctctggtgtttggtatcagaacgcattcccctgatgctgccggaagcaataatccagacacggttcgggggtttagtggaaatcctctgctatagcggaagaaaatgaaacccagtgaagcaaggatttcggcagatgcaaaaatctgcccatttacctccccagtctgaattccacggcagggacagctgagaagcaggcggatggatgaccttagctgcaggtcaggtggggaaggggtgagaactgagttcagaagactggggcttctgcaggtctaaagccccatgaggatgggaggggaaggtcaccgagtatttgcaaacatgttgtaagatcaggattgaccttaattgagtgctgactgttaaaggccagtgcttcgtgcagcaacatattttccttttaagcccttgcaacactgacgtattgaagaagtactaaagaagtattatccttaattatctgatgcactgaagaagtattatccttaattatctgaggtactgaagaagtattatccttaatattggtatgagggcttagatagcctaagtgacttgcccaaagctacacagtcagtaaatggcagagcacagcagaaatgctcactgctaacagatggacactgctatctgttcttgatactcagaccctcccatctctcccatccacaccagttacccaccatcatggaaacatgtggttccggatgtggacagctggctccccgggccccatacctcctgtgtgctcctggagccttctccatctgacacaccatgtcagatgtggtcctggaccttcctgctatcctcagctcactgtggactgtttctgagccaagggtattgtgtggttaccagggaaaatatgcccccgctctaggcctgccagcagctctagggcaataagccatctttctaaaatgagatttcctatttcagggactctgaaatctccagttctgccaaacagcaggtcttctcctcagcttaagatagctgggatcatggctgaggttgagctggtcacagaccatcccccactgaaccaatgataacaccctgccaagggcctcagcacgagcaccaggagcttctctgttcacatatttacatatcaagatagaaaatgaatatacgaaggagtctagcatgaggaggacgggatgcgctgtggagttagacacacttaggttcaaatcccagcgttgtcacttattaattgtgggaccccgggcaagacatttaactcctctgtgagcctgcttccttctttgtaaaatgcaaagaatgatcccatctacctcgaggagctgctatggggataaaggagagcaagccctcagtacggtgcctggcacgcagcgaggactccctaaatggaggctcctgctgtcacgaccctcgcccggggaaatgcctgtcttctccatttagaaagtgacagctgacggcaggcccgaggcagccaggtagggaggctgcctgtgtgcaacccgctgtggaggctgctggtggctgcaggctttcagaaggcattacaggccattgttttaatcaatactatattatttcctccgcggcaactatccccatgtttattatgtgtaaatagggtttttcaatgatgtgaatgtgttagcttaacgtagctgacattcagcgtgcacaatctggtggctgcccctcaggacttccaggaaaatgagatgatgtatccgtcacaaagccatcctcgtgagtaaaatttgagcagtggcagcagccagggcacccgatgaattctgcaggcgtgggctgcgtgcttgagaaggaaaacagacatcaacatagcctgggagcacagtctgcaggcagtgtggacagttggtgccccggaattagggcgttggcgttcccatctctttgctgccatatctagatcctatacagcttattccaacacctctccattgcctggcgagcgcctgtggatgcactcttctgcctactcctggaacttgtcaaggtttgccctctctgactgtagctcctcactctcctggactctaggatgggcccctttcttccccatacaaagcccccagtagtctgaaaactcatttttgtctatgctcctcagttcagcccaggcatgtgggtatgaccgagcctggctgcaaaggcaggcagaggggagcaaaggtggtctttctcaatgtcccatgtgggcttaactttcctcctcctgtaccagggcactcagagtaacaccaccaatgacactaccagcttctctctggtgtctaactggactgaaggtgaagcaggtggggtgtcgtttagatctggggcagagcttccccactgtgacacccttgaagttgcaggccagatgccactaccacacatgggtcactgtcaacaggccacaaccccaatgatgggcacttaactcaataataccagatatcagacaactgtggcttcatctgtagagctctctggagtgcatcataaaggaagtaacctttttcttttttctttgcttttctttttttttttattttgagacagagtctcactctgtcgcccaggctggagtgcagtggcgcaatctcggctcactgcaagctccgcctcccgggtttacgccattctcctgcctcagcctccggagcagctgggactaacaggcgcccgccaccacgcccggctaattttttgtatttttagtagggacggggtttcatcttgttagccaggatggtctcgatctcctgacctcgcgatccgtcagccttggccttccaaagtgctgggattacaggcgtgagccaccgcgcccggcctctttttttttttttttttttttttttttgagatagagtctctgttagccaggctggggtgcaatggtgcaatggcgagatctcggctcactgcaacctctgcctccctgattcaagtgattcttttgccacagcctccccagtagctgggattactggcactcaccaccacgcccggctacattttgtattttcagtagagatgggttttcaacctgcgggccaggctgctctcgaattcctgacctcgtgtgatccgcccgcctcagcctcccaaagtgttggaatcacaggcatgagccaccgcgcccggccaggaattaaccttcaccaggatagtttgtggaattttatcaagaggcttcgctcccatctcctgctttcttaacagagtttggaagcagcggaccggataggaaaactgcttagggttccaccctcatgccaagtggcagaggccccgggggaagcctcctgcggaacgtgggaacaaagggatgcggggcctagcactctacgccggtgtctgttcgtctgtccagaaggcttgtcacactctgggggggcatctagctaaaaggtactccatcaatgtaaacgaccgtcgctctcgttaagttccatctgtgtgtcttaaagctcccgcacggaacgtgattggagttgggcttcagcttccctgtgctgcctgagacagaggagggagatgtttttcttggcaaataaatatgatatcataagccctggcaggattccagcctgagtaatggccgtctgccttcctaattccctcagcagcttggaacaggaacattactctttacttcctctctttaaaaacaaactctctattggagcgcattactcagccacaggatccctccccggacgtggcggcattcagatgatgggaggtgaggaatgagctcagattacagcgcacattagggaaaacacagcaaggcatttggcccagaaaaggcacctgaggaccttgaattagagcggccactcctcatgtgtccttgttcatgaggaacatagagctaaaatcaataaaaatcacattgtttagcgctgccgtttccctggtttaaatcatgaaggagtaagtaggtaattaggtaatccagctcggactggatagttaccttcaagtacgaagcggtcttgctgagaccctctcactgaacgcgagctgggggaagggtctcgtggcctctctactcacaggagcactgctgcctctaagcacataccccgccctctttctgcttgtcattagttcttcctaacaacagttagaggcatcggtgttgttactttccattttataaacccgaggctcagtgagactaattaggtaactcgttcagggccataaattatacatagcagaagtcagagttgaactcgggtcttttggcttcagattcaatgtttacaacgccacatcaagcctcatcactttctctggcctgtgaggacttgggtgctgccacttgtcccttttgaagtagcggatacaaggtggcaccgtgaaggcactgggtcaggagctgggacacagctttgcatcacttgggcactgttctgctggggcctccttggtaaccaaccatccaggtgaggataaaaactgacccagcttgtagagagatcttgaggcaggcatgcagcaagggccctaaaattactgggagaagggcaagtcactgttcgaaggcttgggatggtgaattcagccaataaacgtcctttgaacacttactatggctaagcatgggggcacaactgtaaaccagagagagtccctgcctcagggagctgggagtcagtgggagagatgaataaacaggcaacgacgatgcagtgtgatggatgctccagtggaagagtccagagcaccgggatgatgtgtagggagagccactcaccagacatggcagttcttggaaaatgtccactggggacatgacatccaagctgaaacccgaaggacaaataggggacagggagatgaagacgggggctgcagagcgttccaggctgtggaggcagcgtgtgcaaaggctgggaggtcagaaagaacacactctgctccggtgatggcatgtttggtctggcctggagcagagctgcaggggaagctgtgaggcatgaggcagagaggtaagccaggagtagtttgcagacccctggctgggcagctttccaatctggaacagtgggtcatggagccatcacattcccaaacccacagcgcttccctctcaccaaccctgtagcctgcagtcttcactgtgctctcgactcccccagcctttcattgtatgtggaagaggagccagaaatgcacccaaactgaaagaggagcacgcagcaccaatccctgaatcaaaataaaaatccggctgcactttatctcgctgaaggactgtaatctgggagatattcatttaacatatttctgtctctgaatggcttttacttttcactaaattgaaaccgcagtacaatatatgtgaatgattaggttgtgtaatacattccagcaaatttagattaggaatgattatgacttaagtaaaatagttgaacacaattcttattgccatctatcttttcacttctttttagttttcatgagagtgagtgaatgcaaggaatgaatgactctaaggagagctgggccctggtacagggaggggcagaggtctgtctttggaaggctttaggaagaagggagaggtggactggaagactcagatctagggctcgggggaaagcattgggccatgaggtagattggggacaagtcctatatctgccgtttgctagctgtgtgacctcaggcaagttacttaaactctctagtcttagtttcccatcagcaaaatgggctttattgttccccggctcatggaatcattgtgggacacaatgagatcagggacatgagagtaacactggccaagagctcagatggggagtcaaagtcctgatcaaagtctggctctatcacttattagagctgtgtggccttgccctttgatactcagcttctctgagccccagtttcctaatccacaaaatgggaataagtgtactcagccacaggtatccttgaagagaggcttaaataggatttttttgcatgttaatagtgctttgcaaaatgcaagttacctgggagggctatgctggctgataggggtgggaataggaattggggactcccctttcctgggatagcgacctggaggggtttgggtggagccttgctgcgggccctgaggcagggaggggaaggagaggaggagtccttgccaaaatttccctttggagtcctaagccttgcacgcgccctgggcactccaatcctcctcactccactgctctattttccccatagcattgaacatgctgtaacattctatataatttaccaatttattatgcttttgtttagaatctgtttccctggttcaaaggtaaggcctacaagggcagggagctgtttaatcccctgataaatcccaagcacctagagcacagcttggcagttaggaggcatgctcaggaaatatacgtcaaatgaatggatttatgagtagggctggaattctgtctcctgagaacaagtgagctgaggtgggaagaaggtggcggtggtggggggaccaggggagacgagggcatcagtcactccagcagggagcttgctgcagggagaaagagagaacagcaatttgggccgtgaagcctggcactcattcttcaagggggctgcaagcccccaggattttcctggaacccagggcacccgcacactagctgcctctcccggtcccttccagcaacctgaggaaatgccttccaatcagagcaattactgctgccctggagccgctgcctctccaggtgtctgcctcctgcggctctggctggagacaatatttctcctctgttcatcacgagaacagggacaacaaataacacaatggcagatgaagggccctccaagccctccagagctgaaagagtctgggctgttggcagcgtctgcgtgcaggggaacagaagctacaacctgcgtggggtgtggggatgactgactcttcctggatgggggcactgtggccagctttgtccgggaactgtgctgctcctggtccaggcaggcagggctgtggcagccgccctccgcccgcccaccagcaggcagggactcagggcaccatgggcttgggaaactgagagagagctatgtgtgtcagttgtcttgttaagttttttccccttggtcttaaccatgtaggtactcttgtgttcaaaggaggaaatggaatctcagagaggctgagtcactggtgcatagtaacacagctcatcacacagcagtgctgggataagtgctcccatgtttctgaacccaaagcacatctcgtcgctctggcactgagtgatccgtgacacagatgtacctatagggcgtgagtgcagccccttacctctcagcctcagtttccctactagtgcaccagtcactgaagcttgggaggtgtgtcagtgactcaacccactttatcctgccacctcacctgaccttgctggcatttcatccctgcctcctggggctggggctggatcttgcctagtgccccagctgctggctgaggctctactcagttactcctgaacgctcctctttctactgtgccccatccttaggagcaggggctccctctgaataccagccagggccactgcagcagaacatgccacagtcctttgaaagctgatctcaacaccagtatggatactaactctggctttcattgttgagcatttgttgagctcaaatgtaaacccaggaaccagattctgagggctgcatacctaaccattatacaggcctgcctcttcctcatttgacatggtcttttgaccttaactaccttggttattcgttttgttaataccccctttcaaattgatttctagaactgaacccaaaattccagatgtagcctgatcaagcaaagcctagaagaagaacatcacctccctctgttttaaaaattgctttgcaattaatgcagtctaagattacacccactttcctgggcccccagctcccagagtcgactcctatggggctcttcagccagccctgtctacagggctctgccttaaatccctaagtcttctagaaactagctgctgtggcagaccttttgtgtggctgagatctgcaacaccccagcggtccccacctcaagggctgtgtctgccgtggctgcatgcggccctgctgtggctcactgtggacacagcagacgaaagagaacatggtctcagctaagtggggggctggaaggaggagaaatggtctgtgaaggtcactgccactgtacggtgagtgatctgtccccatttcagcctcagtgggagagtgatggagggtgtaattagggcttgagctgtgcctgtgggggctgctgcaccaggctcaaggaggctggggacacagctggtagtctctgccctcctagataccttggtagcgggagccgcccttcttgggaccactccctcgctggccatcccagccaggtcttccatccctgttctccccaccccttctctcctcaaaatttgtcctgtatgtctcatttcacccattctcttgaggatttgccttattagaaagtgatctggctgggtgcggtggctcacacctataatcccagcactttgggaggccgctgaggcgggcagatcacttgagcccaggagtttgagaccagcctgggttacacggtaaaattacgtctctactaaaaatacaaaaattagctgggcacggtggtgtgtgcctgtagtcccagctccttgggagtctgaggcaggaggatcgcttgagcccgggtggaggaggttgcagtgagccgttattggaccactgtactccagcctgggtgacagagggagatcctgtctctcccacacctgcaccccaaaagtgatctgattcaaatgctgtattaagatgttaacatctaacgactggctggacgcttgtaaccaggtgtattccacaggtaacaatccttcaccaagagaatcccttaacctaaaggcatacatcccttagggtgaaatcctgtgtgttctggtgggaggtttgtgcaaggttggccccggctggttataacagccagggcattactgcacatgtaacctgcacttcccagtgatgaggaaatggcagctcagagggcttctacatcttgcccaagatctcagacatgctcttcctgtccagccttgtgtataccagccatgctctgccttgcacctggacctgaggtcagctctgggggccccatcagggtggtagtgcttctagaaggatctggctgttcagagaaagctctctgtcctgaaggcctgaactgggtgaggaacaggagcactataaatattgctacaatttcttcatcacctgccatgtcctagatactaagttaggctctttacagctcataccgtgttgtcatacgtatgaccatgctctgttttaccagtaaggaaactgaagttcagaaagtttaagtaacttacacttggccactaagcaggaagtcctggcagggggaaaggcaggcctgagtcagcctgcctttgggccctctcaccacccctggagcccaagcaacataggcctctcatagggccaacagctcccacccctatcacatccttcagggtgcagtgccacggctgggggtcgcttgcctttggactctccagagaggagtccctgggacagctgaggccttgctcacagccctaggtgggccaggaaataacattccagggccttttgtcgagcccctgggatggggacttgcatgtgctgggtgcctatgatgcctcaggccttgttctaggtactttccgaacagttattgtcgtaatccttataacaacaccataacttaatccttataacaacacaatactataaaggtatcattgttccctttatatggatgagaaatactatgtcttaatccctataatactatgtcttattatacaatgctaggtctgaatccttataacaacacagtactataaaggtaccattgttccctttatatggaggagaaaagcaaggccaagggaagtctaaagttacatagctaagaaagtggaaggagctgagatctgacagtttccagcgattccaaactcaggctctttctcctacaccctgtagcttctccaagaagattggggtctaaaggggcagagctttctccaggagcttctggtccattgagggagatggaatacatcaggatggaaaggaccatggcaaaaaacccacacagtacactctgcatgcctgctgtgcgggaaacagcgcgcctggggccagagggaagggaggagggagccagggtggggagcccaggaggcacatcaggggaggccttggggaagatgtgagtttggcaccagtcgcaggtaaggcctttttctgtgtgctctgggaagagaaagctattgagctgggtgtggtcacagcagggaagggctgggagcaagacactctcagctcaggcagaaaaggcctgttgttgagagaaccgatgcaggctgccgctgggagcagagggctgggcgtggcgtacctttctttcctgtgagggggctaggagctggctggggtgggagggctgaggggagcaggcacatggtccagccacgttaggaggcttgcacaaagggcttctaggcctgaagcctccagctcccaccccgtcagccgacttgcagattgtctgaatgggtctccaataggaaaaaagccagggctttggagaaacagatgcttaccacggaaccaggatgctgtcgtctgcaggtcacccctgtgtggatacagaccgtgggccaggaggctcttcagagcagttctcccacagctcatcctgtaattgactgactcatcggtcactgcttgcgcgctcagccattgttaactggtgacttgaaaattacctttatttagcaccgttatcgggaggcttcaggggcgccagcatttccacgccaccagctctctctggctgatggcagcaagcagcctcatcacactgtccccagctctaagccacagccactccctacccactgtggggaccagggaggggccctcgtgctaagtggatgcagtaggcaggccagtacctcccaacctgctgtgaccccctctgggtacaggtgggcaatgaacacccggctggacctgtggcctgctgtctgttctcctctgacttgcttgtctgctgatcatttctccatagccacgttgccctgtatgcatgagacaatctggaatgggggtcatccatggggtctgggcctgcacggagtggagttaattgcagaacttgtgcaattccttaattctgagtgaacgtgcatataagccttagggagagagaacattcatagcttttagtagattctcaagaggatttgtgagccctaggaagctgggaagccaggttctgagtcatggttctcagatcacccctccaggaagctgctcaggttagcccattgcaccgttgccatcactgcgagactcagggggtccagtggtgcaatacaactgtccccctccacccagagggcaaggccaggtctgtactctgctcagtggtggatgcagatgacaaatcacaaagagagaacaaagagatgacatttgcagaaactcctgcctttcactttctgctttattggggaaaagaaatcacatccccaggctcccttccctctgtccattggcacagtgtatcctcctcccatcctccacccctccctcctggtcacaggttctgccctgagatctgaagtaagctgtgggactcatctacctggagaagaaggcaggcagaagaggaagggagggaaggatggaggagctggtgaaaactaacagtaaggtgaagggtagggctgggggctgggtcggagccacaggattcatggcgtactgtgatttttttgttgttgctatggtcctttctacctggatgaattccatctccctcactggaccagaagctcctcgaggaaactctgcgccctttagactccaatcttcttggagaagctacagggtgtaggagaaagaacatgagtttggaatcgctggaaactgtcaaatctcagctccttccacttttttcgctgtgtaactttagaattcctttagcctcgtttttccttctttctttccacatagcatggggccttcaactgctggagggtctgggcggtcatttatccttgctgggcctcagaggcctcatgagtggtgcctttaagagtgcaatgaggccgcagcagaaactatctctaaggccagctcttaaattctctaacccatgctcctggccaactctcctctgtccagccgcaggtcctcatagaaaggcagagacactgaatagaacatagaaggggttgttttcctaaagctcatataaaattctgaagcctcagcgatggaacctgcatttgggagctgctcgatcttttctgttagcatttccgccacgtgcttctcagcgttttgccccagttggccttccgcccctgggagggggaacaatgtctcctggtgaaagtcactttgcagctgccctgggccctcggaccctcaggggccttctgggttgtgaggcgtggggcaccccgtcctgagcgtgccctgaagatgggcacagagctcccccagctgccgtggcactgtttccatgcagctgtggggatggtgacaaggcctgagggctgtcagcccggctgagagcactcaagagccacttcaccggccttcttttctctttccaaggctcttaacccacttgtggagggggtggcgggtgaggggctgaagagggtggatgtccactttgggcagacaaaggagctgcagtcagcctcctctccagcctggctctggagaaatgcagtcagcctcccctccagcctggctccagagatccggagctgagggcagtgtaggagctggcagggcccttggcaaagtggagcccagcaggctagttgtcccaggtttatcgcccaggattggggggctctgtgtggctcctgtcttagctgatgactcagatcttggactatttctcccttatcaaggtcttcctcatcctaaacttggccttgatttgagcctctttagtttaccaagtgtttacctgaattatctcatttaatttcacagcaaccggtaagggatgcattgtgagcatcatcttactgaggactcagtggctatgactcaggactgtgtcctttgcctaaggaaggccacacagctagtcagtggcagagataggactagaatgagttctttttctcccagggagacccagtggccagaaggcacctgcagccaggccacaccgcccccttaggagcgatgggggacagcaagaactgacaagccctgatggcatacaaagcctccaggtgaccagcagtgacagacgccagccaggacatcctttccagaaccttctctagctctgctggcataagcagcacctggttttcaaaggctttctttggtgtgtgtctatggtcataaagaattgtaataaacaatgattaagggtcacaatataggctggtgctgtgtttcctcccttaggagcagaggaaagtggttgaggtctccaagcaggtggggagcccttggcccctaggaaggcaggaaagtctcccaggataaatctgtctgttctaggctctggtgaacccaacggaaagccctacgagcctggctggtggctgagctgccttctccataggctgttcaccaatctcgagagtcacctgccatgaagtcccaggagttctgacatccagtgttcatgcccatggagcaaccaacaagaatgttctgttcactgccgcatccttagatctaacacagcacctggcatatggtagatgttgagtacattgtcaaacaaacgtaagtgaaaggaaacctacaagatcatcatctgcagataagtcacaaattattagccctatttttagaggtggtagtgaggcccagagaggtaaagtaacatgcccaatgtcacacagccagttagtgagggaagtgccagactctaggtctcctttcactatactctgtcccttctgaaggggggaaggtaggaatgtgatgacctcggccccagggccaagatatgttcttgccatgtttcttagctgcattgagttgacagtgatctgatgtggctaggtaatgaagagatggtttttctctgggaagtgactctgctccctgacttctggcaggcatgcgggagtggggaggaggtatctctgtgtggagctctacattctgtcttaggagcacaaagctcttcacagctcacctacgcatcttgagcccagctttcttcttccaggaagggggaatgaaagcaactattaataaggtaataagaactgaatcaaccatccagcctggtcttccagaagagtttgatggcctctagccttgggcaagagagacagagcccgggctgcagtttcctggcctaaaggatgagtgtctgcagatccatctaccagtttctagaatctttaaagcagcaggaggaagcaggatggggcattatatgggctctagtctctttacaaagtcattcagaggaaaacagggacctaggagaattttggagtgtggtagccagacagacctctcagaaattcccttgatttacactagccatcaccaaaatccctgtgtctccattctctccctttggagggccgttcccagcacgagttacccagaactacccacccaatcagagcccttggctctctgtggcagggggccctctctggtcaagagcagcctcgctggtcctggagcctgggccagagcccgcctgtcactctgcagctccgcaatgtcgggacaccaaagggcagtgccagtagcccgctgcaagctgacaaggctgagttcacatcagtgctgaggagtcgacaggaccatctgaattaagtggccaagtttagtttttaattaagtccccgtggtcttttaaaaaggtcactgacgacaccatcttctttaaggccaatatgaaaagacattcaaagtcaaagttctgagatgggagccttgtaacttgaaatgtcacaggaagaaatttggaaacagggaaagaggaagctggtgggaaggacaaccctgtcacattcttttgccgtcagcttcacagttcccacttggagctccaaactatttcggtctcaaagggcaagtggtcccaaggttctctcgagtgccttccccgacagaggattgtggagcctcttgtttgctgtgccagtgaaaaacagagcccttgtggtccctgacacggaataaaagttgatagcaatggggcagaatgtggcaacttacccctgatggctgaggaattaacaaaaatgtatgcaattggtcaccatcctctgcacccattcctgtcttcacttttctacctaccttgatcagtactgtatcatttggaagtacagttctgtctaaaacagagcacagcagccacttaagtcacccatagcatcctatgaggattgtacagtgagagcaaagacctgtgcctggcttagacccctaagagaagtagagacttgaggtaatttgagcagagtggaccacacctcctagagaagagatttggaccagccaatagctaatgagcaggcgcaagaatattttcctggagttcttggctcacgccaatgtctgaagagcgggactttctgagtggtgaagcgttcagtgactttgctagggtcagaggggttggaagtgctcagtagtgtgtgtcacattttgttcatgtttgcaataggccatgtaggaagtggaaagaattttggatttagattcaggaaatttgggtcttggggcaaagagtgctatttgcctacctaatatacattctcccatttatttaccattacagtactttcattgttggtgtggcaggttacccaagttaaccaaatatggatttcctagccttccttaagaagctagaggtgattgatgcgaatattcagagatcactggtaggcttctttaaagatggctgattcacctgggaggtgcacctcttttgtcctttcctcttgtttcttcttcctgcctgaaatgtggggctgatgactggagcttcagcagccattttatgaccatgaggtatgacccaagaatggaagccagtgctaaggatgggctgcccatctactcctggtcttcattttatgtgagagaaaagcaaacccctaatttgcttatgccacttactttggatctctgctacacccagttgaatgccaaactgatacacattgattgcccactctgtcattcactcctgagggactttgggcaagtcacttaatttttctgggcttcggtttccttacctctgcagtgggaataataattctggctttgtcttgcaagcgttacttctgacctgtagggctcactcttaggcttcctagaatgttctcaaccccagtctgaagatcacgtggtttttgtgcctgagcagtggctgcctccctcccattgtttggccagataattgttcccaaactaagaaatgtgcctgccttccgacttcaatggctgttataaagtccccttgtgggctcccattttctagagacacaatagcttttcctggcttgcccaggcctcacccctccttgctgggtgcagagacatctgctgtttcaagctgctaaaagagaagcttcaaagaaccccacattggcccctcttagggctctgactcatataaatgtttctagaaatcctcaaaagccttattaatctgttaagacatcccagaagcaggagtctgcacacccaatttccacggcttttcagctgcttccattgtctcagccgcattgtccctgctcggtgtcttggcccctaatggactctctctgaggcaggcacgctttcggctgcacctgctattccattgcctgactcttttcttcttcttctctgttctctttaactcttaaaatgaaaaggtgaccagctcttcctgggctgtttactcctctagctcccctgtgcgggtctctgcttcaccccctttctcttctggcatgtggctggatctgagtcagagacatagaggcccacatagaaagtaggggcccatttgtcttttccatcaaatggaagcctctaggggtctgtcattcctcatgcctagccaagataccgggtatccccacaagcctctgaaggggacttgcttacagctcttgcatatagaagctctaatcaggcttctccagaaactccctcatctctggtccatacagtaatgaccctctgatgtgtaaccttcactgtggttgaagggccctggagaaagagccagaagaccagggctctgttcctgacttgaccccagctggtttccattttcttagactagcatcaggggacttaacttgacagccaaggtcccatggtgggcagcttgccaattactcctgcctcctggttttcagacccctgtgtgctcccttcccttgagtatgggctagacctggtgacttgcttctaaccaatagaacacagcgagagtgatgggctatcacctctctagttaagttataaaagactagtttgcgtgttctgtcctgttggctctctctttttctctctgtctctccttctcagatgcttgctttgatgaagaaagctgctatattggagaggcccatgtggcaagaacttgagtgtagcctgtagccagtatccagtgggcaaatgaggctctcaatccaacagcctacaaggaattgaatccaactgacaagcatgtgagtgagcttggaagccaaccctgccccaggtaagccttgagatggtaaagccctgacttacatcttgattgcagccttgggagagaccttgaagcagagggcccatctaagctgtgcccagattcttgacccacatatatttagaggtaataaatgtctgttgtcttaaactgctaattttaatacagcaagaaataactaatctaggtccttattagctaagaagaaatgtgtttcttgccttgttcctctgtatttaaactctaggtccttaaacctttcatacccacgagctagccacttgggttgtgcatgtgcaccacccaactccaccaaccaccccactccaacactcaaatctatgggtggtgcaaatccctttactcttactccaaacatacatgatcagaaaaaatggaagaaagacatagctgaaatagagctccaatgagatgattcctggtttctactaggaatataagtaaaatttgaatttttgccagaatccaaagtattcaaggaagggctccttatacacctttgatcattcacttccatgtctcatctttcaaagcttggcttaaactttcctcctctgggaaaaaagaccctgacttcttcagttagggttactgttccctctcccagtcacccatcagttttgtccatatcagagcattctattttagttatttgcatattcccttctctctctcacccctccacggatctcctaccccaggaaggtcagcatccagtgaccttttcaggaaattacccaggatttcacaatcttagtcagaagcgaaatttaaaaccctttgtcccccgtcctcccagccccccgatgttccaggaagccaaagcacagagcaatctttccaatctaggaagcaataaagaaatgtatttatgaaccagcctctatctaagggagagaatttatgtctcttcatgctcttgttgacaataataactgattgctgcatcaatgtgatgcaatataattttaaaaccctccagaacaaggatcagaaaacaactggcagagagactgagcggcagccgtgggcatcttgggttttgcagctcagccctgggcctgctaatgccctgaggcgatgggaacacagctctgggagcacctgcaatctcatcttgtttctttccaagcaccagggaagaaaagcaatttgtttgctctcatactctaaagatgaacttcccgtgctcaatcaaacgttattatcccaatgtaagtcaatttacctttgaatttgaaggctattttcttcctaaatggctaattatgggagatagatggctgtaaacagaagtcttctacctcaacactccgccaggttttctccttatggcacctgagagaaccagagaaaggaggcctcacagtgtcctggccccctctgcccacttgccgcccctcctccattcttctcatgcatcctgcggtgccattcgcccaccccgcctacattcctggacgcctatttggagtttcatccccctgaattccatcccctgccgcgtccatttctaggagctccattccctcgtgccatctcccgtttttaaggactggactaaaggtggaggtcttggcctgagaaccgtgcatacgggacagcatgagttttaggagacaaggggtcctgtgtgtgtttgagatgaaacaaggtcacctgaggccgcctctttgatttgcctgacagagtcacagaagctgaccgctgcgaggcaggggctgcggccttttcccgtggcatgatcaacacctcgcaggaactaattgaatggccgagtttgtttactgagaggaggagtagccccctcctttctcgcaaaacaaagtctttccccaggagcggtggcaaagaggtcagccctggcagcgtttctgttttgccttttgatgaaagcctactctggctgctctgaagaagggagctcattgtgtgctcactgtcagaggtggctccagcagggaggccacagccctgggggctttttgggtcttggggttatggagcctgtggtgtgtggggttatctacagggactgagctttctagctcttctcccagaagtctggcctctggtcctctgccctttccacctgggccccagaagccatagtaatagcaacctgcctttgtccggtgcctcgtcgtcgtttatgcaagtctatatactttatctcacttgatcctcacaaccatcctgtgctgtcatcctcccctgacagatgagggagaggcccagagaggtcaagtgctctgcctgaggtcacacagctaggaagtgacataactgggacctgcctccctttggcttgaacgcctctgatctctcccgtctgtcacagtcccatcacagaaaggcaggcatgtggccccgtggttgaagccctgccccagctgtggatccgcatcacctgggccaggcttccaatttatgatacttactgagaccttggcaccacggccttgataaacccctctgccctgggcttgagcttgctgttctgtcgggggcagttcgcggggctgggaggacaggtaagaagggaggagcttttcatgagctgctctggaaaagtttaaggccatggtagggtcagctcaggaaagcacagcagggcaaggggcaggtaggcctgtccaactcagctaatagctacagaggtctcaagaagtaatgattggaggcctgactgaggcatagagaccaataggagacgctctctctcctagctcagaccaaggaaccctagaacatgctcctccaagttcacccaccgtcaccctgcaggggaggggtctgccacactccaaaaaagaatcaatccactgtgtgttctgtggactgttatttagagatgcccctacagattcctggagctgctgggccccatgccagggcaaggatcccaggactccctgtttagcatagtactttgattaaaacaataaattcccattgaataccgatgggcaggcaagtgggggctcatgccagcctcggtgccctcctggcatcatctcacagcaactcgtttggggagaaatacctccctccgctgtgatgagaaccctcattcccaatgaatgagggggcagaagctgcctgggagcctcaggaatgagggcatcatgggcaggacagggtaggactggggcagctgcagatggcaccaaggatatgggggccttgactaagcagggagggccacagaaggggagagggggcacacagaaacctcaatggctggcccctgtctggtcctcacctcctgaccctgtctctgcagacatgctgaactgggaggaacatgcttgggtcttggccccctgagcagctgtgctggagccacgcctcagtgcccagcgctgctgcatctgctctctggcagcacatggctgcatgtttctctgggccctgcctggtgcgcagcagccatatcctgggcaggtgtgctggggctgttgcctcacctggccctgggatgctggtagctccggattgaccagggtttctgatgggaagggatgtatgggagaagccagggagtggagagagaactcgtgttccccgatacaaggctttttacccatgtctccccaaatagccccccctcctcccactagccccgaggctggagatcaacatcatggtcccatctttaagaggaaccaggatctgttttgagatggccaatcagccaaagaatgccataattcacgttatccattcacttttcagttgacttccttccttccttcctgctttcctttcttccttttatccttcctccctcccttctatccattcagtaatatttactgataatccttcacatgaggcccgatgctaggctgtggaaatcaaagatgaataagcaatagcttctgtccttgtgctatctcctccgggtgtccagtattatgaccactgtatttctgaaccgaaaacgaggacgcagagctgacaggggtgagtgtacacgtgggaatgggcaggaagaccaccctgaaggtctgaggcattctgttcctaagctaggatgaaactgagtattccatacatactggctgcattgcatttttgtctagcattctttaataagaacagtaagagctgccatttgttgaacatgtaccatgtgccaggcttgtacaagataatgtgtataccatatctcatttagtcttcaccacagccctacagagaaattcactgtccagacagggaaactgaggaccaggccgttcgcagttagtgttagtacagtccttcttggccactctaaatcctctgctgcctctacagctggagggttctgatccgttggcttacaggtgtgtcctgtgggccacatgggggtgggtgggtgttcacagcacactgcctggagccatggtgcacacagcagggggtctgaggctgcgcagaatggcccacttctaaacaagcgtgtctgagctttgccaggtgtccatgtttggaacacaataaaagaggaggtcttcgaaaggaggtgactcagagaagcaacgctagactcaccccagagctgcaacctgctaacttcacagagcctcacagcagaattatttaaccccaagccccctctcctcatggggacaaaagagaaatcaggctgatgctatctccctcatagcacacttaggaggagcaaatgaaacggcatatgtaaaagtgcattgtaaattgcaaagtggcagatgagattattattactgcttccttcacctcaacaaagacccataatcacagacaatgcatcgagcctggtgagggtgtggcctttcttggccctgccctttctccttggctcctcccacgctcttggcttttctcctggattccctgctctcccatctgcagcaggttggggccccatggataactatatctagggaccgactcctgggatcttaccaagtcacatttgcagttggtgcctccttagtcactgccaggattccaggcaggtataatgtgctgcacttaatgtagaggatcagggtcccagtgagcagcttcatcttcaggcgtcgggagtgggagcaatggagcacccatggtctccaggtctcaggccacttgggtctgggatttgaggctcagggggaggagtcctgcggtgactgctgtgaagtggtgtgggggctcaggatgggacctacttcatgggacatgatggatgagactcaggatgccaggagggaggcacagcccacacttagcagcttggcgcacgcaaataggagctctgctcacagcctgtgctgggcacttcatttcccagagacaaccggcgcgttttaataatgtctacttgggttaatgaaagttgtcggtttcacttaataaatacattgccattcttggccacacatatccgtcatgctgggcctggagctgtgcgtcccgcctgagttgagtagggatgctgggagtgggaatggggtggggaaagcatggggcatatgggtagagagtgaggtctggagggcatgggacatggtccctcttgggagttaagcagagggagtcctctcattgcatctttcctctgggatcaaattagaggcacaaagggcagaagggaaccttggaggttcctcctgttcattctctgcctcagggaagtgacacacagaatggcccctttggcagggagcagtgagccatagtgtggtccagagggacgcaggccatcttgggaaggaatcccagttgaccactcattatctctgtaactaagtcaattattcaatctccctgagcctccatttcttcagtaaaatggagctaataatcatatttgcttcatagagcctgtttcgagcattccagcataagccatgggaagctcttagcaggcacccagcatctaaagcactcaaatcagagtcactagtattattaatgttaaaatattatttttatgaaggcacagtttagtatggtgtttatgagagtggatctggagtgtgggtttggatttcgggtgtatcacttactagctgtgtcactctggagaatttatgtagtctttctgtgtttcagtttccaagtctgtaaaatacggggaaataatacctaactcatggagctgtgaggagtgagcagattatgacatgtacatcctttggaacacagacccaataaatgttaagaattattaagttgtcgatttcacagggccatgggggagggaagtccgggctctctgggaactgccttccacatttccccaccttagggtggtctccagaccacatcccagatgaccttacacaccccaggggttgataccaggccgagaccctcgacattccagggagggaaccggaggactccagtcagtttccaagctgcataacttggttcaaggttggcagtgaggggagagacccaggggagggatcatgcttaacattcttgggacattctccttgaactctgcaggggccttaaaacatccctaagtgccatacctctacatgctggccttcttctgcactctttttttctttctttaaaagcttagactgattaaagatgggaagggatttggggggtcaagggaggactctggatgggaaaggggagaagctcagatgatgggaaggggcgggggtggccaggcagtgctttctagctgaagtaagcagctttggaacctgcctatcacatggccgggtattccagggtttttaaattgcatgccacatgtttatccttattaagcagttgttctcttccaaggggctctctctggcagccaagaaccaaccacagggcttgtcgtggggcttatgagtagctagggcctcccaggaggtcgtcagagtggatggaggggcaaagccaggaaaatacctgggggcttccactccctaaacccagggaaacgatggagtagctgagccgagattggctcacctccttgtacaggaagaaaaactgcggccagaggggcaaggcgaggaagtcgccataacacatttggtgtggttttgggcagacagaacgggtttcttatggctggggctgctttctaatgtgaatatgagtactcttggctgggagaggaagggctggaggagagatcaggaaggagagatccacatctggctccgagctgactctcggtgaccatgaccacctccttccactggagggagcagcctctccgcaggtggggctgtccctcaggagcaggaactgggctcccgctggagagaagcagcgctccacgttcaaagaccattattgccattattaattgatcgctgttattatcatgtaggcattaagtggcttcctctgccctttgagttgtaacacttagggcagctgctagcgaggacaaaacaaagcttccctactgcaagagctttatctgggtccctgctgctgtgtggccttctgcaattagccattttacagatggagaaacttagtcctaatgatttgctgaagggccgagttgcttagccctgcagggtacacagatgaatagggagcgttgctgagcacttgcaatcaagacagagttgccacccactgcaaggacgaacatcactactgggtcagctctgcagctgcaagtctggggaaaagggatccacccaggcactagggcaactgctcagccccatcgcagcaagggcccgaggaacgagcacgtcagctgtctccagggcctttctcatcatctcccgtgcctgccgtgctgtctcttaccaacccaggagggagggttggtggctgctgctccatcctcaccctttagaccaccccacaggtgggacagggtgggcccaggtggagtctgagctgggtgccaattccaggaatgcagctggaggtgggggcgggccatggtgggccaggacaggtgggagagaaaagcaggaggcagctgaagggggcggtctcagaagcccccgctgggagcctcctatccacctggcaggcgtttggaacaacgtgctgaataacagcagcatttgtgaaatctaattagtgcaggcccaacttctgacttcctgtgcgggggctcctcctctagccccaggctatcgagctgaattaagctgcctaagatcacctcattaaattcactaaccttgcttttccaccaggtttagcccctggtgcccttcctctgtctgtgggaggtgcgcgtctggcattcctccagtgcgttcccaggcaggtgttttgagaaactcccctcctcttccctcctctcccctccccaaatggctcccttaatcacgagctgctttcttctgagctcaataatcaccctggactaatccatacacaaaatcctgtggctgcagtaggagcccccttcccagccctccctggctaagggatggtggtcccagaggcactgaggactcctcctggaggcaggcagggggctgtccagaggcagagcattgggcctgctggcaaactgctaactggcacaggtgacttgcatttcctggggcctaactgctgggagtgcacttctggagtggagatgggcaatggggatgcctgatgagacctatgtccaggacaggaggggaggggatggagaagcagctctggagcccagcttgctgttagccctgagaaacaagtgacttcctgtgggtcagagtacagggtgggtagcagaaacaatcaggccagaggggtatttgttgcagaagagaaatgtgatgcaattagtatgctaggagaatggaaaactaacccggagacagggctaaagttactgcccactcaactctgcatggaattgtgctgaattgaggagcactgcagcgagacctgaccaccgcccagcccaggttgggtttgttttccccgctctgagaccggacctcaggaaaggggtgcggggaaggttgggttcagaaggagagactctccagccacacctgtgaagctccaggcagtttccctaatgtctctccttagcctcttgcagagagggctaatgtatgtcttccccccgggctggtggctgggttaattggaccttgtttatgtagcatctattatttatgatttcctttcgtctctcctgagtatgacaactgtggttaagcaaccagagttattcctgcctcgggacatgtatgaggacggtctcctttgcagcctacctgaagtgaatgtgaggccgagaggcttcgtgaaaggttaagtgggtgggggacctgctgggagagaggggcaggggaatgtgcctgagatcagacagccttgcactaagctcagctcctttctggggggacctccgatgcatgctcacttgtataaaatctaactggaactgggatcgtgttctgggggttccgaactttggctgcatattggaattatctgagatgtctgaaaaacctgacaaccagagattccagattaatcggtatgggggtgtggctacaaggtttcagagctccccagtattctaatatacagcaaaagttgagagccactcgcagctccagcacattcttactgtgtcagtttttttctgttgattatgaacaacagcagctaacattaatagaacctgatgatgcgataggcaccgagataagaattttatgtggatgacttcaacgaatcctcagaacaacccaatgttgttggaaggtgcaatgatcatcttccttttacagatgaagaaactgaggctcagggaggttaagtaaatgaggccgaagtcacacattgtttcagttaccaagttaggcctgacctgactccaaaatctgtgctgttaacttttttttttttgagacagaattttgccctttcacccagactggagtgcagcagcaagatctcggctcactgcaaccttcgcctcccaggttcaagcgattctcctgcctcagcctgccgagtggctgggattacaggcatgcaccaccacgcctggctaatttttgtatttttaatagagatgggggtttcggcatgttcgtcaggctggtcttgaactcctggtctcaaacaatctgtctgccttggcctcccaaattgctgggattacaggcatgagcctgcttgtctgaactgtaagaggattttaacagtttcccaagcaatgcttcatattcacaaatgaacacattaggctcaaggacagaagggacatacttaggatgatagactaacctggcccagcctgcaacctcatgggaatgtgggataatgagagagaatgtttgcattggaggtctgtgggcgtagagcactcaacaaatgccaggcactggggctataatcacatggggagaaggagccaaccgtgcatgtctgaagcaggtattctcttccctgcaggtgccaggactacagacagggcaacggagagcaggggcttgctggagaaatccatccttccctgggatctcttggagggctctccatctctcttagagcagtttctttcttagacagttgaagctgcctcagtggtctccccagatcatgcaggtcggggcagaagcttctcactcagagaactgagaatatcatttttcacagaagtctaaggtggaatttagaccaagatattcttggccttagcagtttgactcgggcgggggtttgaagctggaacttttcaacatacatctccaagcttcaggaggaagctagacacatctgaaagcctctgaacaacctgcgatgaagattcttgaaaaaagagaccatttgccttaggggctaagagtacaggtgcaagagacagaccgcccacattaaaatctgactccactcctgagctgtgtgactttggggaagttcctcaactgaagtcacaaagacctaatctgggaggtgggaatagtcatagaaaaaggatcgtggggaaatgaaacgagagaatacatgtaacgttcttggctcacagcgcccggtgaatgttagctgctattactgttgttcctaccaccgcaccctctcccattcctttccttctcaattctattgacatttttggtgtctaactccttttgagagatcatgacttttgtagaactaggctgctttcactctttgagggtggtctttctgattgatccatcagtctgcattctccttgccgtccttggtatgcacacacatgcatggaagctatattcctccttcatactggactttgaggacaacgttttcatgtttcacatttcccacttcatctcctttgttttccacttgcttagtttcctactcttccctttatcctgaggtgtcgtgagggcaatggcctgcagagtccaaaggtggctgtcatgtcatttgtccacgtttgcattcccgtgccctccccacagatggctgctctctgggctgcacgcacgttgggttcactgatcgcagagtctttttctggctgccaagaacatggtagcctcccagaggctgttggcatgtggatgctgcctctgtgatccacagccccgccaggctgatgcttcaggaatggatcacaccttggctggacccatcaggctggaacaccagattcttaatcaactgtaggtgctactgtcgctctaggacctgccgatgccctctgtccttctctggtgactttgtccacgtggatcttcagttccttcaacatgtgtgcttgttgccccttggagcccacctcctcaagcaagcctcccagcccagtcagcccctgtgcactctcatgttacctgtgcatctccttcacaactcacgtcactgatggacttacgcagttgggtgtgtatttggtaacctgtcttcctcctgctgaaatatcaactccaagagggcaaggagtgtgtctatttgttcactacagtattatatgaacacccctggcatataataagtgctccctcagaatttgagtattatatggacacccttggcatataataaatgctccctcagaatttgagtattatatggacacccttggcatataataaatgctccctcagaatttgagtattatatggacacccctggcatagaataaatgctccctcagtatttgaataaataaatgtggtgtcaatttggattaattttcttgatctcatacttgtgttctctatgcatcctatcacctggctctgctactaactgtctcatgaacttggaagctttaggggttagtcttttttaagtacattcgttaaaaaagagatgttgttcatataacataacattttcccctttaaaatagacagttcagtagttttaagtatatttacaacattttgcaaccatggccatgacctcattttggaacaatttcatcgcccccaaaataaaccccacacccatcactccccatttctgtccccgtcggtagccattaacccactttctgcctctgtggatttacctatactggacactcctacaacatgtggccttttgtgtccgtctcctttcacgtaacaaaatgctttcaaggttccatcccagttgccacatgcatcagtactttattcctttgtatgggtgagtaacattccatggcatagctataagcgcattttgtccattcatcatctgctagacatttgggctgtttccacttttcggctattgtgaatactgctgctatgaacatctgtgtaaagtttttgtgtgaacgtatgttttcagtactcttgggtatatacttagaagtgggatcactgggtcatatggtaactctatgtttaatttttgcagaaccgccaaactgctttctgaggagtttttatttgacttttttaaatgaaaggccaatttagtgtccacccccttacatttaaatttttatttgataaagaactcctttagaaacatattaaaaaccatggaatctccagataaatgcatatgtgtgaatatacatcatttcaggggtcccagaaccatcagaaactggctgtggatcccaaagttcgtgattacaggctcgcacgcagcagtgttttaaggttagatgattttctccaacacagaactccagctacagttttggctttttcacacggatattggagatggataatttggctaatgagttctaatccatgttctgatttgcatctgggatcagaacattcagcagccatttagttgccttaattttttccacccactctgcaatcatttgattgatgtgcaattacctccccctgcttggacacgtgctttcccctgctcatgtgtgtcatccaatgcctgataaccttcattttttcccatttattttgtgtgtgttggccactgtttgatataattatttttgtaatcatcttctattaggtgaaagaatattgcagtagagaaagaaggaaaaagaaaataaatgccttcctgacaagttctaatattttatgttcacaaatctcccaatatcagagcaataatattattttctcgatgtgcatttattaaaatgtaaagtagctccatcacattgggaacgaaaacccttgcattaccttggccagaaaatatcacttatttatttcagattgcatttctggaatgttaatactgttgcttttttttttttttttttttttatttttttccccatagcctttatctagcaggggagtgaacctgaaggtctgatttctaaacaggccttgctgaatgcacaggaccttaatttggttttaagaattgcttttggctcttgatttatgatgaggttcttttctgtgtaattcttttggctgaaaactgaatagagttctccctttgtgggtggcattttgacatcacattttaagacagggtacagatgtaagtggggagtagggaagatttataaaagagaagggggattaacatgtgcgctttaagggttggaaaagttcgatctattgtcgatttctctatggtatcaatggcataccccttagattccagttcctaagtcagaatgttaatttccaggtagcctagtaaaagagatactagattggaagtcagaagccaggagttctaatcctatttttccctctaagtaggtttgtgaccttggacaactcacttccattctttgcgctgttttctcaagtgcaaaaggaaaggttgaactaagatggatgggttttaatcttagctgcgtattagaatgccctggagagctttgaaaactacagtgatactcaggcccttagatcaattaaatcagactttctcatgagggtgcatggacctgggcattggtgtctctactaaacactgcccaggtggttctatcatcaagccagagatgaggacccctggtgcaggtgatctcagatgtccctccagatttctggttcctcagtgttatgagctgggcagtgatgtcagtccagccaaggctggtgagatgtatttgcagacaagtgggccgcaatcacaggattgtgattctgtgctggggttcgaggtgtctccgctgggagactctggggagatcctgaatggaattgaatttctcttagtatcaggtctgggttggggcaggtaaatcttcctttctttgtgggctcatggtgctgagaagatggatgagctggggccggtaaaatagctttgttccttggagaaagtcatgtagagagataaggtaggcttattatttttcgagtggaactgggactgtttagcctagaaaaggggggacttggggagaggcgtgatttgcggtcttcaagaggctgaaaggctgtcatgtggaagagggattggagtgatttgagatgctctggggggctgaactcaggtctgtgggtagagagtcagggaaagacattttggtgcattatgaggaagaattgtaatgtagagctgtgcttcatattccccgtgcatacctctgccttagcacctgcttttatgacagtcttctctacaatgagacgacatctttctcatctctgtattctcagcacctaatccagttcctggcacagtcctcaataaatgtttattgtcattcctgtgattattaattactgtcatgaatgcccactatgcagatcacttttcttgctttatcttgtttaactctcctaatgctttagaagtaagtatatttattaccccactctacagttaaggaaaccagagctttgggaggttaaggaatgggcaaaatcacagccagtaggtagcagaggctggatgtgaaattaggtctgtctgactcaaaaacctgtgttcctaaccatcctgcccaccaggatcctggaggtattcaagctgaagatagacaaccacttgggggacctagttgtgccatggcaataagtatggattgagttaggacagtcccagatgatgatggagccaggagctgagtagatttttagagtctgaggtcacccagttactgctctatcagccacctaccccacattcctccagtgaggtgttggcccggtccagaggcagagccttactacctttggctacataggctctgggatggcagtgctctctcagcagttatggtcttttccaggtaataagtattgcggcctcctctgccacttgcctgcattaagccttttggtcatatgtctggggagcagacttctttgtatgcccccggggacaggacaggatggagggaggagccctgggtgtgtgtgtgtggggtgcgtgggtggggagatgcatgactgctttggttatgaaacattgtgttagtgtgtccgttcacttcacatagacacagtgattgcattactacgcggccgagcatacgtggcagagggtggaagcagctgaggaaggagcaggtgctccaaggaaatctttcatcaaagtgatggcatagctaaaggcacagaaagaaatgcattactgagatggcgttgcccgttcatgggcggctgcaaggaaggctgaaatggtggcttgggagaatgaatgggagaggggctggaattggctggaaagacaggaaaaggaaagagggggagaaacaagttcgtgggaatggtgattcctttcaaatggggtgcacagcctgacaagctgtgcgttcttcttaaacacagcccaaatcaagtcttaacttgaaagaaaattaagtcagattcagtcatgaccctcctgttagcctggttgggcatagaggctttccagaaaactctctctggaggggttaggtggtggttgtagcagtggtaagcacaaaaaagggagccagcatttgagaatcaagtgcttaaaatacatcatcccatttgtttctgataatgaacacacagagtgggtgataggattttccttttacagatgagaagactgaggctcacagggcttttgttgttgttggtttagagataaagtcttgctctgtcacccaggttgaggtttcatggtatgatcatggctcactccagcattgaattcctgggctccagtgatcctcgagccttagcctcccaagtagctgagactacaggtgcacaccactgtgattggctatttttaattttttttgcagaggcagggtctcactattttgcccaggctggtcttgaactcctgggctcaagtgatcctcctgccttggcctcccaaagtgttgggattacaggtgtgagccacttggcctggcctcatagatgtttcaaagactaaattataagtgaaagccagagagtcttacttaaacatgacttaaaaattgtttattttaccacatcatgtgatcttccagttttccatcagagcaggcaggttggaggttgggggcttaggagtttgctttcacagcctcactaaataaattttggggaatggccacagattctagtgggcctgttagcctgacgaggctgaggttgcagacaggacccacagaatgggagaagctgagttacttgcaagttggaaaggtgatgtcatcatgaaacaaaatggatttggttggtgggcttgcccacgcagttagatggcaggtggtgaagaaacatggcctcttctctcttataactctgaggggcaggaggagagagctgggaatcactagattcactgcagagaagtttggggctgtatctaggtcatgggtaaactgataattggaaaagaaattcaaggttggacattcattttgatttttggttttcaaagtttatacttatctactttcaaaaataattttaagagacatactattttctcaggaaaagaaatatatgccctctaaatagttttcttccttgaatattgccagcaaatcagccatctcattgaatattgatggttgtagagcaaatcacgaatgctgacctagagctgccatttattgagttcctactagggatttgactctgttttaggtacattgcacatattagctttataaacattccccacaacccagcaagataggcatttttatccccatttttcagatgaggaaactgaggttcacagaggttaactgacttgctcaaagtcccactgtatataagtagcaaaactaagatttgaactcagatctgtctgacttcaaaatcaggtgctctttctactctgtgacatgaggctatgaacatgtgaatctcagaggtaaaaagcagagttggatatggtttggatctgtgtccccacccaagtcttatgttcagttgtgatcctcaatgttggaggtggggcctggtgggaggtgattggataatgtggttggtgttctcatgaatggcttagcaccatcccttcagtgttgttctcatgatagtgagtatgtgagatatcacgagatctggttgtttaaaattgtgtagcacctccccactcccctctcctcctgctctggccatgtgagacatctcgcttctcctacaacttctgccatgattgtaagtttcctgaggcctcagctaggctgaggcagatttatagttacgcattggccagggtggtgctaactcactcatgagaactcacccacatgatccaaaccatattagtgagccaaactctaccttttagctctgagattcatgtgcgcagaaaccgccatgtttcttgtacggcctatggaaccaggagccaattaaacttcttttctttataaattacccagtctcttttgtctttctttttttttgtttttagacagagtctcattctgtcatctgtcacccaggttggagtgcagtggcacaatcttggctcactgcaaactccgcctcctgggttcaagcgattctcctgcgtcagcctcctgagtagctggtattacaggcatgcaccaccatacctggctaatttttatgtctttagtagagacaaggttgcgccatgttggccaggctggtctcaaactcctgacctcaggtgatccacctgccttggcctcccaaagcgctgggattacaagcatgagccacctagtttcagatatttcattatagcaatgcgagaacaacctaatacactcacccttacctcttcaacacaaagagtcttcccagagcatccctgctaagggctgtgacttgaatcaccctcctctactaatgaaagactcgttaatgactccacgaggtgtcaggtccactgtttgatcctgcattggttcacccaaggaatatttaatacgtgtccactgtgtgtcaggtactattctagaacctggcaggccagacaagggcctggttctcatggatcttgacttctagttggagaagcaagcccttgaaaacaaagtaaataacaaagagtttcaggtgctgataaatgcattggagataatgagacagcggtctagagggtgtctggccatagggatccctttagatggaataatcagggaagattttgctaaagagatagcaactgagttgagatctgaatgacaaggatatgccttccaaagatctgggagaaaggggatttaaggcagaggaaacaggagatgccaaagctttgaggccagactgagtttggcacattaagtaagcccaatagcctggagagaacaatcaactagggggagaatgggaggagatgagcccagagaggaaggcggaagccagatggtgtagggcccacctgccatagcgagggctttggattttatcctaagtgtggtgggatgccatcggatgggtttgaatgggaaaatgacataatctgattcacattttaaaaaaagatcctatgtggagactggattgcaggaggcacttctaattgttggaaggactgttctctcttctactgatcaaagttggttcttcaagtaatgacccttatgaaactgtcctcacaacattaatgagaattacaaaccagactttaggcggatttgtagttaggcattggccagggtgcactggtgcactttgacccacttcctagcagctgctgactgaccaagagtcacacagcatgctgaccacctgctttcccattgttcctaaagatagaatctctgacactggacctttttactcaagaattacttaagttatttttcggatcctgaaatccagtggaatggctcatacccaccagtcttaagacccccaatcaaggaactgacccagcacaggcatgcggtttcttcatctccctgtcccatgacttcattcctcacttcttgaccaattagtgatcccctattcccttacaaaatcaaactccttaaaaatcccatcctaagtttctcggggaggcagatttaaggtttcctctcatttggctgccgtgtgattattaaactctctctctgctgcaacttccactgttttgctgtttgcccacacagtgggcaatcgaatctggtggtcttataacacttgaccaaaaaccaaacaacaaaaacaaggctactttcttccttcttaaaatttttccaatcagctattatagttccctttagttctttctaaacttcccttgttctttgaattgatccttggattctagacccaaggtggattctagacccattatcttgatcattctttatcagcaaatctcttgcttgtccatgtccttattaacatgtggcatccagtaccaaacactctttcaccagcccaggattctgaggggctgtgaattccaaggacatccattaatgaaaagtattagactaagtctttgttgagtagtaattcttaatgtgaggctctaggtccatgaaagggcccacatacaccacacaccattgtctatggggtgcctgtgcatgtgtgttgtgtatgcatttctaggaggagagtccatagctctcattaaagtctcaagcagagcctcctccttgagaaccactgccctaggaagttaaatcaaaggatttctctactaagcagatgttacaattagttccttcctggtcccacattcattcccttgctgccttcttcaatgcttttataggtctcttgatctcttcttcctgcctcataccccactttaaattccttctttagcttctaataaatcatccaaacccagagaagataacttctgctttcttcttggagcagcaactagtgaggaaggccgtaccccacttgctggatgagaacatactgacaaataggcctaagaccagaggctttttgttttttcttctcttctctggactcataggtctttggaactgacctgtgtgcctgacttgcagacttcttaagagcagggcacagagagactggaaagggcttgagtgtaagcgaatgcaaagggcaaagtcatcttaaaagaattattattcatttcccattgcagttaattttggcaccttcatcagggtttaaattctagtaccatatcatatcaaaggaaaaaagtatttgatgtacgtgttaattactgctaagatgtagctacttaaatcaagagtttaatcttcatttgactattcagaacagctctgagtgggggatggggagaaccccttttgatttgggttactttaataggtgatgagaacttcaagcaaaatggctttctaatttcagtatttggatgtcttgcaattagtacccagctaaaggaaaaataggaaaatcaggttcctccaggaattcccaagtttttgcttgttctgtgaagtggaagaatgttctgaataatttaatttcatgtgctcaaaggcttgagaatctgcagagtgatagcctaatggtaagtgatatcttaaaagcgtgtgagaggcttaaaaagtagatccatgtataaaataataaactattatttaaaagcacaaattgtcaaaatgatactactcttagatacactctttataagaaccatcttggttgaatcctaatgtgcattttttttaataccacgaaactataaaacccattgaaacaccacattatttaccaagtgattaaatcatagtcatctattatagttttactagaacattgttttcttggaattccaaggctttattgcctcagatataacactttactcctaataatccctattgattttattatattaccttatatttttagatttgttttaatgccttgcattacattttagccttaatgtgctatataaaatgagatacatcatcatgtttctcaaaccttctgaaggtaattatcttaactaacatggataaaaaaatgctcattgttggctgctgacagtggtgggagtctgggggtggggaaggtacattgtagtctctgggactgttggttgtatttctggacagttgaggtgctgcccatgggctgggtgaatggtggtgggtgtggtaatggggcattgccacagattaggtatctcatttgtgtcattattttgctatccttgcctctcttgggatttgtggctcacactgcatttacaaggtgttttacatacagtaattgttcacttgctaaatcagccagtagagaacttggtattcttagagaaagttgttgcacctttgggtgctgttttaattactttttcaaggtgccttctaaatgttaaaaatggtgacacattttatctcaagttgaactttgcatccccattctctggatttggggtcattctcttgccttggagtctggagggaggagaggagtcggttctggcttgtgagccatggtgctactggtccctctggaggaagggtagctactgatgagccttccctgcagcaattgtgtcccaagatctgacacactcttatcagggccccagcaaataactcagcaccttcattacaaaagttagccaggtatggtggcatgtgcctgtaatcccagctactcaggaggctgaggcagaagaatcacttgaaccctggaggcggaggttgcagtgagctgagatcacgccagtgcactccagcctgggcgacaagagcgaaactctgtctcaaaaaacaaaaaaacaaataaaaactccacaaaacttcagtggagactagattcttgactactaggaactcaaactctaaaaggagaaaataatcacaccagctacactttttacagtgctaactatactttttgtagagttaactacatgcacaattttatttgctttatctatattaattcttttcatccttatgaaaagcagatactatcattagctacatttcataatgaggaaatggaagtacctagaggttaagtattttgcccaaggtcacacagctagagagtggtagaccgagaattcaaacccaggcaatctgatgctcagaacctagactcttaattacactaatatgatatttacaatttacaaagcgttatccactagttatctcactgattttcccaagagactttggctccactttagacataagaaaacagaaataggtcatcatttgtctaaggtgacagagcccaaacccactaacaggacagttttcttcaccttcaactcatctcaatgggtggaaaaacctacccacatgctatgaggatgggaaaccaaagtgtctttgcacataaacagactgcctccctggaaaccaggcctgtccttggtggtgtatgagcaggcccctgggatcgacacatggatgaagggagccctctgaattctcccacatctctgggcacccctctaatgtgctcttctcagcttgttgctccttcactgtaagtccaagttctttgaaggaaggaactatgttggtattctgtgatgtacgcggctctgtgtgctggtgagattttgtagccactggaatgatcagaaaaacgtctgtgtgaatcttgcatgatggaagaggaaaccaggtaagagtgagcaagcaggatggtaaaagggataacagctgatgggccagcaaggatgcggggaggatacctgtggtcaggaccaggttgtgtgcagggcagctctgattgctttcttagcagaaagcacaagaccaggcaaagcaggcgaggagaaagccattgaataaatactaagctagaaaacaaagatatacatagaaattctaggttctcaagaaaataaacaaaccaacttacagaaaacccctttccctgtgttgaggccctctgttgaacctggcaataaacgttatgcctctccccaaccccagtccagaaggggctggcaggtacctctttttattcattgagaaagtaacggtgagcagttttgtgaattctgtgaattacccttgaactggtcagaaagatccaacagctcagacaaggagaagggaagagctaatctcctcttcacctgtgatgactgtttttccacctgtggcttgggaaggaccatccttgctggtgatggatgttgatttagtgctttgagatccctggaagacaggtcaggcaactaacaaggaaaatggcattttgggtcaagtcactaggaatgaagaactagaatacagggagccagggggtggcggtgtggcggggaggaggccagaatgaaagataggaggatcagagaatggtgataagtttgtacaggtgggatcatcagttattctccccaaacagatcattcttgtcttctcctctgatttccactaggaaaaaacaaaacaaaacaaaacaaaacctgaggtatttcttagaacacgaagcatgaatcacttacaccagagatgagaaaagcaccatcaggtgcttaaaacacaattataattggaaagaccaagaatttgtggttcatttctagcaggtgaacaaatgtatgtttataatggtgtaaaaaccctggtttccccttcccattcccggtgccttcccagtgtgcttggaacactctactgtgttattcacctgacggattaagctcagcagaggcaagctgcctaggcatgtcgtgtaattcagcattaagtatcctattgattcactgaagtgctgccatggatgttaatggagacaaatattgtggctgtgatttttcaaagggctgagtaattcccgagcatcaataacgtgtgtcatgatgtaatgcagggagacctccagatgcttgacttgaggccaactacggagggcagagctgatggaagggcccgttggatactgacccagggcttggggagatagcctgcactttctccagacctaccatcagtaaggatggtggaaattggggtggggcagggactgctgatggcgtttcctagtcactcatcacaaggtcactgattgttggatggcatgggcacgcttcccattatggaagcttgctgggccttaggagcttataccataccctgtttcagggaacagggtgggttttctcccctctccagttggaaacactacatatccctgatgataatgcagcaaaactactatctaatcttaacagcgtctaccctgtgccctacttgatctgagcatgtgaccacttcagtgcacgattccagtgactgctttcagagaggttacatgccttcctcaaggtcactcagcttcctcaaggtcatggactaggctacaatccaggtctcaggactgcttcccctggtctattctcagttacctttaggtagggtctctggaaatcatttgagtatatggcctgaaacaagcgacattttcttccaaaaaggctctgtaaaaatctcagggttggtcgttgtaaggaataaattattcccaaacaaatctcatttcagtcaaattctgcagactgcccaatctttcctacactccaattcattctccatactgctgcttacattatcttgaaacaagacaaatccaatcttgtcactccctagcatgaagacttccatcagcccctctctgctgacaggataaactccttgcatgatattcacaatctctcccccaagcctgcagtgtgatgtcctgcccctcctgtccccagcacttggaacatagcagaccactttatgctctttgccccctgaatattttatacaagtgattcctggtgtctagaacatctttcccccacctgctgcccagaaaacctcagcccattcttcaagagccagttctactatcccatcccaggaaaccatccccacgtctccagggtagagttatgagtggtcctttctctgagaccccacagaacactgcttatccctttattacccctgtataatgacagccttcctattgaacttactgatttattttcttgtgtatcttcctgcattggaatttggatttctgcggttgggggctgtgtctttgtcatttttgtcctcttgttggcatgcagtaagtgtactacataagtttattcactgaatggatgaatggattctggaatcagaaccctgctggggtagggactatcagtagggtatagggcaaataaattggccctgtgagatacatgtttctatagtcctgggtctaggagggacccttgggggcttgagaactggaggcagaaaaactgtccttcaactcagcagcatgctggggtcttggagagagtctctggggctgggtgtgccctttaactaccatgtcccttgaaaatggtagccctgagaacatatgcaaacatgtattcccttgggaaacagagtctgacattctaatgaagaaccagcacacttgactttgatcaacaccagccttataagcagcatggatattgaaacattcagtaaccagcatggcatgtgcatgggtcagtcagaatgcacacaggccacagggctgaagcagaggtctggagggctccattgtgccaaccattaactctttagtagctggacagtagggggtatcttggaggagggtctgagaatagcaggagaaacatgagtaagggggcttgcagcggtgactactgaccagccagtataaaaatatttcattattttaacaaccggccctggtactgctccaccggtgcctatcagcccgttgataagtcttgttaaagaataaccacagttttggctgggcgcggtggctcacgcctgtaatcccagcactttggaaggccgaggcgggcagatcgcctgaggtcaggaatttgagaccagccttggccaacatggcgaaaccccatgtttcaccccatgtttctactaaaaattcaaaaattagccaggcgtggtggcgcatgcctgtaatcccagctactcaggaggctgaggcaggagaatcgcttgaacccagtggggcggaggttgcagtttgcaccattgcactccagcctgggccacaagagtgaaacactgtctcaagaaaaaaaaaaaacaaaaaaaaaagaataaccacagttttgaagcctcaaaggaaggtgtgtgtgcatgcatgtgtgtgtatgtgtgtgtgaaggaatgaggcagagctctataaaggcagtactagagtggaatctttcatttttagttgtatttcaatataagcataaggaggtggaggtgagagaatttcagactgaggaactgaaagagccagggcacagagtgtgaaagggacctatttgggagaggtggctgtaggatgctgaggattcctgggggagatgaggaaggagacagaggctggagcaggtggccaagggccttgaaaaccatgttgaagcatggtgacctggtctgtgttcctataggccgccctttaggcaaaccttattgcttaggctggcttttgggtggtccttgctgggacaaccagtggcgtcatcttcaccaagtctagggtggtcacctggtgatgggaacaagcttctccttaattaagaatgtcatagcagcctccctggctccatggtgactgacgctgccagtccagctgccatgtggccgatgtgtcctaccgtggtacatcatctcctaattaacatgtcttgtcaggtccagcggttggctttagtaaatatgcctcaagcagctgtcactgggaccctgcgtggggcctgctgcctcattagctccagagaagggagatggcattggcggcaggagggagggagaagaatgttctttatggggggtgttggcaggattagagggatgtcagatgctcagagagaactcacaggccccagtggagggcttggatctgagcaccatgagcctctctctctcccatgtgtagtgagaggataggtgggtagcagtgtgggcaggaaaacagcccaggagttgggagacccacatcttcattctgtctctcccaccaccgagcaaggctcggtctcctggtttgagaaacaggaatgatcccagctctacctatcctgaagtttgttgagtggttctaatgagcaaatgacctatactattctgaaggacaagaaatgctaaattttacagaaatcaagccagggcatggttgtaatttggggctatcagagagaagtctttgctcagacaagactggtccctctgaacacacttcgcccacccctccaaggcttctggcctgcatcccactgcactgtctgagcactcatcaagacctgctcaccacccaccaatcctgtcagactctttctctccagcctggcctcgccttctctgtgagaaggaaaatgagaacattccggaaggaagcactcttctttctctggctgctggagtaccttccaggctgtggaggcagggagctgacttcacagtgactgaggagacataccttagcccacccccactggattttgagcacatgcctaaactttgtacccatgagagcacatagtaggtggttaatgaatgtttgctgagcaggaagaacagtatatcccgttctcctagctctcaaaacaatggtgggtgatttcatagtttctttcagcaacttgttctattgccaacctttctataagccttcttctgagatccagcccagtctccttgggcagtgtgtatctgtttcctctttgtccccagcagagaatagaaactgactgtcattctctctgcctctcctgaaagactaatactaagcactcttatctcaccccttcccatctttcctattcatcagatttcctggagcccagcctgctacctggagccagggcctcgcctctactgccccctccgctcgctctgcctgtgcagggtccatcctgaggagagtctgagcaactgaggatgttgtgaaagcatctgacagcacagggaggcagggcttccccagcccagcagaggcaccaaacccacgcaatttgtaaatctttgataatgagcatttaaagggcacgtcctaatgaagggagccaggaatgactggccatggaatgcaggcagaagattttaattaaaatgcttgtctttttagttttcctcttcccttgtctcttccaaacaccacctccccccaacccctgccaatgatgcacatgtcttgcttctggaccaggcctgtgcaaaaaatgtgcgtctcatatttcccttgatttagttgctctctgggggactgggtgctcttcttcagctgggcgcgctgtgtgggtttgacagggactgtgcacatgtgggtagaggcggaccaggactgtgctgcctgcagccaagcagatgtcctcaccccaggaagcacagtggggctctaagagagctcatgaatgagtggcagctgccagccttgtgagcttcctgtagtgaagctctggggggagctctggggggccagctgggagacttctgggccaaaggggtgttttatggggcctctcacgatacttttctctccaaatggctaaatggagtgtggcggcagagcagctgtgagggactttgcactgctctctctaggggtggagggaccgttggctggatgccttccacgtgctcctccagatccatgtccaccctgccctgtgccctgggaatctgagctgtgtggattccagcagcagacttccttgctataggcttcagattgggtctgcccaatgaggaggccttggcaggacatgggcggaaataggaaaatgaggttggactatattttctggcgctttctttgtgagatcatctcagggctggttgtgtcttttgattgaagtccacagtgcctggtaaaggtggcttctctaaaagatgctctccttcctggttctatgagccactctgtcccttcactgctgccactctttctaaccccaagatactatactcttccttgtattactcctggagcaaaaccttgtaaacagtccctttattaaactctccagattccccaatttctgtgtattgtctgttttctgccaggatcctgatagattcacctgttcttttccagactggttccttcgcaccagacacatggtcagaggggattattcatgttattcctgggatcctagctctgatgtggaatgcaatgtagtctggtgggtgataaacgtccctacttccacatagacggactgggtttggaaaagtgcttgtgaatttgtttcccaggaactgatgatagtctttggacttctccaaaggtctgtgtcgaatggaatataagccccctctctgtgtgggatgaggtgggagtggggatttattcctccccaacatgttttcatctgggctatgatgccattctcattttatagacaaggccactgtggttgagtgacttacccagaatctaagaggcacgttctcttcaactaatatttagcaaagaattaaagcaggttttctaccaattgatggaaatctttcctccttttgttccttgccccttttgctatttgttcactatgaagacctggcttcaaggatcttgtggggaagtgagtagggctttggtcttggactgggaaaaactccactcagatacactctctgtcagtcaagctctcaggcttttccttatccagcaatgacttacctcttacctctgcctggagctggcctctgagtagggtttctgatcttggcttagcagactgattgcctcctgcttgtgcctcagggccctaagcttttagaagcatgcctcactcccagcctaagagcttgtctttgactcctgattggccctttttcctgatgtgtgggttggtgttctcgaccccacagggcgctgaactccagttagaactgccacccatggcaactccacagggtgagcccgccctttggacctgacactatgtgcctgatcactctttcacagacgtctcccttccttcccactccacccgagtcaaggctcctgaccaactaggagacagaggccctttctccttgacacgtcctgcctaaagtgtcagcttccatccctgcctggtgttccccacaccaaaatatgaaaccaatctttcttctcatacacagtgacacagtagctacttcgtgttccctcttcattcagttgtctgtgcaatcagtctgtatgtatgtattcattcattcattcattcattcattcattcattcattctgctatgtattcagcaacctctaggtgccacagcttgcaaatatcatctgaattcattctcacagatctctagcagatctctagtgttcactgttactgccattttacacatgaggaaaccgggtcaaagagtaactaagcggcttgatgagggccacacagctggcaaatgtcggagccagagtttgaagcagaacgtatggcattcgcactggaattctcaaaccccagcacaaggcacctattcacagacagtttgaagttgttcatatgcagaatcggaagattctgagcagattccatccctcctccccataagccacacttccattagctctgctcaggacaggtgggcccctgtgtgttggaaattgagatggagagaggtgaggagagaacaccctgagggagaagtgtgtgggggtggtgcaggcaagaccaattcaccctgaggtgatttgcatctttagcaggagtacatgtcatgctgtcacagccttttcctgtattgacataataacaatcctttacttttgttagcactttgtagctttcaaagcagtttcaaatccattagctcattttattcctacaacaatctcacaaaaggcagaaattattatccttattttgcagatgaacaagctctgtgaggctatataacttctccagagtcaggaagcctggatgcaggcctagatacctgactcctggtcttatggattatgtaccttgcctcacttttctcattgttactttctgattttgagccatttagggggaaaggatggcttcctagactctcagaaacccctcactcttgggttccaggccacctagactacataaagcagtggttctcaaattttatttgacaccgggatcacttggaaggccatcacatagattactgggccccactaccagagctactgattcaggaggtctgggaggggcccaagaatctgaatttccaataagttcccaggtcaggttgatgctgctggtgtggtctcacactttgaggaccacagatataaggcaatgcctatgagtctttagctgaatttctctaatcagggctcttcttctgggctgcagaaacctcagatacagaaagaattgcccttgtgggtctctccctggggtgagaaatttgtgtatgtcttgcttcactgactgtggtgtgacccagagaatgggaagaaaacctcaggctttttggtttatacacacacacgaaaggaaaatgtccacacatgagattattaattcattgttcaattaagttatgatctctaaaattatcacaatatttggctcggaggaaggcagcactgaatagcttgttacacgtaatgtgtgaataatgtaactttattacttttcccactcgtaagtaattgtgactgacacattggcaataacacagattgccttcttaccttcccctctctctactctcagcacggagcgtttactttcttgtctctattattttcttgctcatcctccttccctgccacaagcctcctccactgcatattagccactgctgtaacaagtatactaatgtctcctcatcaatttttatctcccaatgcccaggcacttggagtctaaacttaaaaaaaaaaaaaaaaaagaccaggcgcggtagctcatgcctgtaatcccagcactttggcaggccgaggtgggcagatcacttgaggtcaggattttgagaccagcctggccaatatggtgaaaccccttctttactaaaaatacaaaaattagcctggtgtggtggtgcacgcctgtagtcccagctattcgggaggctgaggcaggagaatcacttgaacctgggaggcagaggttgctctatcaccactgcacttcagcctgggcaatagagtgagaccctgtctaaaaaaaataaataaacttaaaaaatcattctctattaaaatccagtctaagcactgccatgatttgggtatggtatgtttggccatgccgagtcccaagtctcgtgttaaaatctgatttcccaacacacaccggggcctgttgtggggtgggggtgaggggagggaatgtagaggatgggtcaataagtgcagcaaaccaccatggcacacgtatccctatggaacaaacctgcaagtctgcacacctatctcatttttagaagaaataaagagaaacaaacaaacaaaaaaattgattcctagtgttagaggtgggggctggtgggaggtgtttgggttgtgggggtggatctgtcatgaatggcttggtgtcattctcatgctcctgggagtgagtgagttctcattcttcgttcccacaagaattggttgttgaaaagagcctggcacctccccctcgccttgcttcctctcttgctctgtgatctgcacatcccagctccatttccccttctgccatgagcggaagattcctgaagccctcaccaaaagaaaatgctggcacaatgcttcttgcacaccctacataaccatgagccaattagatctcttttctttacaaattacccagcctccagtattcctttacagcaatgaaaagggtctaagaaaaacactgtcttgtcttccttttccatcatccatcagtgtatgtttttgtaccagcaagtatgtttatttaggcagaaccacaggtactggcaacgtatctacagtgtagacatgaaaagaacaggaagagcataagtaacagagattttgttcacatggtttagtcatgttcccactgcaatgtccctcttcatacagtatttcttacctccttccacctcttcagaaagtacagcgtagtccacatgaatgagacctgagtgcactggggcatccttccctcctgctctgggggtcaggtgtggtaatctggcttagcttcctccaaagctccagttggaagggaacacgttctctttttctggggtgatccagtgtcgaaggccaatttacatgcagactgggtgtgttgtctgtattgctctgttcaccggtaccgaaggctctgagtaaggtggaatcagaccctactctactttccctgaacagtgagagcagcaagagctaacagctgagcatctactttgtgccggaccctatgacatgcactttccatgcattcatgcagtcttcacaataattgaatgtggaaggtgccattgttccctgtattgtaccgctggccagtgagagccaggagcctgtgctcatcacaataccatagttttcagccccccaggctaacatctaccctctctcgtggtgcctgggacccttctggacctgatcaaggtgtagcagctaatggactcggaacaagtctctgtagatttgagtggaggcgccacttgggctggagaggcttgcggggagctttgcaggggaaatgaagcttgactcttgggtcctcagggtttaaggtttgccttttttctcaaaaaagacttaaagggaaccaggtcccttgtacctgctgtgtgcacctggcaaagagtgcatcgggtggaatgcagtcctctctcaccaagctcttgcactccattgccccctagcctagaatacttgctccctgctcagtaaagaatcaaattcctgcaaatatccatcctcggtcctaggctacaggtctgcgccctctcggaggcccttgctggtgctctttccactaagcctcactgcctctcctgtcttcaaggggactgattgcactagggaagtgtggagggagggtatatgcacccagggaagaaagcagcacagcacttctcacagctctggtctacagttgctccactcagcaagtggggacagttccagcttctgggctcttcttgcccctaaacttctcctcgatcaggagtaatatagtctgagaatgagcacaaagaacactttttcttttaaggattgaccttttgctcaatgagcaggattgaaccttgaacccaacaaaagggtctgcagtgaggcagggctggacagctccacctctaggcaggcacagcaagtgtgggcattgcttactgcagagaggcttcccttctaaatccactcatggggggtgccaggtgcttccctccaaggcagaaggtaacccctcccagtccagagcaaatcacggtctccatgtttttcctccctggtcccacataggtgagtgatatatacagaggttagacctcagggttatgttatggattggagggagcagagaagcttcctcattaaaagggctgggctggttggctggctccaaggccctcagcacctctgggcttctgagccatgggagagttggacagaaggctgaacagtggctgatggcctggaggaggagatagggagggaggagaaggctggatgctgggttcccattgtacacccccagcaacgagcccccctgccagcccagagtaaccagagatcttgggccacaagtcagacacacctagactaagatgtggctttgaccccagctggatatctgctcacgtcatcaaagctcttgaggcctcagcttccttatctgtaaaatgtggctgggaatacctgttctactgatctgaagaattgttgtggtaatctgaagaggcgattggtataaaaataccaggtaaaaggcagagtgtgtcccatgaatgagacaccctgtccttctccctcaagacatcctctttgtttctcattcccaatatgaaaataacaaaccattctagggaacaacttggttatttttgggtcatgggcagggccagcaggcctacaggtagcgggagggatcagtggaggaagcgacgtgattcctgtaagacttgaatgcccctgagtcaaagtctgctctgaagaccagcccccttagagtgacagagatggggctacctcacaactctgccacttactatttttaggaccttggggaagtcatatagaattttgaattttagttccttcatttgtaaaaatgggaagggtaatagcactatccttagcattataaaataatggatacttatggcatacccagggcatggcatgtgctaagcattcaataaatgtggactattattgttatttcctttttgagctagttgtgtttgcttgctacggaggaaatacccatttcaaagaattgggaggataaaattaagagactggtaacccagcatctgccgtttaacagatgccctgtaagtgagtgccttcctctttctcccttctggcacttgttctgttgagagtctgtgatgcccaaaccttggaattaaccctgatagaaaaaaggcataaagccactggatatgtggcagctctgccttcgtgttgggctcacattacagacatttgagtgtctgcccctcatcctgccccccagatctcactgctctctgagtcttaccttagtctcctgtcttttcttctgccctcctggacccagcttactgcctgctctgctgccagcaccctttcttgtgtcttggtatctgcctgagacctttgttttgctggttacggttgtggcctgatgggctaagctaggccctttgtaccacctcagaacagcaggggatgcagcaataatgccaactaggagtccggatgatctggacttgaatttgtatcccggtttaaccacttactctatagccttaggcaaggcacttaatgccattgcatgccattgtcacatcaatacaatgaaagtaacacctatatcatggcattactggaagataaaaagagatgactgagggataaaaaggcgatgtgaaagtccctaggagggtaggcacttagtaatactaggctacctcccttcctcctcacttctctagtctcaatgcctgcttaggggaggggtagagatcagggtggtgagttgtctcctctgcaggatgactcagcccctccctactcccctactctgttactgcctttgcctcatcatactctggaaaacctagactaaagtaagttttttagctggacctatttttggaggtggagaatggaacttcctcactggtatgctgagttttgatttccatatgggctgatttcagagtaactgggaaaattcagtaattagcagtagcagcattagtgaatcatgttgtaatcatcctcttctcgcttcttccctcttctgcatgttccaaatgctattaccgacactatctttccctccactggcccttggcctcatgttcccactgcagacgttgtgcttcctgcttagcactatgggtcagcctctgggtactttcctccctcccagcctccagcctcctgctcaagcctctgcctatttgtccagaaccctggtgggcacatttagctagtttctcctcttgcaaattcaacctacaggtttatttcaattcaaagaaaaaaatgactcatctaaatcctgataaaaacatggctagtgctgtctgggctgatgaaatctacttggagaatggagaacctaagagaaccttctctgtctaagtctggatatctctgcggatggtcacttaaaaaaagataaaaatgcagaggagggttttccttagcaaaaactaataatcagtggctccatccatttatccatctatccatctaggaaacatttacacaatgtctacaatgtgccaagcctagcactgggctttaaggacatacacatgatagctgagaagactagcaagtaaaccgatgaccattgtacagtggaaaacatgccaagagcacagtgggagcatgagtcagtgagcagcaggggcagctcctctgagagggaaatgcttaaatattgaggaatggagagaatttagctttgcagagtttgctttcattggtatgcgtgtggaactaaggctcaacaaatggaaacctgtaaaatctatacttactcaaatttttgtagagcattgtaatgtgctgggaatgggaagctcagaagaggaataataatgggctttgctttggggtttagcactgacttctcagaatttgagaatttggaacatttaagtaatcccatttcctcttgacagaattttcctaaaacatgccagagagataggaatagaaacaccttgcttgttcttaaagaatctaaatctccacaatgttccctgttcattccatcatctcctgttgttggaaaaacgtacttgtctgtcctctggctgcaactaaagtcagtcctctccttagggcacccaggaactcttgatgtttcaccagtcctcttgctgagctaaacccaagagttgttctgtgttctatactgagtctggcctagtgtcacagaatctgcattagacatagaaatcattactgcataaatgtggagcaatattaacaaaaagctgaagcattcagatgaagaggcagctgttttgccttaggcgggctggggtgggtagccccatagtccgtggataattctccctccgtatctttccctcacttatcctatatgttcacgtcactgcagttatttggtgggcagttgtagtcttagatgagctttagtgaatgggagcccagcttgagggcttgaaattcatttagtgtaggaaccttggtgagaaggttgctgctgtggaggaatcgctatgtgaaaggactttagtcttcaaaagccggctaatgacccaggcatcaccccgtctccccatggccccagtgacagcaggcacaatgtctggatattgagtaattacctatttccttttctagatgatgtaagctctgttttgcttaccactgcatccccgggggctggacagtacactttaatgatttttttttaattgaatgaattaagattcacaagtaatttgaaaggcatctctatttatctcgctggtgtttctcagtcctgggctgcattgccaaagtttccagtttcttcatgacttggccagccccccaatcatcccaaagcccagttaagagaaacacttcggtgctaatagatctggaaacttaagctctggagggccacctgtcagatgagatttgccttcaaaggccactggctctgaccttttgataacattttaaaaaaagaaaccttacatattgactgaatcaggcctgtctccaatgaagatctaggcagctatttgtatttctgtttggatttttgggtccttttctttttgtacctctgggtaagcaaaaggaaaaacgttcctttgctttaccaaacctcatttaaaagttgtttgtatatattttttaatggaacccaatcccttaagcctttaaaagtaacctctactgagctcaataaaccatttccaatgtggcagcttctaatccaggagagttaagaaggcagatgctaaccaaccaccaattgcatcccaggacagttgctgaaagtctcagggctctgcaagctggagatgagatcggctaatcctgactctattctttcgtctgctctgctagctggccctacttgtacaattaatattctccctggtgttgattttgttcaaatatattgggcccatcaatcacccactttccaactcatctgtctggatcagtcatttacaaagttatttttgagccactaggattcttgtgaaatagacacaagaaggagctaaactcatttcaggtttgacctctgtggctgggatctgagaaggcttagtttgattacgcttcatggccatccaatccaatctggcttgtagaatagaaaggccacttgcttaattgggaacactttaatatagatatccattaacttatgctaaattacagtaaagcatctatggaggaacttgatgtgacatctgcatgaatactaaataacttcattacgatcagtactgtgacaatgaatatgaaatgaacgtgcccagagaagacaattaatctcccaccttcccaagccagtactgttttattttaccctgcattgtactaaaaaaataaggcatagaagctctatgattttctgtctatctcactcacccttcagctggtgagtggtccccgagagcttctgtcatttgtagagtggaaactgacccaccctgaggaatagccatgggcagtgggtatgtggggctcctggggacccactttggtttgggaaaggaggttgtcaagactaactgaacacaacacacacacagacgcgcgtgtgcgcgcgcacacacacgcacacgcgcacacacagaattaaaaggcatcctcatccggaactagcaaacagactgtcagttcagattagcaacatcaaaagcattccaatctgttccctgcatacattacatgcatagatctgagagaagaatttggcctctgaattaagtcagctttttccttctgggctgcttgtacctgaaatgtgtggcgaagagggtccagcagtcagattaatacacctcatagcatttagtctgaaccttacagcatggtcttaaagagacaccctctcatattacttgctgctgtttcacatgggttctttctgaatctggaatgaaccatgggacccttgggttgaagactatgcctaactctgtatgaggggtcgctcagaatggaggcatgcatgaaagaatattcctgggttctccattctagtcatttccctcctacgtcactgacttattgctggcatctcctccccttgaccttcatattggagtccttggatctcttctcaatcttatggctttaaacaccgactctactctgatgtctctcaattttgtatccacagcctagaccaccccctaaactctggactcatctatccaattgcctagttctcccctccacttgcaatgtgtaacaggcatctcaaatttcacatgctccgaaaagaactcctggtcttctcccacaggcctgcccctctcacggtcttcttcatctttgaagaagatgataaacttgtcagtggcaattttatccttccagttactcagaccaggaaacttgaagtgagtgatcctagactcttctcttcctttcacacccacatccaatctgtcaatgtagcctgttgtctcaaaatatattataaaccaaccacctctcaccacttcctctgctactttcttggcccgagcctcatcacttgttgctcagatggttgttacagtcatggttctgggtttagcagggtctctactccaggccttgtctctgaagagcctcttggtggtcacaaagctacttgccactctcatcagatcagggtgcagggtgtcatgagttttacagattctggctacaaatacctgaggtaaaaggatacctttgacattagcaacaacaggaagggagaaaattgctattaccacctagactgtgagcaaataacattctggccagtgggatatgtctcaccaatccatttacaggtcgcagacatttacaacaccagcctcctggcttcttatggggatagtggctgcatcatgtcccactgcacccttgcagctgactccatacccctattacataacacaagtctttctccttctctctttgtacccagaggctccagcatatttgcatagcatttattatgctatgtaaatacaccattatatatgaatttatagcatatgtgagaactcagagtaaatccaattccatctaaaaccacgtaatactcactgaggttcccaccacagtccccttgcttacatgtgcacatcctcaacttccactctttctcaggtcaggaacgtgtcaattctgcaacttcaagtggcagttagggaaggatcctctctccattatatgaaaagtaggtgtctagtggggaggagcttccttctgaaatgctcagaaatgtaccgatgtccttagatgctgcagatggagcccagatcccagtgagcgactgctgggctgttcacagagagccagaggcccctttggaaagggtggatctccataacccatgggaggggagggacctccaacaatcttgttagtgcatcaagtaatagatttttgacagatgctttcctgccttctagtccaaacttcaaaatccttcctgcactggtctcattggggttggtggttagttctcactttccccatttctgagaccagcaagaggctctgtttgcgccaagtctccctgtaaacactgtggttatgcccacactaggcaatgccttcctgggagataacattgcatttattccaggactcctacagggaacaggaggggaagaaaattgcctctctgtgaaagcacattacaatgtggcctagcccaagctagactcactagaaatgttaactctgccctgcactttccattccccatcccctttcctctgccttttccaagcaaactcttactctaggaaatacatgtttgattttcttgggtgaccaccatctccaagagaacctcttagaagtaggccaaggagcaaagaagaagtcccataaaggtcaagagcatcttacaggaaaggaaagtggttacggcagattgcaattgtaggaggaatgacacaaaaggggtaggctagaaccagagtcacataagaacagccttctggaggcagggggatggatgaaagaatgtctttatgtcccttcaagggttatgattttgtatgtgcaaaattctgaactgtacatccagttgaacaaagtaaacatttatcaagcatctcctctgtgtcaggcttgaagtgagaaattcaaaggtgaaccaagcatggttccagagtacaaggatcctacaaagtaaaagggtaaaaaaaaggtactttggcctcccttcttccctcccatccatccatccatccatccatccatccatctatccatccatccaatgcaaggcatattgtaataaaggagacacaactctaggcagatgtcatgagcactggaatcagattggaaaactgagtctgccacttactaattctgtaatattgggcagaaaatgtaaacaagcatagcttcaattttcctatttctataacaagaatattaatggtatctatttcatagggttaacatgggaattaaagaagataatgcatattaaagttcttggtacatagcagatgctcaataaattaatatttattaaactaatgaattacaaataaagaaaatgttagggaaacacagaggggagctcatcaatagttgaagagattgggctaaaatttacaggaaggatggaatttgagatggtcttgaagaggattttaacacatgcagatggaagctatttcagacagagggaaaaaacatgagtattgaagtggaaaagaggaggtcatggttcagggaaaggtgactagtgggaaataggactgaagatgtaggctgaggcgatatcatggcaaatctttatctctacactgatgatatagacttgatccttgggcaaaagtgcattagtagggattctggagcaaggcataactgtggtttaggaagatcaatgtggcaacacaatgagtaggattgtactgaagatgaattggagatagggagaggagtttggaggcagcagtaatctcagcgagattacgtgaggattttaacaaagctggtgacagtagaaatggaggaaatagaaaagagttattatgaactggtgaccaaaaagatgaagagaatgaggggaggaagagcaaagctgaccctgagcatttagggagaaagaattgaaaagatcatgatgtcaactctagctcgagaacacagagaaaaggcaagagtttttgcaggaaggtaagctatgtgctagatggagagttagggaccttgtaggaaaccacgtgcagatgctcagtctagctggaactatgtgcctacagtccaggccatcgtccagaactagatataaggaagtggcatcagcctcatagggttaatggctgaaagtgtgggaaaggatgtcattgaaaaggggctaaaataactcttgatttaggggactagcatggtagattgaagtagatccagtgtatagtgggctatgagaactgggaactggaaaatcaagtaggcagaaggacgaaaagctgagtgttactaatagtagaggtaaaacatgaggctaatagagttcagggactggagccaccaagggaagtgggaaaataggaaaggatgaaaagattgaagaccaagggaaggccaaaaagtaggtcaagagggagtgagaaaatgagtgaggacagagaagaactttgacaattggagctgaatgttcagtagttttgagtcgtgcatttcaagatgcaaatggggtagatgcaggtcacttgggggaagactgctgggacctgaggaggtcagaggcttgggaggactgaaatcaccaaggatgaagctggtgaagacatgggttgggggtgggggctgaaagcctggtactaaaatcctagaggaagatggagtcatgtccagaaaacctgcagatgaggtgagaagaataaagagatggtacagtggatggaaatattggggcaaattgctgaaattgaagtgagtctgtggaaaacaatatgcaggatgaatttatccgtctcctattaaatgcctcaaagagttaaagtttttaagttggagggtcaaagaacatctatggaacaaataataatctatagatgtacaaagctagcaaatattttaagtgctaaaatgtgtggtgctggtcacaaatagcttgagcctggtgcctttgaccagccctcctgacaaacagcgaacgtgccaagtcctacaaggcaccgttgcagcccaggagagctaaaatctatgccctggaagaggtgaggacttgggatgaaccttgagggaggggttggggttgaagtgggaggagcatttcagtcaatgggagagtggataaatgagcagaggtgaagtgaacacagcatattctgaatatatcgcaagaggggtgcagactgggcgttatgaaggaaaaagctggaggaagatagagtgggaccagaaagtgaagggatgcagactgacatcgtaacaattcaaatgctaatgaaatattctcaacttgagttccctgcggttgtggtcatgggccaattgcagtattcagtttttatgaagacctccagcgtcttcatgtgtggtcctcaaatcctgaatacttctctcccagagcatttaccacacggtgctgctggtatgccagcctttctccttccaccgtgagccatttgagggcagagaccagaccatctccgcagcctctcaggctacagggtaccctgcattatgcagactgagagctctagaaatatttgtggcatgaatgaaagaattcatgagtaatagccgggcataaatcagaatatgcacttgaactgggctacagtgttccaccagaggccttccacatctaaatggaagcatcatggcacgaggtgaaattctaggtttctgaagaagaaaaggtaagaaggactctcaaagcctttgttaattaaaaacacacacagctcttcagggaacatttccctgcctcccattctccctcgttgtactgaatggcagataaggtggtgtcttcgcctatgctttggaccacatttaattaaatgcctacattactgcttcctcacacaccttattttatttcctttccttccttccatgctaaagagggccagggctaatactaatgcatatgctgttaaacctttttaattaacttcaacttctcccagagatttatgtttaaacagtaaattttttgttgatactcaaatacataggcggcactcggaatgatgtacgagtactcttgtcctcaaaatgattcttcatgagttaccaccagagacgttttcatgagcctcttttattaaaataataatactcagcaaggcaataatgctttacagccggcagctaattaacccaccccaccccccaaacaggtcagcattagcatctgcaggttcgcgatatgatcgcccagtgggtcccccttgtaccttcgagtcagcactgaatcggtctgggtttgtgctctagcatctgtgaataatgattttcatttaaaacacatctttgttcttagactgtagctcaatctattattattgttatttattttgttcttgttagtgccttcctgcactgggtatcagtatttctgatctgcagttgacctcttgaaacaaaatttaaccatgccttggaaaatccaattgatttaaaactcttgtctaattgcaaaatccatttatttttctgcaactctaaatttgtgccccaagtatttttttttttttttttttgagacagagtctcgttctgttgctcaggctggagtgcagtggcatgacctcggctcactgcaaacttcaactcctgggttcaggtgattctcctgcttcagcctcctgagtagctgggattacaggcatgcaccaccacacccagctaacttttgtatttttagtagagacggggtttcaccatgttggccagactggtctcgaactcctgaccttgagtgattcacccgccttgggctcccaaagtgctgggattacaggagtgagccactgcgcccggccaccccaagtatttttaatcatgatctatgctgtcaattgtaattgcaatgtagcaattctttgccaacaaaaccaatctacctacccaagctcctgttcttttcttcatgttgagacaacgtttttccccacaagccaatgtggtcatatcacatgttgcaccaccgatgagccaattatttcaattttggcatcagatttaaaagagactttaatgatcctcaatggtataaactgaatttttattcctacagcaatttagtaatgatgatgacacttaagcatttagaaagtattactcatcttccaaccactgacaaacaggaggctcggcacttttcattttaggcacttttctaggcaagtctgatggggacctcagcatggacagcatttcacaatatttagggagcccaggctcacccctgctactctgccaggagctatagaaagaaaaatctccaagccccagtgcttgtctgctggggtttctagctggaaatcagaataagctcccaagccttgcatgcccgttttaattaacttgtctattcacgcatccaacaaatatttaatgagtttctgctaggtaaggaaacccagccccaggagggagactgagatatatgaggtatacccctttccctctaatcaaattcaaccccacccctctcaccagggtccaagttatttgaatacttcatttatgcatacgtttactcctttcattcagcaaacgtttatcaggcaccttttagtgtaaggtactctgctgggagcccaaaagtttacagcgaagatcaaatctgtcagcaaatccctttggttcttccttcaaagtaaatttggaatctggtcttcttgcccctccaaggctaccccctggtccaagtcacttggaccctgtgcctggatggcggccagagcctcctaattggtctcgcagcttccatccttgtcttctgctgtctagtttcaacagggcagtctgagtagtgcttttaaaaacctaagtcagagggagccgttcctttgttcagaacggtgcagagcattccatctcactgagaatgaaagccaacaccctctccatgactcatggtgctctccggggtctggcctcgttgttacactttgacttaatcttcactcttccttttgcttgcttatacagtttggatttgtgtccccacccaaatgtcatgtcatattgtaatccccagtgttggaggaggggcctggtaggaggtgattggatcacaggggtggatttcccccttgctgttcttgtgatggtgagttctcacgagatttggttgtttgaaagtgtgtatcacctcctccttcacttcttcctcctgctctggccatctaatatgggcctacttcccctttgccttccaccatgattgtaagttttctgaggcctccccagctgtgcctgcctacagaaccgtgagtcaattaaacttctttcctttttaccccgtctcacgtacttctttatagtaatgagagaatggatgagtgcacttgtgctggcctctttgctgttcctgaaactcaccaggcatgctcctgcctcagggtctttgcacttatgcagttccctctgcctgggatgtcctgtcctcggtccctcccctgcttcaagacattgctcggtggccaccttcttggggactgaccatcttatttaaaatgtgcaccccacgcctataggagtactttatatccctctccctgttttacctggctgtagagtgcctatctccatctgacatgattcatctttatttgttcatttcatgtctcctccactagaatgtcagccccatgaagtcttagctatttgttttattgactgatgtatcaatgcctagtgcacagatatttaaaatttgttgaacatatatatgtatgtaatgagtgcatgtaataaatagtgctgtgataatcttcaagaagcacatgatcaaataggaactatatctaaaataaataatgagctatgttttaagaaagctagaaataaatatggtagcccaaagggtagaaaattcattttgcctggttgaatgagtggctaaaatcacagtcctacaatttcaggtgtgtcatgttggaaaatgtattagtcagttttcacactgctgataaagacatactcgagaatgggaagaaaaacaggtttaattggacttacagttccacatgggtggggaggcctcagaatcatggagggaggtgaaaggcacttcttaaatggagatggcaagagaaaaatgaggaaaatgcaaaagtgaaaacgcctgatataaccatcagatcttgtgagacatattcactacccctagaacagtaagggggaaaccaccctcatgattaaaattatctcctattgggtccctcccacaacacgtgggaattattggagtataattcaagatgggatttgggtgggaacagagccaaaccatatcattctgctcctggcccctccaaatctaaggttctcatatttcaaaacctatcaggccttcccctcagtcccccaaattcttaactcatttcaccattaacccaaaagtccacagtccaaactctcatctgagacaaggcaaatcccttctacctatgagcctgtaaaatcaaaagcaagctagttactccctagataaaatgagggtacaggtattgggtaaatacagccattccaaatgggagaaattgaccaaaacaaaggggttacaaggcccatgcaagtctgaaatccagtggggcaaattgtaaagctgcaaaatgatctcctttgactccaggtctcatatccaggtcatgctgatgcaagaggtgggttcccatggtcttgggtagctctatccttgtggctttgcagggtacagcctccctcccagctgctttcacaggctgacattgagtgtctgcggctcttccaggtgaacggtgcaagctgttggtggatctaccattctgggatctggagggcgatggccctcctctcacagctccactaggcagtgccctagtagggactctgtatgagggctctgaccccacatttcccttctgcactgctttagcagaagttctccatgaggttcccacccctgcagcaaacttctgcctgggcatccaggagtttccatacattttctgaaatctaggtggaggttcccaaaccccaattcttgacttctgtgcactctcaggctcaacaccacatggaagctgccaaggcttggggcttgcaccccatgaagccatggcctgagctctacattggcccctttcagccatggctgtagcggctgggatgcagggcaccaagtccctaggctgcacacagcgtggggaccctgggcccgtcccatgaaaccattttctcctaggcctatgggcctgtgataggaagggctgccacgaaaacctctgacatgccctagagaattttctccatcatcgtggggattaacattcgactcctcattacttatgcaaatttctgcagccagcttgtatttttcctcagaaaatgggcttttcttttctattacattgtcaggctgcatattttctgaacttttatgcttggcttcccttataaaactgaatgcctttaatggcacccaagtcacatctagaatgctttgctccttagaaatttcttccactagataccctagatcatctatgtcaagttcaaagttccacaaatctctagggcaggggcaaaatgctgccagtctgtttgctaaaacataacaagaatctcctttgctccatttccaaacaagttccttatctccatctgagacaacctcagcctggaccttattgtccatatcactatcaggcttctggtcaaagccattcaacaagtctctaggaagttccaaactttcccacattttcgtgtcttcttctgggccctctaacctctccctgttgccaagttccaaagtcacttccacatctttgggtatctttttagcaactctactggtaccaatttactgtattagtctgttttcatgctgctgataaagacatacccaagactgggaagaaaaagaggtttaactggacttacagttccacatggctgggaagatctcagaatcatggcaggaagtaaaaggcacttcttacatggcagtggtaagagaagaatgaggaagatgcaaaagtgaaaatccctgataaaaccatcagatctcatgagacacattcacttccatgagaacagtatgggggaaaccacccccatgattcaaattatctcccaccgggtccctcccacaacacataggaattatgggagtacaattcaagatgatatgtgggtggggacacagcaaaaccatatcagaaaagaactgcaatccacgtctaaatgagaaaatggttccttgctataggatttctcagctagactaagaaagtcttttgggaattggtgggatggtgcacagtttgcgtgtttcactgagtcttgataattattccaactgggaatccctctccatcttccccaaatctcacaaattccagtgataaactccactccatgtctcaaacagggactatttttgagaaccatgcatgctctttccagatatcagtggacagcatccaggggggcagagtcagtgtaatttctcatggctgattttgacaggagatgtcaggttagtcttagttatcctggagcctaactggatcttgggaataaatctcttattttggtagcactttcaaataagtggcagcagttcatgcataattacttctgaattatctaggggatttatcaggtttgattatagatgcataatgaatttaccaaatttgtgggtattatggagatattaattccatatgaaacctcacaattcattcatgtgccatttgttttcattccttttttataataagctaattagtttaaattatttgtacttgtacaaggtcttgaaacacatattaggaatgattataccagagaacccaataaatgagaagttttggagacagcattaattgtgatgaagggttcataaagcagtggatgttcaattttcccatttggggtggtaataacaggtctaatcatgacacctccataaagtcatgggaagtccctaatgaaagtttctgaattcagatatttaaatgatggtagggtaagtcattatgccaatgggagaatgaggcaaaaagcggagttcatccttgtgctaaccaaagaaaagatgaaatggtgagggctcatcaattctgggccaggaggaagataggcactagtaggtctgatctgtctggaggattcctttaaaaaaacccaaggttctggaggtcactggcaggctggaatttcagcccctcagagtgaagggatgggcttctttggttgagttccggtgtctgttaaccccccaccccttgttctttgtgtgaaaccagcacccactggccaaaaagcccgggttggggtctctgtgggttgatggatataaaccatcttctttacttagggcacaaagaagaaccaagacaggagaggaagcctgggccaagcctgcctagggagtctatcgtggtaggaacaagagctaccatgccttgagcccattctaaatggtaggcaagtgctagatatttggctcacacatttcatcctcataacagccctatggtgtagagaatatcattatctccacttcacaggtcagggggctgtggacaagaggtcaggccatttgccaaagtcctccactcaatctataggtagcggggctgggttcctaaggatgtctgattctgaagcctggtccttgatctctgtgctccatgaccttctgtaatccccacagtctcccaaacatcaatgctgtcattacaaccccatcacctacccttacccttaccacaccaaagagttactcttttttgaaatctgaatctcagattttcactttccaggcaattcaccaggacagaggcctttcaactttcctccctgagatcttcctccgtgaaccaacaacaaaaggaccagccacctcactggtcctctgttgccagtagaaaaagccctacaaggattaatgcaagaagaagttctgctttgggtgagacatcagtttaatttatatttgattaaaaaagtcattcattcatgcattcagcagccagtatttgttaaatgtctcctacactcttaattgggttttgtcgggttgtgggggtgggggaggggaaaaagagagcaggtataataaagcttatgccagacaccttgtttgtaattgtcttgtgaggaatatatgtacacaactgaaaagttaagtaaacaagagaatgatggaataactaggcaagtgagagaggcagacagtgcactatctacagaatccaacggaggaggcggtactggggcccgtggtggcagaggatgacggctttgcagaggcagaggaacgactgacttgctcagtgaaggatgggcagacttggggtggcagaagaggcaccagctggacccgcccaggaagccaagcccctgtgctgcctcagtttgtaagtaggcatttgaccttgtggggaatcactctctagcgcctcaccgtctttgctgtaagatggagataatgatacctcatggggttgtcatgaaattcaaatcaggaaatggatatgaaatggttctgaaagatgtaaagagcaatataaacaccagatacggaatgagaaaaaagcggcaccggaagtggcattttgcaaactccaatcccccaggaccacatgtgaaggagctcttttcaaggtcacacggacactctgacccgactctctcctggcagcattcaatgtgacacgccagggcaatgagaaacgggaggggctgcgtgagacatggcaaggctgaggccaagccccaaagttcacggacattccataaaaagtgcacggtggaacctgagaaggtggagaagggcagggatgcccctggcactttttttgtctctggtgctatcaaacagaaaatgtcacctttgttcctctatagccatttttagttgcaccaaaggggggagttgaaaaatagaccttgtagctgcctccatgcgattcaggggaaggtgataccacttctgcctagagggtgacccccacgcccagcacatatctcaccctcagtcacagcgaggccacagccctcgattctagaatctgatgtccttgaatctccctatcacgggctcccagtttcaagggcctctggacacatgaatttctactttgagaatcagtttggctgtgtttcggtatctgcattcagcttcacaaggctggtgagcgagggctcgtggttgggacacctgacaggtggcggggaagacctccactggggacactgattttattgctagaagttgctaaaggatgagcaacttagcagctaggacttttaccacttcagtgatagaatgtaaagtcaaccccgagaagatggatctaggatacctaaactgaaagtttttttttttttttttttcacagcatattgcaatgcaacagtgaaaggaattttaaatgggcagcttctccttttctcctacctccaggcatctgcctctgaaatgttgaaggtggagggagataggattggcctttctgggaagacctctaagaaaggggtttccattgagaagaaactacgggtaacagttaaagaggaagagcatgtgtaatgtaggaagcgcttttgcttcagatagatgtccttccctcaccccagagcacagtaaccctaatgctatgtcctgcatctgtctggaggggttgtctagcctggcccacatcctgagccctctccacatgggcaaccacacagccgacatcgtgagaggtctgagcccctcagactcttgaaggtcaatggatattgtgtatcttttttctacactgcttcaatgcttttcaaccattatttttttttatttttttatttttttacaaccttgagtgttttaacgatttgcttctttaaaggctttgcttccctctgaatattatgactagcctattgggtcagaggccaggagtctgcagaggaccattcattcaccccagaggccgctccttgcttttatcctgtcctcaacatgatagctcaaactgccagattttacataggaggaaggaagacaccgaaagatgttcctagctggcacaggctgtgctgaacacaggtctcaccccactgtgggcaggtggtggtggagcacatctgtctctctccgtgttggtggctgtgatttggcagctctgccgaagatttgtgagatggagaagaaagtgcagggttggggtacggggaaaggggtaagaaaggagattagtcacttgagtcaggataatttttcctgatgtcaaagcctcacccaggagagctctcgctgttgcctgcttttatctggaaaacaatgtgagcagtatctctcaaaattaggtcagggcttgcagaggcagggacttgccaaggtgctaactgcctgaatcctcggtgggtttgcacagctctctgctctgacaaatgcctcctttgtctccctgaaaagcctgcctcttttctccttcacccctccactccccccacaaacaactgaatttggaaggttaaaaatcacttcacttgtcaactcgaaagctctccctcccacctcaagttgtttctcttcctgcccagggaaggcagctactgtgtgtccccctggggactggaaccactttgcaaagagcgcagatctgcagttttcacaacgcagttgtcatctcgggagcagtgtgtgcccgtccaccctgggagaggcttatgaaggctgtgtctcaagcatttcagggggctgcagatttagggggacagtcctggtggcttggtcttaggcttgtcttggctcaggtttctgtgtggcaacagcatgataaaaattctgtccactctaccaaaatgggagaagcaatagcaagacagcagggcagcaacagtcagttcttgtctggctttccaggacaacgtgactttctcttattttttgttcctgacactgtttgcactgactaagatatcacgatgatgaaacactgttgaatctaaaaggtgggtggggctgaaggaggggtgggaggaggccttagaagctaattagaatcctctagaagtgtgtggaaatgggaacctgagccaggagagtcctgtggattcactagattctgggactataccttatctatgctgtgcaaaggaataagaaactagtgctgtctcgggaaccagcaacacagatgttcccaggagcaatgtttgcaggtgagtgaggtcagggagggctacagagttaggactccgaagtcagaaagatgcctgttggttctgccgttcatatctgtgagatatcaggctggtttcttaaccataacctccatgattcagtttcttcatttgcaaaataatttaaataagataatatgttgaaaactcttagcacccaataagccttcaaaattataattgttttgtatgttttggcaagaaaatagaataatattattattggagtctctggaaaacctaggtttccaaacctttcaccttaagtagatttttataaaatgagacttcacgtggaatctcaacatacaaaattggcataagtgggggataaggcagcaggtgacagtggttgcgtgctcctgggcaccgcctgcccagcccctgcactgattgtcttacccacaggggcagtttaaatcttcatgcttttaccaccttatactgagtaagaagatgaatttgcacagatttctccctgcataatttctccgtatctttagcacagtttggtgatgacttttaagctttgacatcatgtactcataacctatctcttatgaaaataaatgaaactggctaggcgtggtggctcatgcctgtggtcccagcactttgggaggccaaggtgtgtgcatcgcttggggctgggagtcccagaccagcctggctgtcgtggtgggaccccgtctctactaggaatacaggggttggctgggcatggtggtgtgtgcttgtggtcctggctgcttgggaggctgaggcatgagagtggcttgaacccaggaggctagggttgtggtgagctgagatcatgccactgcactccatccagcctgggcaatggagtgagactgtgtctcaaaaaaaaagaaacaaaaaaaaacagaaaaaataaatgaaaccatgattttctctcacactgtattgtgtttaattttcatttgtttattctataaacatgacaggcttttgaactttgtattacctatatattttataatagatcatgcataatctctcaggagaataaaatgagaattccaaataaataattaaataaataaataaataaataaataaataaatcttcatggaatctcaaggctctgaggggcctagttagacaactgctggtttaaaatattagagaaatagtgggccagttccaaaaaagtagagccctgatgacatccagccagttaacatgttttagtaaccaagcaaaccaacccagaaagacatggatcaggagaaacctccatatgtggcagggcacaggtctgagaggtgagtgctggaggaaccaaggccagagtgggacaagctgtttagcaaagaagggcagtgtcattcctcttctcacccagtgtggggctgggacgtgtgggaactcagggcctgtagatgggttgggggtgaggtggagtagggagatggagacaatgacacagagacagtccgtccccagcccaaagaggactgcgctagcttgggagggaatgagactcagttggcatttctgcacatggtctgggtggacctgcgcaactctgattgtgtccatgtagaaacctgtgctgtgttcagtcactgtaatgcttttgtagttctatggctttttccccttttgcttccccttagttttcagagaaattccaatcaggctttactgctatctaccggaagagacaagaaggtaatttgaccagatcaagaccacccagcccagcagagcgcaattcatgaccagtccacagagctctcctcccggatcccatcagtttcacagagaagatggcattgccaaagcctggggctgctcacccaatccctttgtgtctgtcacagctctcccatttctggaggagtcgagttagcccctccttctcctttgaatctcttctctttaagactcgcagcttcaatacccaaatgctgccatgtctgtagtggtaatgcttggaataacaagtagttattgtcatacaagaagaataaggaagcttttgatgatctcgaataatgtggatatctacatcatttttgcatgtcagtgggtatacccagctttgagggaatggttatttttatacctttcaagacttggtatgcttaattatctagggaaactcataaccccaacttcctaagccactcctaaagaaaaagcacagatgcagtgactaaaaactttctggcctccttatacttcatctcagggctggaggtgactcagatgtaccttgctattttcatgatccattggtgtctcagtaatgaatgttcaccactgcagtgccctcatttagcctaataacctcagtaaggtaatgtttgatttgtgctaagtatctgattaaacaacataaagtatttaacctattgatcttttatactttgccagccctacattgctggatatactttaattactgactcggagagctttcctgaatgggatctgcatctcgttaagactttttctttgtctttaaggtgccatatcaacagcttctccttcttgttgcctctaggcttttcttccacttcctgctcctccgccagaccctgcttgattctgcaagactgacgtttggttaatctactgaaagtagagtcctttatgtaaccatgaatcttactgcttattttagaaagtcaatgaccacataaacaatcggacttgttactttgtccaccctgatctttggagcatgggaagttgtccaaagtgacaaccccattttaggcagttggtcacagctgttggatggacctaacccttctatctcacaaggagacgaggccagtgggcatccatcaagagaaattataggaaaccatttagactggccaattggttagctaattgctctagtctaaaccacttcttagaaaactacagaaaatgatacattttccctcttgcctgcaaggatatagtcatgaacgttaataataattagctgctttacatgctgtcttttcttcaagaatctcagacatggtgagtttatttattttttctcttattttaaaactagatctacaaaggctgagatagcttctccatgggtcctcccaaaatgagagtgacacctcataggattaagagaattcaatgagaaaattcatattgaacacttatcataatgccactgagtaagcactcaaaaaataggagttatactattagttattattagttatatcatctaagaagcctgcgacttgtgggttgcccatgaatttctgaatagagtcaggctgggaggaaggcacactggtccaagtgtctagttactttgtccagaccacctgataaagactgtctcaccctgtgtgccaacatcctttggtctctgctggcccatcacacataggtcttggacaaaaaagagtggtttgtggaggattaaaggtcatgaaaaggcgaacattcaccttcactcaagatgctgcccgaagtcagatcagaagcagagtcagaatggctctctaaacagcttctcaaaggatgccttccacgggctgatgtgcttgataacaatgcaaatgcaaggaacatgccccagacaactgaactggaatttctatgagcacagcccaggaatttgcaattaaatcaagctcgtgggtgattcttatgttcaataaagtttgagaagcatactactaagtgttgcctttaaaggcaactcgaaaacttgcagaaaacatctaaagaaggctggaggtggcctggtgcttattgtataagagcatctggcaagctccaccctctaggtggcattctggtcttgaaaagcatgataaaaatttggggttgctactaagcagggacaattgcgcagcttgtggagtggcttggagacctccaatagccctgctaggatctggggcagacagtgggcaccagccgatgccagggtatgtgaagggcaaaggaggccctttgggggaagagaactgtgaggccacaggactactgaaatagagctccatgcccttctccattgcctctgtaaataccctggggatcacttttactctattttctggcttctctgtcacttgtggtgcagttgggatgcttactttcacttccaaatgatgatacctcagagaatgcaaactgtaatgcacataagacacagacaatccatggaaaacatgatactgctgagacgtaggcacatgttcacactgacgtgcattgcatcattgcatttgttccaaagccggtaaaaatgattttcagataatctgctattttggatcgtctgcactgctgcttgcttccattagcatggctaattgagaactgactgtgtgtcttggaccatttccaggaagggaacccattgcctgtataatacaggctccctgagagagccaagtaaatggctggaaatgtcaggttgaatgcccacattggaggagcaaacttttgaggacgacctgaccattctcaggccagagaagcaatcttgttcagcatgtcacattgattgccaagtcagtaaaccataaaactgtcccacagctagaacatgcactgactctgagaaagatgaggcttggttagtaaaggatgaagccattccaagaccaataaaagatgcaatatggttttccctgggctgtatattaacaccatcctggcagctataggggatagaggcttggcaaacaactgtgttttgctttgacttttgcagagtgaggatgagatagaggccaatggggagatcatctgaggccagatgaaaggcttggaaagagtaagtctttacagaaacctagtctctaaagaaaccactgatgtttatgtgtcttggccagtgtcttctgtcatataacatcttggtgaaataccccaaatagatcttaaaaccaaaacatactaagaaaaaaggaaaatagaaagcacaatgttgtaactgccttctgggtaaccatgttttggatggtgtcatttttcttatgacataagctcccagatggcacagacactgtgtctcagaaaaaatagcaactagcagagggtcatgcctcatgtgagtttctgtaagtattgtttggttgtgtgttgtttatcacaaagagaacagatactattgtcagacaatctcaccagctgcattttgcaagaagaatgagagaagtcccctacaacttttacaattctgtgttctgtcccaaataacgacgagagatgaatcacctgggctgaaggataattgaaggaggaggcacattactcaagaaggtcagaaagcctatgtctaggattaatctgtgctcatggaatcgtttctatgtgttgctaatagctagagggtctgctgatttcatctgtgcccagtcaactccctgggcccacctctaatcaaaagcagaggacataaactgtgaagatttccaggatggatttctgaggacagctgtctatagcttcagatatggcactagacacagtggtgctcatcattggctgcatgttagaatcacctgagggagctagaaaactatggatacccaggctccatccccagagattctgatttaattggtcagggatgggtcctctgtatgaataattttaaaaatcacctaggagattttacttgcaagcagggttgagacagcccgagctaaagcctctttagtggtatgagggaaaacaggaggctctggctcagttcacaaagttgaagatcaaacccagccttcgaaacagcattcttcttctttacaggatgacaggaaataaaagactgtgggagttggggtttgggtaaagaggaaagaagggaagggagaaaaaaggagagagccaaaacgcccattgagaggaagggaataagattgattttcccctagtagtttttattcaaccagggtctgaaatgtgctcagtctacctcatgaaaagtgtgtcacccagggcacactggtgtttctatcgctagtcacagaggcttcgggcaactgctgaatggcagcattagggacccataaaaggaaaaatgcattgctatgactaagagcccattaccataacaattgtaaatgactttggggagtctgcccattgaccatcaaagaaaccagaaaacggggccaggccccttggagagcactagaggcttatgaaagccatgcactggtaatgttagtgtcttagtcccttcgtgctgctgtcacagagtacctgagagtgggtaatttataaaaaacagaaatttatttcttacagttctagaggccgggaagtgcaagatctagaggctggcatctggtctggtgagggccttcttgctgcatccttatatgcagaaggtggaaggcaagctagaacaagttagccaaacactgcataaagcctcttgcataagggcattaatcccattaatgaggaaggaagtctcatagcctgatcacctcttggaggccccacctctcaatactgtcacgttggcaacacctgaattttggaggcgattaggtttcaacatgaattttggaggagtccaaaacattcaaatcctagcagttggagatagcaaagcacattgtatgatgtgacaagaaagtcacatggaggcagaaaaagaagaagagacccagtgggtcaccccaacttcaaatgggttctcaacattaactttctagagtgtaggattttactttttccaaagtcctttctttttttttttttttttttttgctccatctctctgattcttactcatgtatttctactcagaactggagccaggaatccatactccctgttcactgtcccttctggcagaaatactatggaagagcagatgtcagtgatactgcccgatcttggcaagggaagaaccagcaagaagagtgcagggcatctccacacgtgggactgatgagcatggggagtgtggagtgtgagaggcaggagagggatgtgggggaggttttgatatcatgtctggctttttttttttttttttttttgagatggagtctcgctctgtcacccaggctggagtgcagtggctcgatcttctttcaccgcaaactctgcctcccggggtcaagtgattctcctgcctcagcctcctgagtagctgggactacaggtgcatgccaccacacccggctaattttttgtatttttagtagagacggggtttcaccatgttagccaggatggtctcgatgtcctgacctcgtgatccgcctgcctcggcctcccaacgtgctgggattacaatgtctggctttaacaagacaaagcttttgatagtttatctcctgcaattcctggttttctctaaggtggtgctggtttctactacacagggagagggatccacttgtcataattaaaacatctcatggaagcgtatgcttctgtgctttcctggaaaatgtactaatagctggggatggcaggttcccagggaagtggcacatgacatgtcaggggagtccagcaatggggaggcacaactcctaggcccttagatttgtagcctctgaacccattgcatcctggagccagttacagatttcatctgagggacaaaaggagagtgagagacttggaggctccctttggagctctctggcaattcatgattgttgagcaagaaagatggggaatgaggaattagttttcactgaattgccacagggcctgctctgactataagcataggagagccaccccagtcctgtaaagccctagagttgggctagcaggggaaagcacaaggtctggagattggaaggaattttcctgagagtgtgtgtgtctgtgcttttgagcctgtgcccctggcacaagggaaattaaccagactctgcatgttgtgggaattctgcatggcaacctaatagaggcttagcttttcattaaaatttccattaatactggagctgtttagagcaagttgaatgggaatatccataatgcacctcctatcctctattaccattctgaggatcagagtgaggtttcaggcttttgctggggccattagcattttttttttttttaccatcattatgatcatcaacccagcaccaattatgtagagcaggcaaagtacaaagaggctcacacagaacctatccttgtcctatgtgacaggcagggcaagagtaagagagcaggcacgcagaggcagagagtgaagtctagtgagaccacacggacatggactttccagtgttgagaagcacctccttcctcccacctgcctactctaaatgaaacagctctgtcatactgggctagagcaatctcaggtgcagggaaggcatagatcttctgttggaactggggatactgaaagggatgaagaagttcggcctcacctcttgaggatcatttctacagcagagctgcccagaggatcaccattgttaccagctccgatgtgcccttcctgcatgccaaagccagttctctcttggagatggccactgttgctctctgggctgtgggacatctaggaagctgatgtccttgtttcagggtcctgggaggctgtttcaatgacatctcatagagacactttcctttctaaccctggctgcagcctcatggcactacttcctcatctatgaacctcttgtgcccttagacaggggggcattccctgcctcaaccacaggtagctggagctcattctacagtgtccagagtgaaacctgtcccctccaggcagaatgaactgtgctcttactctgcagccttcgacacattattcataacatgatgattattttggagtgcgttcttttgcttctcacaatgagcagacactctactttatccagcttgtatcctctatgctaagtgcacagcagattacatggtagttccttataaattttttaaaaattgttgtagatttccttccacctgcctgaggtgaggctcaacactgttactgatgaaacagtccatgtgtggaaaaacagagcccattaaaaagaaaacccaaacacagctaatagtctgggaatggtgtctgcaggatgatgcagttgacacattctgtttgtgccacacgtgtgttttgtcactgagactgccagctctgaggggaaaaattctactataagaatatttaaaataagattgagtacagtggctctttgccaggtgtgtgtttcaggaggcattttaatgagaacatgctgtcatggtctgaatgtttgtgtttctccaaaattcatgtgttgaaatcctcacccccgaggtgatgctattaggaggtggggcctttgggaggtgattagggcatgagggtggagccctcatgaatgaaattagtgaccttgtgaaagaggccccagagagctgccctcttccaccatgtgaggacagagaaagaaggtgccatccatgaaccaggaggcgggtctggaccagacatcagatctgccagcaccttgatcttggacttctccacctccagaatggtgagaaatacatttctgttgttcagtctaagatcgtttgttactgcagcccaaatggactgaggcacatgcttcagccccagtggtgaagagcacagactttggaaacatgctatgtggacctgaggtctgcctgcaacacttagctgtgtgacctcaggaaggtttcttaatctctatgtgcattcatttttcatttgtaaaactggaatcataatagacccatcaccttgtgccattgtgaggatgacatgaggtaaaaatatatacaaacttagagtagtttatacttatactgtgtcagtctaaagcgttgttgctattaatgaatcagaaagcctggaactatgatctggacctttttattttgaaggcgctcctcggagattctgatttgcatccatggttcagaaccacttgcctactgcattgtctgtatcatagaagttgaggaaccattaagcattaataaataagtgcagcaggatcttggttccgcaggaagagtgtggattcttggaatgcaattgtcatgtggcaagttatttcaggttttcttgttatcctcctccctgtatctataatggacagccttgggttttacctcctgtccaggcacccgttcctctttctgcagggataagagtgagcatggaagtacttaagcaccagggaaaggggagaaagaaaaagtgggggtaatccaccaactgtctaaccatttcctgaaaaatagagggccaactaccattagagctcttagaggattgctgagccttctaagggtttaccaagaagggacaaatctaatgataagaaagttacagccaagtttattgaacaataacccatttccttcatgtagaaacaatgaagaaacattttttctcacttacatggcacaaggaaaacaatatcaatgatttgtgctgcctgcttgtcgagtctgtttaccaacttggcttatttttttactgcatgatatgaacacttagggttaaacagagctctctttttctctctggtgaggtttttgcttttcccatttttatttgtattgactaggaggtctttcaccagaagaataaaagaccatgcttttgaggagccagtcactgagtttctctgttgatcaatcaccattgctggtacaggtatattcattttgggtctgggatggatacaggtttgatgaaaggtccctggggaatgagagggcttagccaacagtctcagggtcagcatttcctagtcctacaagattcagatccctgatgtggagccaaggaaaggcttgagtgactaggggtctttttgaacaaggcactttaatttgccaagaactctacatcattttgtacaatttatttcagggagagatatcactttaagctaaaaaacaaaggaaaaaagctccagactactccatgatggaggacaaagcatctcagtaaataactttgaaagtcaagagttacaggaaataaaaaaagaagacaatcagagaatgtgccactaatgaattcaatcgcagcaaaagtccatttccattcccttgaactctacacaatttccagttgcaaatatctttcagaagtactgtacacacacagttggatattgagttgcttgacaaacatttctgatcaaaactgcttgcctagaaatggctgctggagcaacaataatgtggatttagaatgagccgggctgtttgcacataggtgtagtctatgagtttaatggagttttgcagaaggcaattgcctagaaaatagtgggtttttaaggatgaacttttgactcccaatgcgaggtgaagggaagatcgggggagaatagggagagaagggctgtcttttctgttttctctggggcaccatggctataataacttctactttgctgtgatggactcagcaatcaatttattctacgatcttttcccagacacactctcaactcatgtcggcttagttgaatggtcaccctacctggattctgagacccttcttggggcctcaattgggatatttacagcttccatttttgagaagtgtgtgtgtagaggcactaatttaagaacaaaaaaggccagtgacatctagggaaatgtcttcactttgggcaggagtgggatgaccctctgaaagctgcacaaaaggccacagatctggccgatctgaggagactggtgttttctgatcttgggacaaagcagttaaaatcctggagctcttgcatcttggagaaaaatcctgtagcttctttctctggggcaaggggcaaggctgtttggtcacactgtttagtgattcacagctgggaatcttctgtgtctgaacaatttcagcccctcataaggggttgatagctgagcccctgtgtcttagtcagtttcggctataacaaaacaccataaactgggtggtttataaacaacagaaatttatttcttacagatctagaggctgaaagatcaagatcaaggtgatggcagatttggtgactggtgagggctggcttcttcataggcagtgccttctctctgtgtccttacatcgtggaagggacaagaggcctttcttggacatctttcataaaggcactaatcccattcatgaactccgttttcatgacctaatcacctcccaaaggcctcacctcctaataccgtagccttggaggtgagaattttagcttatgaatttgggggaatataaccattcagaataaaacaccctggctatagaagagaggtggcttttcctctccccagacagcttccctttccccacagtccaaccggctgtctaagcttagggagctgcccctggggaagaggagccctgtcaactgcacccggaatgatggcctttcttcctgttcttcctcgttagtttcttcccacttctctaggatgacagagaggccccccttctcggttttctcagatagcatgccatttgctgtctcaaatctataaagagctgttgggaagtttctgtttttctttctttctttctttctttctttctttctttctttctttctttctttctttctttcttttttctctttctttctttcaaaaaagttcaattctcctaggtggctcacctgggcttttaataatgtttggctccattttaaacccctggctctgagtgtgctgctaagaatctattcctataggcgtttggtcattgcagggttaagaaaatttgagccgttcctttcctgcctatgttggggtgctgggtactgacagtaagagtgtccaggatgagggaatgcatgtttccagtgactcctgaagttttattcacctgttagggctttccatcccaattttcatccctttttgacaattcttggtaaaagctttgcaagtatggagctaatcaaaggatttctggctcccaacttgtctgctctttgttttgtttttgctttggttttttgcttctctggggtatgggtcttcatcttgtttgttatggcaagaattccctttagtgactagtgttgggagttgttagacccattgaacagatgaaaataaaaggggtctctagatctgggatcctggcactgagtgaagttttccttcagcgtatttcaaacacgtgcaagatcttcctccttccctgagacacttacctctcctttagttctcaggtgttggatcatgtcctctagaaaacttttccctatttaatcccatgtatttttaacccactaacataatccccaatgtttccatgtctttagttaatgcttgtaatatctatgtatttaagggcttaatcatgggcggttagatttttaacttctggttcggactaatacatcttttccagtgcatgggtacagatctcagtagcacacatggaacatttgctaactccgtggttgactcattcaagccctcccacgagtcagattacccagtcagccagtaaatgttggaggactcctgcacttcctcgtgggcttttctctcttctccatttacatttttctctcaaggttttgcatgaaactccaaggctttaaataccattgagatacagatgattttttaaattataaatccagtcttgacctatcccttgggctaaagatttgtagagtcaactgtcttcctaaatctttttttggaggtctaataattaccgaaaactgtaacatgtacaaaacagacttgtagcccccaccctgcacatctgtctctctcccagtcttcagcatgtcagtgcattgcagcaccatccaccccgttgctcaagctcatgcctcagtctcccctgactcttcccattccttctcccagcacattccacacaccagcatgtcctgttggctcttgtttcaagatacatccagaatctgttcacttctctgcactgccactgttccagtccaagcctccatcaactcttgcctgagcttctgtattagtcttcccaactggtctccctgcttctctccttgccacctaaaatctatgccccacatagcaggcataatgattttaaaaaatcagcatttgaccaaatcgaatggctgttcataataaaaactatcaaataactaggaattgaagagaatttcactaacttaatataaagagtataagaaaaacctagagttaacatcatacttaatggtaagagactgaatgcttttgtcctaagattggaacaaggtgagaatatctgttctcaccacccctattgaccactgtactggaagtcctagcttagtgcaataagataagtaaaagaaataaaaagtgtggagacttggaaggaagaaataaaactgtctttattctcgggtaacataattatctacataaaaaacccaaagaatctgtaagaaaacacctagtaagtcaatatagcaagattgtaggatacaaggtgaataaacagaagttaattttttcaatagaaagttggaatcgtggtaagctgcctaccttgccccacccttgggggctacattttagcttttactgaatggaatgaagaaagataaatacaaatttgtgtctttaacgaagaaaaaattaactgctttcctccataccaaaaataatctcaggaagtgattttgtagatacaacaaacttaatgtaaattttgtatagaatggcgaaggacctagaacagtcaccacaatactaaataagaaataagttggaggactcatactacctgatttcaagacttactataatataaagccacagtaatcaagacagtataatactggtgaaggaatacacaaatagatcagtggaacaggatagagagcccagaaatagacccacacaaataaagggacagtgttttcaacaaatggtggaggaacaattggccatctatattagaaacagagactagacacagatcttacatccttcataaaaaattgcttaaaatgaattatacacctagatataaaacatgaaacaataaaacttccagaagaaaacactggagaaaatctatggccttagattggtgatgagtttttctccttttttttttttttttgagtcgaggtcttgctgcactgcccacaccactcttgaactcctgagctcaaaaaatccccctgcctcagcctcctgagtagctgagattacgggcatgagccaccatgcctggttggtgatgagtttttagatattacaccaaatgcatgatccataaaacaaaaaattgaaaattttggctttattaaaattaaaaacttttgctctgctgaagacattcttaacatgtgaaaaagacaagtcattgaccaggagaaaatatttgtaaatcacatatcagataaaacacttgcatctaaaatataccaagaatcctgaaaactcaacagtaagaaagcaaatggtccaacttaaaaaatgggcaagagatctgaacagacacttcaccaaagaagatacacagatggcaaagaaacatatcaaaagatgatctatagcatctgtcattagggaaatgcaaattaaaattacaacatacctctacacacctcttagcatggctaaaatccagaaaagctgacaatactggcaaggatatggagcaacaggagctctcattcattgctgctgggaatgcaaagtggtacagccactttggaaaatagttttgagagtttcttaccatgctaaacatagttttaccacatgatcaagtaactgcagtcctagatatttacccagctgatttgaaaacttacgtgcacacaaaaacctccacgagaaggtttatagtacctttacttgcaatcatcaaaactggaagcaacaaagatgttctccagtaggtgaatgggttaataaacttgggttttttaaatacacaattaagctataattaatagcatgccccatgcataatcacagagtaaaacaagaaaggcccagcccattaggtcaaacatgctgagtgttgtggaacagcaaaaatctatttctaaagacttgaacagtagctggaaacataaaagttcagattattggctcagttggacttgattatatgagactagtgtgtatataaagaccctaaagttgggagggtatgtttaagagatacatgaaaccagcaggacagggtggtgctgacatcactttactacaaataaagttgttataaatccatatagtgggatactattcggcaataaaaagaaatgagctatcaggcgacaacatggatgtatcttagatacatattgctaagtgaaagaagccagtctgaaaaaacatattgaatgattccatttatatgacacttgaaaaggcaaaactatagaaaaagagcagtagttgccaggggcgtgggcagaggagagggttgaatagatgaagcacaggggatgtttttaaggccgtgaaaatattctgtacaatactgtaatggtggtagggtataataaaaatatacatattggatctttgtccttggttcccagcatggagctgggaggatacaaagaataataccaacagctctgagagtacatagggaatttgctatctagtcaggtacgtgttacagtgtctcttttcttctatgtccagtgagttcctcccttacttgttaaggacctaaactaacaatctagttaattaaccaaccaattccctcactcgtatttgcattagtgtttcaattgctttgcgttaaccttaagtttcaaaatttcttaagccggttttcagtaatctgcccttcatcaaattatagaaagtagcataacaaataggcttgagtttcctcatctcctggccctcctccgtctctggggaaaatattaaagacagaaatggtcccccagtgtagagctggagccaggaagcaggaatacagttgagggctaggataaccaaatgaaaagcagagctgggtgttgggcaaattggttgtattccgcgaatgcagacagctacacctgcaaagacgcaggaatgcagatgatcagataaaccaagttcaaagaaatgaggccacacttggctcgaaagagcggagaggttggtgggtcagtgagataattgtgctgcttgttcagaatctgaaccagtcccgtctgttatctggtcaggacaggtggcttgcaggcagagtttgggctcaggcaggtggcaccaagaggaaaatttatggatagacctttaactctggtcactttggagcccagcagctctggaaattggatccagatggatagtattttgatagcttctcctaaccaaggaatttatgctgattttcaggacccaaggggaaggaggaagctcctaaaggcaaggaattcataattgcttcttaccatgtttccaaaattcatctgtgttttcactcaccaccacagtcagggctggcacagggactggggaatgaaaaataaatgagggctcagggcctcactcatcacacgtgtgccttccatgggatgtcctggagcaggacagggaggagtgtggggaatagtctcctaattcaggaaaaagtctaggttgggtctgtaagatcttcctccactgagaaatgtattaatccttgccctgctcatagaagcaatgaaagaagctctaaacaccgggatggatgttcctccctccacatttgggtttttgcgtgagttaaactactggaagggtggagggttctccctctgtacggagctcagtacaggccaggagggcccatctatgtgaacacttctctgaaaatgaagctacttctggtcatagctctgctgttaactgtgtaatatgggtaaccccttaactgcctctgggccatggtgtcttcaccggacatttgcatgagagccagaggatggccaggaccctttcaagctctcatcttcaatgctcctagaatctccgttggaaaccatttggctctgctggaatgttacagaaagaaggcaagggcaattcttcttttctcatgaatgttttgggaattctgttgcttggaagagacttcaaagactgtatcttctgcttctctgtgagattcatctccaatttatgtcacaaggagatgggattttgaaggcatactaggtgatctccatccaggttttcatagcttttgcaagcacttactgagcacctgctatgtgccagaccttgttctcataagtcctgatttcatactaagacatccagacaaagaggtagcataaacaaagggcttgagccagtaaagatgataagcaggatgaagaatactgttgctcagtccccagtcagatagagcatccaacaacagcctgcccagctactctcagaatcctgacactgtggcccagtgcccatctcctttcctaattccaagcaagaaatcatccccaatactgacattcaccaacagcccttgcactgcttggggacctacaaaaggagattcttttcatttctcttccaaatttcatggcaagggcatttggaggagttagtggagaaggatggcaggggctttgagttgtcatcttttcttaggagctaagaattttaaattgtacttaattgctggtcacagtcaatggattctaagaatctgatgtgcttaccctgcacactcccaccagtccctcagcctgggccagccataaaaacacattactggtgtctgccatttggatggctggaggagatggcgtagtgagttttatttttacctgaatagtggggagccagctgatgtggtgcacctcgtgttaaccaataagcacctgatgggatttgcctcacgtcaagaggaagaaggggctcttggctctactgggccacatcccagttcagtgtttgtggaaggcattcaccttggagcttgttgcctgccaggccccactcttagggcctcttcgatgctggggagaatgatgtcagcaccacccattcctgctggtttcatttatctcttaaacataccatcctggcattggagcctttacatgctagtctcatataatcaagcccaacagaggcaatgatctgaccttctatgtttccagctactatttatgtctttagaaatggttttctacattccatagcactcagcatgtttgacctaatgggctgggtctttcttgctttcctctgtgattatgcaccaggcatgtaattaattatggctcaattctatattttaaaagcccacaactttggactgagattacaatgaacaacatttagcattggcttacctctgctttcacgtggagctgagagatggagttaggtagtagggagtgaagtttgttatgataggattgaaacctgcaggcagcagtattagataatttttctctagctggggatctgggggtggtggagaccaagaggtcaatcaccagcatgtaatgtggggccatcccaatgcctactgtcgttgccactcccaagaacaaagagcctgcttcctggatgactgggagccaaccatggtggaagtagggagtaaaaaggaactaacagggtcagctcatgaaaggttttgtaagccaagcataggaatttgaactttattctgtaggtaaagggaagtcatttgaagcagggaaatgatcacttcagcagctgtatgggtaatggattaatgaggagagactggaagcttggaggccacttaggaggccacagcagtaatccaagcagagaagaggaagctgtttaataggcagaattgaatgaacgtgttgactgaaagatagaaggagagggaggtgttgatgactccatgcttttggtttgagaagctggatggatgatgatgttaacaccaagaataagaaatccagtaggagggagaagtttgagaaaggaagaggatgccaggtccagtttgggacatactgaatttcagatggtttggggacattcaggtgtttcattgtttggccatgtaggtctagagctctgaagagagacttcattagagattacaagcaggggtgtcatcagcatcaaggtgctagtaactatcacgggcaaagatgaaatcagctaggaaagaaagcacagaaccatcaggagggaaacactcagggccaggccgaggcagagaagcttctggagggcagagactgagaagatgctttcatagcctggagtgaagtctgtcccatctgtcctatctcagttcaggctagaattctctcctaccctggggcctctctagtcccccagggccactgggctggctctgcagttggccacactgaggctgttctttgaccagtgtttctcaaatttgcacctgcagatgttgtattgttttgttttgtttgagttggggggagatgctgcgagtcctttaaagaacctcccatagcagtctgtgaatacgtattctgaggggtctttgagttctcaagttcaggaaactcagacgtggtcctggactctccttgcctggacttgaggtaactgccttggcctccctaagccaaagatgcatctgggccccatatgcgacccagggcttcccatggcaacatgtggtgttgtttttactactgcaactttttatttttctttagagctgattttttttttttccttttgagacagagtctccctctgccatctggactggtatacagtggctcaaccacaggtcaccgcagcctcgatctcccaggctcaagcggtcgtcctgcctaaacctcccgagtagctgggactacaggcatgcaccaccacaccacgctaatttttaaaaaattttttgtagagacagggtcttgctgtgttgccagggctgatcttgaactcctgggctcaagtgatcctcccgccttggcctctcaaagattttttttttttaacagctgtattgagatacagttcacatatggcccacttaaagaatacaattcagtgatttttaatatattcgcagatttgcacaaccaccaccacagtccatttagaaccttttaaaatcaccccaaagaaaccctgtacattttagctatccccttagcctcagcctctccctccccatcacctgggttttaggcgactactaatttactttctggctaatggattaatgaggagaggctatagattcccctattctggacatttcgtataagtggaaccatagactgtaactttttaggattgcacgttcccatctgataaccgaatctccattctggagaaaggatgttggcatagtctgggtgctttgctatctattatctcctctaattctcaccacctctttggaaagccagccttatcaaccccattttagttgagagtgctgaggttcggaggtgaaatgacttgtcagaggccccagggacagtcagtggaagcacgctgaacagggaggggcacccagctctgtctggctgcattcgctgagctgtcgctgtgctaggtgctgaagcagggctgggatgggggtgtgaagacagaaaatccaccagcagctcgcacgagtgggtcctcccagaatgagtccaggggagccccctggaccaaagcaggacagagctaattccaggaacaactgcacatttgtccactggttggagtgagcctcccccttttactgcatctccacgaggcagaggaagtggcagtggcctgagccctcagatacctggtgccctgggaatgttcccaaccagatgattatggctgttgtcaccaccaagccctgtcttgtcatcagcctcagtgtcaggccctgggacccagagacacaccccgtccccaggctccagcttcatggagcttcagaatcaggccctgttacacccactgcagggaacttatcatctcattataaaggataaggcatattttttcagtatggttatacgcggtaatgaagcatgcaggaaaccacacaagatagatggcagctttcactagtgaagctgaaaacttggttaccttaatagtctatttattacattcactctctgagcttacagcacctgattaatatctcccatcttctcccttgctatacaattaaaactagtaatatgtgattgcacatgctgactccagcacagatgggtgtgtggagttgaaggccgagataagaagtgaaggggtcaggcgtggtggctcacgcctgtaatctcaccactttgggaggccgaggcgggcagatcacgaggtcaggagattgagaccaccctggctaacatggtgaaaccctgtctctactaaaaatacaaaaaattagccaggcatggtggcaggcgcctgtagtcccagctactcagaaggctgaggcaggagaatggcgtgaacctgggagacggagcttacagtgagccgagattgtgccactgcacaccagcctgggcgatagagcaagactctgtctcaaaaaaaaaaaaaaaaaaaaaaaaaaagaagtggagaaggaatgttcttcctgggtcatgatagaggagtcagatcccttgctggtaagggagtgatcttacagaattaattacactcgaggagaaaaggaccctatgtccactgcccagtctcacccattgccgtggcttctggcaggggagtggtgaagcctgcacagagagaggatatcagtggaggtggccatacggcctttaatcagcaaaaggaaagatggctggactttaactcatttgcttggatgagaatgtttgaggttgaattcgattacaatgatgtagctactcaaaagccgctcccaacttcctgctcccctgcccacctgctcctgaagagctgagcatttggccaagttctgaccaatgagatgtaaggagaactctgctgaggggtttctgggagagatgctttgctttttgacaaaatggcaagtcacattatgagaacttgctggtgctgccctctgccccttcttcctgaatgtggatgtgatgactgagtttgggctgccatcttgtgagcatgaggatgaaaacgtaacatgccatggatggtggagaatcaccagggagagcctaggttcatgattacatcacccagctgacagcccaaccctggggtcatctacttctggaccttttgttaagcaaacaatatatagccttgtggttgaagccacagttagaagggcattatgttccttgcagctgagaaacatacctacataatctaaatggctccatttattgagcagcatatgcgtgtcctttgctaagtgctttgtgttcattttgaagcttcaaaacatgttccctttaagggagctactatgacctctgttttataaaggaggacacgagttttaagtgtataaggtcacacacctattccaggaaagagcagagctaagatttgaatccaagtctttctgactagagagttattactattaatcataatattgtgactttgtagacagttcatctcaacactgaactctgggaatgagtgttacttaaagtctggttggcataatagtactcagtataaatcacgaagtttttccacatgacccactaaaataaggtgaaattcagtcttattggtgattgaaaattgcatattttttacctgcctcaacccactccaaatagccggggttgaaattagtttagctaacctaacttgccccagccaattggatggccaaaaagtgaaatgtgtatgaagggaaaaggtcccagagagagaatttgagttaaaagaccaccagtccgagcctgtgtgcagcccatctcatagcttttgagtacaaagcaggaagcctctccttccgtggcatttgaagactcagagcaaggttaagatggctttgaaacctgggtctggttctcccagaaacacttctgttgcttctcctcattaaagaaaacattccaagtgtgcaattgttctctgagatgaatttctcaaaacacatgtgaactacttgagactattctaattcctggaggtgcctagtcagtgctggccatataacagatgctcagtaaagatcggttgctttcatgaccagtgagggcaacagaaaaaacaaaagatctcttaatgaatatgattcatcctcctagcctcagtgaaaaggcaaaaaataggctgctttcttggaaacgtgccagctaatggtacttagcatgcaagggaccgcgtactgatccatacccattagcccaatgctcatcaactcttctactggagatatatatatatatatatacacatagccagcagccaacagagggacttggccacatgctgattctctctcccctcccagtccatcagaccattattcagcaggaggtagtagggtcttcccctccctcttatgccctttagggcaggagctatctagagagggaaaaaaagtcagaataaacatatgcaaggactggggtttaaacatcccatgaagattaacttatctggagtaattgccttaactaggggatttttaatgcttttcaaagttttttagaggaagaaaaatatgcagaatgagtcttaaagcagccaacagaggagatacttagagcaaaaaaaaaaaaaagatatcaaccataagaagcccatagctaggaaattttaaggcactgattctaggggatttaataagaatgtaatttgtataattaaccattcatcaatgtcaatttcattaaatgaatgccagaaatattaccttcagcagcacgacctaacaggattgaatatattatatgaaaaatgaacacttagtggtttcccccactgctctgtctgtcacagcaagatttgcaaggctgagaaataatttaaagggtagtaaatgaaaccggctaaggcaaatgtgtgcattttggtaactaacctccgtcatgatgtatgagagttcatgtcaaaatgttttcctgcagcaatgactaaagggacttgtagctctctcccaggtggcaaaatgtgagaaataatgccaggaacttcccaaaggtcccccttgtcactcgcctggatacagcttactctttccctagataggctgcctagggtctaagaccagaagccatgtgtttttgtgtccagaatttgtagaccttcccttcatacctccaggttagccttacatccaatcacttgcctacctgtccaggaaaagtgatgattgatgtgcaggagacagaaatcattctgagttttatttatgttattgcctacagtcatcaggggagcacgaagcttgaggtaggtgggctgatgaaatatatgtaaataggacttatttccaaggttgctcatgagggaggcagtttatggagggaggcagtttatggggatttatccatttcagtgcatcataggaaaagtggaggacttgggagcgggggctgtagtaacttgtccatgtgtgtgctcctgggaatgtatatacagacacacacacacacacaccagatcaagcacacactggagatcagtgcttgagatttgcaaattgttgtcactggagttggcctggtgcctcgtgtatagtaggtgatcaataaacatttgtttaattgaatttctcttagtgttaactccactcccattctcttctgtttcagggttctatgaggctgaaaatattggatcagtattcctgaggaatctgcgtttcagaatcccaggtccggaaggacaagaagtactttgcaaacaaatcaaatgtacgtttaggaagatgaaatcatgcaacagaaagatttttcagaatttttcagcaacagattttacacacaattcagaaggaagaaagaacagatgagtttgggaatcaggagaccagatgtcaagactggactacatctttatattcatttccagatttaaagttctatgttgtattttatttgatgcaaagcaataaaatattcctccctcctgtgaccaccgaaaaggtcatatttaggacctgggtgaaggaagagtgggcatcacagagctgctgtggagtgtgtgcacagattctgtgtactaggtctgtgggctctgcaagactcaaaatcaattgctgaaacacttcttaaatgtgttccctcctatgcattctgctatgcatagtcgccctctcttccttctaggttagagtgggtgacactgagcatgtaacttaacctctctgaagcacagtttcctcatctgcaaaatgaggatgataatatcctcctcccagtgttgctgggaggatgaagtgagatgaatctggtgatactgagtaggtgtgcaatcaatatttgttttttcctgccactcctttaccaggctttttttcacctcaaatgagtgatgacctctgagtgcggagcttttttgtcaattttttaaagacagtggtccccagcatttttggcaccagggacaggtttcatggatggcaatttttccatggacctgggtagggggtggtttctggatgaaactgttccatcatagatcttcaggcactagttagattctcataagagacacagcacacagcctagatccatcacatgcgcagttcacaacagggctggtgctcctaggagaatctaacgcctctgctgatctgacaggaggcagagttcgggcggcaatgttcactcacctgccgctcacctcctgctgtgtagtctggttcctaacaggctgaggaccggtaccccggggctggggatccctgttctatgaggatagaaaatctggtaaagtaattcaccctaagatgccattaaattactatgacctcctgggctcaagcaatcctcgcacctcagcctcccaagtagctaggacttcaggcatgcactactatgcctgggtaacttttttgatttttattagagatgaggtctcaccatgttgcctaggctggttttgaccccctgaactccagtgatcttaccgcctcagccttccaaagtgttgcaattacaagcgtgagccacagcaccgggttactttgttactctttaggggtattggaaatattaagaaaatacagcagggagagattgatttttaggatttaagaagaacaagaatagttttgggagttctgggagctacttccaagggcatgaaccaaatctggaaagtagagttggggttgtgaaatattagaacgtgtggatagtctgatggtttgcaagtaagtgggatcgaccgtggggtctctggacagctccccagagggccgtggtccacaaagggaaacactgtcccatccaactctgagaaatgggtctgggcatccactgctttcaccgagggtctctgcatgactttaggaaagtcactagacttctttaaccatttctttcttatctgcaaaatgggaagagtaagggcacccatcttggaggagatttggcacgtgatgctcagcacattgcctgacaatactaagtgttcaaccaatgctcatgattggccagggcattgacggcagaatcgtaaggatcacagagacctcaggaacatggctctgaaggatagaagctgaaaatcagtgtgctgatatcaccccttttgtctatgaggagtgaatgtctccaattaggctgcattcagcaggcctggcagcctcctctctcttgggatgcaaactgcttatgtggtagaaacaggaagccgtcttgaaaccctcgccaggccccagacgcgcgtgggtccacctaccgtccatctaccggggtcactgagtcactcctgcccaggtcccccttcagggactgtcgtgggctgtggcctcagaggtcccttacagggtggtgggacccagggcccagggtttggctccgggtttttgggcagctccgccttcataccgaaggcagcttagcatggcactgtctgatctgctgacagccgcgaccctgccacctgctcagtgggatggcatcttgggggagcaccttgggcagggctgcccagagccctggaactggactctccctgtgcagggctgatgggaaggaggtgtgtgcaatatggtgggaggagccgggctggaggctgcagactctgcctctgtgcccgttctgggaaagcccctgggcttgctggacccatttctgcccttctgaaagcgggagttagactagattggggctttcaacattgctgatattttgaacagcagaatccttatcacaaagccaatggaaacaaagaagtgatacattaaaaacacatcgaagcaaaacctcctggttgaactggcttccctgcccctccaaagtggttccaaggtgcctccacaaagcctcagggctctgagggtgttagggaaaccacaggtgtccacaatgcctgccatgctatgatttcatctggccgatgtgtcacttcagtattctgatgaatttaccctaccaggccagtcagaatcgactcactgatgatcaaaaaagagaggacacttagaattaaattcatttctttgggccagtctcctttgtctgcacttgctgagaaggcatttatgatgccagtgtgacttatagttatcctggtaggtactgaagcttgtaaaggccacctaatcactttgctttggtattcattagtcatttaacacctctaaagaaaggaaaggtgcggcaggttgcgtgtgcgggaggggagaggtagtgttggcttggaccacagcgggagggacctgggaagagggagaagttgatggtctggtcactaatggtcctcagcaggacaggcttctttgtccttgtctcccccctcccttttgtcctcttctctcttcctctctccctcatttctggcttccctctttttctccttcctcttctcctcctctaatatggaaggaacgttagacacacattcctgtagatgctggagtggaaaggcaggttggaggaaatacaaagatgaaggacatagtcaatctcttcaaggaggtcatggccaagtgtgcaaggggacctcgaagaagcccagtgtgacaaggattgagaggtgtgctcaagatgtgctgagagcagaggatagccccagctctgctctggggagtcaggggcagggcggcagatgcttggggtcacatgaacacacaattgagcaacaaaacatagtcacacagggcctgcctcacacccagcactgggtgggttttgtgcaggagaacttcttgcaggagacttggagacagaaattctttgggaaggagatggggtagctgccttaccagagagagcgggatttctcagacactgctaacttcccacctccacacaagctgatgagactggctcagaaaaggggtctgcccccagtgcataataatagcagtgataattaataatctatagttaatgagattaaattaattattattttaattatgacatgttttcctcctctctttcccctgccagggcaggcttggcacttcccaggattacagtcataatggtaacagataaaccttaattaaaacattccaaaataccatggctgagttaaagtgctgtgacacgtcgtttccatctcattttgagatcttgcctatgacggcaaatgtctccccaccgtcggcagcatcttggccattcagagctgttgccctcacagcattcagtgatgtttgccagagtggctccacgccccttgggggcagatggccgacccactggatcggggccactggagactttttccctcatgctgggctcttcacgtggcatcctgtgcctgctcaatgctgaatctgcttcccatgtgcacagcttactcctttgctccacccggctctgcctctgttcccttcacctgcttcttctcaggccaaggtagacctgaggaaaggattgaaaggattgtctactctggctctgtgggcactgttcctgaggtgtgagcaaaccctgcctcagatggcccccgagtccatcagcagctccttccctgtggtccgagttactggcagggtctctgcgttctgcctttgtgttgagcttctcctccacagcccacccacctgcaggggctttctcacgtgtggcgcgggtgtggaggcaggtctccatggattgtacggctttcccaaggcctgctccagactggtggcctttttatggaggttagcattcttttgttagtccactcacatattttcactcattactaaacatttatggaccattctaggaactgtgcttggtgatgagctgcagagacagaagacaccatcctatttttataagccttgtgggtctgtggaagagaatggaagatacacaaaggaagggagtcccaagctgaatgttctgatagggtcagtgctggccactgagcggggagggtggggagggactgtgcgttcctgcgcatgttaccctacactgaattttatttttttattattttattttaattttgagacagagtctcactgtgtggcacaggctggagtgcagtggcgtgatcttggctcactgcaacctcggcctctccagttcaagcagttctcctgcctcagcctcccaagtagctgggattataagtgtctgctcccacccctggctaatttctgtatttttagtagagatggggcttcgcatgttggccaggctggtctcgaactcctgacctcaagtgattcacccaccttggcctcccaaagtgccaggattacaggtgtgagccaccatgcctggatcctacactgaattttgaaacataagaaggagttatccagatgataagaggggaaggaaggtcacattgagaagagtcaaattcagaaggcctgacagagatgacatccctggaactgcagtagaggagtatggctagaaggcaggacaatgaggatgacaggccagaggtgaggttgcaagtgtggttggggccaagaccacaacacgtgttcaaggtatgtctaagaaggctcaagttcatgaatgggtgcatcaaagaaccacaccccagaaataagctaagtaacacctgcaacactgtcatcaaacgtgctgagccctgccttgcgccaggcagtgagctagtccttattttcacacctggctttcttgcctaagcaaattcagagtcaccctaacttgggtcatttgcatcacaaaattgccttcaaattagcacagagagggaaaaatcaacgcatacctcccaacataacatccccaaatttacctagcccagagttttaaaaaatttatatttttaaccttgatacccaagaaagcaggaaatctcacccagctggaagctctcctgtaaagaattcacaaaaatccacaccaaaacctctagatattcccatggagctgctagttctggaaacactatgggggaaattgcagggttttctattagtttgaaggaggtctacttcctaagacattcttctgctaccatctcttgcatgctcagttcattgattgatagagtaaatcattgatatttttccccattgcttcattcaacaaatttacattgcactctcctacatgccaggcattgttttggatgctggggatacaaagataagtgctctgaggcccctattctcagagtgctcagtccagtgagaaactagaaaagtctgcaggtaatgacaggcaaagagagatgcggtgaaatggccatgggagcacagccttgaagagacgcctgtgcaaggcacaggctccactgccagcgagggagaaagccctcctaggcccgaagcagcaaaagaaagcatctagaaaaaggaaataaagggctgtaggtgtatcaaaggtattccagtgccagttaaatttgagagagaaatcattttatttacgaaaatgtcaaggggaagaagatgcataacttctttaggaacgactcctgcctctgctagtatgtcaattccgagaggcctaaaataatttgggcttgaagatggatggaggtggagagcttggccttattgccaacactgtaaattagcagtaccaagagcagcctgtcccacttctggtctctggctacctcttcacccagctctggccacagtcaggtgatctctgatgagtgcattcaatcaccttccttttccatttggaacatgattgtgtgcatgctgtacataagcgatattgattgcaaataagttgttgactggaagacatgcctctgtggacatgtttgggtgggggatagaggggaaataaaattaaaaagagagtaagaaaacacctgtggcccccagttggaaacttctcaaatatttgaagctaacaatgttttggttgcctatttcttttttcttttttttctaggagctaaacgtcaatattgcatttattgctgaacaaactaaaatcataacaaatataataaaaggagagagttagcctcagctttctgcagagaatgattggcacttttgagccctggattggttgggcctttatcttagctgcgtcagctcataattaaacaataaaaggaggaattgttacttgcttggaatatatacagtcagttttctgtaaggtgggggcagtgtgtattttataagccctgttgctgtcccagttttctgtaagaagggaaatgtgggtattttataaactctcttcttgtctctgtcagttctaaaagactgagagatgacatgatagctgtcacaagaaatttctgcttaataacaatgaacactcagagctctttaggccctgaagaggaatgggaagatgatgagggaggaggaaataaaagcaagaaaatggtaggacaggaagattttttttttccgctctcaatcttgtctttgtttggctgaccatagagcagctatgtagaactatgtgtgtgtgtgtaagggggagagaagagagagagagagagagagagagagagagagagagagagtattgtaataacgtattgagcatgagctgcctgatctttgccaggtgataaactggcccactgtgatcttgcaggaaacatcaacagtctgagaattgttgtttcaggaactagaaagaatcctggaaatagttaagaaagacgattttccaatggccaataccttctcccagtggcttgtgagattaagatttggtattggaatttgtcccatctcgacttggaagaatgagacaccttggaagatgaggctgaccaggccatggagctgcccagaccccctgggagcccagagtccccatccttgcatctcatgatctatcatttaacagccctgtccaaagtgcttgctggagatcacagggctaggccacttctgctccttgcaagctccaaagaggaggtctcctatgcacccgaggaggatgagtcttcagagtttccagctgccttcttgtcacctggctctaccttaccttgacactcccaagtgtagacatgcctgattattctatccaaacccagccaggagatgggaagagacatcttgttagccagttgctctggtagcctgcattgcaagggcctggcttttacgcagtttcgcttcaagtcagtgcaactagctacctgtcttcctgtcacttttctttggccacctgggtctcagcagaggccctcccaagactgacaggttagcacggaaggtataatctgctagtcagatttcacatggctgcacagagaatcggtgcccttggcaggtaagtgaataaatatgggaagacatttgctattaactgcaaatggcaagcagcatcttagaaagctagttagtgaaacagggatgggagtgtgagagttgatgcttcttttagaccctatttgtctcccggcctcacactgccttcctcttgctcagactttccctcttgcagtatctcctaagtcactggaggaggcccgagaagaaagccacgacccccatttgtgtgactgagatgttttcccagcgtcagtctctcaacctccccagtttcagctgcactacttcagaatgggacctctcctggctttatctgtagtgcggactatgtgtaagatcactggcagtgagtgtttatgcgccttaattcatgtatgtgctgatagcttataccccatctctgtattctccatcagaaacccacaccccagcagggaaattctttgaagcctaaatacttaaccatttctttggctccagggaatgtttgaaagaaattagttctaagcaggggttttttttttttttcccattagtttcagagcagttttagggcaagaaaaataatcccccttccctcagtggatggataatgatgggaagtcacctcccttcccctgggattaacctagaagggctctggttgggaaaatgttacctggttctttggggaaggatgacggttttgtgccttatgttttggggttttctgggtgtccctaggtaaccatctgtgagagcatcttgggcttggagtttttgtcactgtgaacaccttctgtggactcaggtgaattctccagttggcaaaagagggaatgcaggcttcgctgactaatccctgaaccagctaaggacaaggccttagaaagtttcgtctacaataaagaagcttttatctgatgtcgaggaatctttaccagtagctgctgtcgtgaatacaagtgcacctttatggcccacagtaagcactgggggattttctgtgaaatccttgtcatttcttttacccattttcctaggaagtgagttgtgctcttgtatatgctcttcacactgtgcgaagtcagttacgtgtgtggcaaagaacttgccttggtttctaacttgttttacactttctttgcagtgtcttgatgaacagaagttcttatttggattaaagaaacacatatggtcaataaacatatgatgggatgttcaacctcattaatgatcagggaaatgcatatcaagggcacaagagataccaatctcacccactcggctgttaagagtatggaagtatgacaatatcgggtgttggagggagtgtggatctgcagaaggttttgtgcagtgctgatgggaaggagaaattgtacagccactttgtcatgatctcgtaaagttgatcattcaaatgctccatcatccatcaatcccactcttaggaagtcagacaagggcaactctctctcacgtataccagcagacatgtatgagaacggtcatttcagcactatttatataaagcaaaacttgggggcaatacaaatgttctctgacaggagactggatcaatatattgtggtgtgcctatttaatggaataataaacctcagtcaaaatgaatgaacaatagtcccatgcaacaatatgaattagttttagcagcagaattcaagtgcaaaaagtctcagaagaatgcatattgcatgataccctttgtagacggttaaaataaatccaaactgaaaattcttctttttttaaaaaaaatatatgtagcagtagtaaaactttgtttgaaaaaagggaaagcaagtcaatgatgaacataagattcgagaaagtgcttagttactttgggtagaggaagagaaaggatgcattgaagattgatgttgctactctagttttcttgtttgtttggtaatttaaagaatgtttattatagtactgaagagaaatacataaatacagcaataaaaaatcaaataaccagatttaaaaaaaatgggaaaaggacttgaatagacatttctccaaagatgatttacaaatggccaagaagcatatggaaagatgttaaacatcactaatcatcagagatttgcaaatcgaaatgatagtgaggtatcacctcacacccattacgatagccactatagagaaaagccagaatatagcaaatgtcggtaagagcgtggagaaattgggacccttgtgcactgttggtggtgttgtaaaatggtgcaactgctatggataacacaatgaaggttccttaaaaaattaaaaataggaccaccatctgatgcagcagttccacttctgagtagacatccagaaacattaaaagcagggtgtcgattcgcacacccacgttcacagccacactattcacaataaatagctaagaggtggaaataggctgggcacggtggttcaggcctgtaatcctagcactttcggaagccaaggcaggaagatcacttgaggtcaggagttcgagaccagtctggccaacatggagaaaccctgcgtctattaaaaatacaaaaattagctgggtgtggtggcacacacctgtagtctcagctcctcaggaggctgaggcaggaggatcacttgaacccatgaggcggaggttgcagtgagctaagactgcaccaatgcactccagcctgggtgacagaccaagactctgtctcaaaaaaaaaaaaaaaaaaaaaaaaaaaaggaggtggaaacaacccaagtattcatcaatgatgaatggataaacaaaatatagcatatacatacaatggaatattcttcagctttaaaaaggaaggaaaaccttccatatgctacaacatagatgaaccttgaagacattacgctaagtgaaacaagccagtcacaaaaggacaaatattgtatgacttcacatctatgagggtctaacatggtcagattcatagaaaaaacagaaagtaggatgttgattactagggacaggtgacccctccttggatctacccgctttgcaatgtgactctgcagctcttcccaccaacaggtggagactgctttcccatcccttggatctgagctggcctggtgacttgctttggcccatagcctgtggtggaagcgaggctgtgctggtgctgagccaagacctcaagaagcttgcatgctcctgctcacgcccttggaaaacagacatgtgaggccatcctagaccagccaccctctaggtgaccctccaggtgactgcagatagatgagtgagtgcagttaaattcagctgtgctgggccaggcactgtggctcacgcctgtaatcccagtactttgggaggcgaaggcaggcagactgcctgagatcaggagtttgagaccagcctgggcaacacagcgaaaccctgtctccagtaaaatacaaaaaaaattagccgggcgtggtggcgcgcacctgtaatcccagctactcaggaggctgaggcaggagaattgtttgaacctgggaggtagatgttgcagtgagctgagattgcgccattgtactccagcctgggtgacagagtgagactctgtctcaaacacaaacaaacaaacaaacaaaaaaacaacaaaaaaactggctatcaggagatgaagaatgcatctgaaagtcaacaaggagagaaagagactctgccggcatgccgtaaaagcgtgcaagtcatggcaggggaacacataagtgtgttacatctgtatgcacatgcatgtgagtgcctgtgaccacacacacacacacacacacacacccatagtcagaggaagcctcaaatcaggctgagtttccgaagggaaaatctcatttgtccaccagtgatagcgtatgtagccttctacattaatgtaaattgaggcaggattaccttctagtgataaagtcgcatctggtagcagagaaaaagtgagtggaaacggacacatttccaatcaggctctggcctgggctgcagccccactccgctgaacacctagatacacctttttaaaacccaggatccttcgggctcagcctcctagtccttgccccttccccagatcccacccctgtctgcccaccttgtcttctcgggccctcaaaacttaagccagaagtctgggcaggccagtagaggaaggagctggggcccaggcagccacaggttgaagaggcggagggaagcggcacagctcacagtcacactaggacaacttggaagttgaattggcaagttgcagcaggagatgggagcatgggctccatccctaagggagccacattcgttttttttcctttcaaagtcgtcaggcagtaaaagaaaattgcagggatggggaaataatgaaaaaggctctttgtttttcccccagtccgaactcctagctcatcaaaccttggaaatgctcactgcaaatggttgttcttgttttattgcttatttatgggaatctatttaaagtgaattgcacttttccattgtatcctagtgagcgtgcaccggagttgtgtctcccctggctgtggggctgtctggactggggattctgtctgattgtgtcagcatcacgctccgtgacatttaaaagtggggaaggaaaatactgcagaggaagcagggcgagcgtggagaatgattgctcaggcctccatcagctccaggcgggtgtggggaatgctgttctagggcaggtttgggggtgctgactaggccttcacacaaagaggaatctgctcttgtggatgaatgaatggcggtgacaaatcaaactttaatctggctctgctgtaagcattgtgaccttagggcaggtactgacttctatgagccaccttttttaaaaaaaattctctacagagaggtgaatactgggctgttgttaataatgatgatggaattcattatatatatgagagtgcttactcagtatcaggtagatgctcactaaatgtaaaactcccttataagggtggctggaatggggactggaagagacaggtaagtccccaacctatcttcattttcttaacctatgccttttgactcaaaaagaatgaaggctccctcactcctttgctttgattgggagatgagatgcgagtctcaatgcctagaatgctctatagcaggggtcagcaaactggctgaatcgggctgctgttctggtagctaaagcattatgggaacccatccctcacccccttctgtctgcgagccatctatgacagctttcctgctacagcggcagagcaggatagctatgaaagagaccgtggggcccacaaagccgaaagtatttactttttggccctttacagaaaaagtttgccaatccctgctctaattcattggtattttggggttctcttatctgtgtgatcagaaggtctgagcctcagagaaaggaagcagcaacttgtccaagatcacaaagttagtgtttgagttagaactgcaatcaggtttcccaattcctggcccagtgcttttccattgtttaactgtaccatttcacagagatcccaaagccattgggattagctttaccaaaaaaaaaaaaaaaaaaaaaaaaagagtctctaagtcacgtggcatctgagctccatgtgattggtaaagttggcattagtccctgccacatttcccaagtccccaccttctctgctcaccacaccgctgtctctccaggctcagcaaatacttctagagacaccggtgtgtccttgtcctgaaacctttgtgagtcagctgcattgactcctgctccaggatgacgagggccaattccttgatgaagggccatctgcctgtgtctggctgcctgtctgtgagctttcgtgtcttgggggctctgctgcattgcaagaaggagctgggacagagctctgagagaggggaaggaggcagggagagggagtttgattcctgaagaatcttccttttcccatgaagacaagcaagctgatggccagcgtagagccacagcctggaaaactttatttttaaatttatttttggtggggaaagagttgggttagctctaatttacggcaacctccccagttccctgacactgctgcctcctcatatgctttgctaagaaaacctggatgagtcgggcgaggtggcttatgcctgtaatcccagcactttgggaggctgaggcgggtggattacctgaggtcaggagttcaagaccagcctgaccaacatggtgaaaccccatctctactaaaaatacaaaaaaaattagcctgacatggtgacacgtgcctgtagtcccagctacttgggaggctgaggtatgagaattgcttgaacctgagtggcagaggttgcagtgagccaacatcccgccactccactccagcctgggccactgagcgagactctatctcaattaaaaaaaaaaaaaaaagcctggatggcctagtgcttccttattgcttaattaacccttctccctttctttgacccttctcctccttggttgccttgtgtggttgatggtgacatcatccatccaatttcttatcctgtaacttccaagttacccttaactcctgcctttgcccaatccccagccttctatgagataccacatgcagcctgcaaactcccacagctgtacgcaggcatgtggcctcttgcctcgacatctggccccaccgtccaacccacctttcagcctccaggcaggtcctcacctctgccatcctccacgtgatccccaaacgttgctgatcaacacaccacagctggaatccacagaggcgccacagtaccgaaagggtggctcaaaccacatcgcatggctcataaggcccttggcgagttgacatcaggctccctctctcccaaagccacaccgtcttcctgcaggcaccgccagtggacacaccgaacacccctcttgtccaaacacactgcagctccctacatacaaagggcaggagctagactgtggaatgaggttgactagcgcttacatccagacactactgtaccacttgctttccgggcagattatcttccctttctgagtctcagtttcttcatctgtattaatggagatgacctaagagctgccctgaggattaagtggtataatgcacttaaacatgacaaaaaaaatgcactaaataagtgtcatctccttcctttccagcctctgcctgcacaaacccactgttctttcgctcagggtgctctgccctgcgactcagcctccttcgggctgcggcttagcatgttcccctcagcctccttgcaaatgaaggcttagtcacttcctccgctggtcccccagacctgtgttcacctggctcacagccctccttaattacaattgtaattgtttatgtgcttgtttatgcgggagatgacaggactacaagaaggcgggacttcctctattgccctaggccctggggtgaactgcagccagcactggccttgccggctcactgcacagggtgggcacttagtccctgacttggacaagccactcaacccctaggaacctgttttcttatctagaacatgagggtaatagttcccagttgccaaagcttttcccacagaccctgactcagaggagatattcaatgaatgctggttctactctacctttccagggctaagtcctacgactgtgacacaactgatgctcagtggctctttgtttaatgaatgaatacatgaatagtgattagagatgaggccccaggacctatagctttagatccaaaagaggtcagaagatttagaccaaccctaataacctgaactcatgtaaaagtggctctttcctcccagtccaaaccacaaatcctaaatgctcattcagcctcacttgccggggactcagcttctcccggggcctccgggtgggtcccatgattgctctgatcacctccctattattggatattaatcaagtcctactcagaccacaaacaagcagccctgctcttgacagtcatctgaggatctttgttggtgatgaggagagtgggaggaagggagagtgaaggaagaagagagggaaagtgatgagaagagagagccagggaggctcagagactgagcaagtgccaagaagggaagatgacaacgctggtgaagtctgaacaaatgcaaagtcaagcacaataataatttgggcaaaatggcaaatggcacagctgaggaggaaatagcattgtgaatgtaaaaactcctaaatggagcgcagatgggagggaaaagtgtaatcttctggaaaagcctctaattgtctgcccacactaataatttcagcaaacgctccctctctccctcctgcgtataattacaccattccatctgtctatcagcaggttttttactgtgccttactgctaccacgttctcatgctcacggagagatgaggggtttttgaagatttaagaatccttctgacacatatcctgaagaaaaaacactcaggcagacaaatccctctcccaggcctgctaagactctattttaaaaagttgtataatctctccaaacgctattatgaagtccaaaggaggcagggccacatggaccctccaccttgggtgttctcatctgccggcttgtcttagtaggtcagctctggagagacgacaggtcaggggctgcagggagaaaggggctggcagagacaccggcccgtgcatcccgcaggtggcaagtcataagagcatctgctcagggctatccctttagagtgtcttaggtgtcaaggccagggttctgctgcgtgaggaggaagaggaatgcaaatgaaagagaagaagccagccgggagtggtgggggagtgtctgtggccatgtattagctcagctcagctggcctgaggagcgctgcccagcgcccaaatccagggctctgagtgactccaactgccattggcttctctccctgctctggcagtgagttccagagaagacaggtggcctcgtgcacagagcccagtaggaaaggctccaggtttcccacccaagtcactgcccttcgtgcaggaggtacagagcttcccatttgcttgctccacgggcaggagctgcgatcttaaggggctgggagctgcctgcaggttcttcatcaggaagttttcttttcatgtgaaaaatcacatcccagctcttctccctttcctttccaataagtgggtcctaagtagttactggaaggggtgccaggagagaggcaggacaggtcaaaaaggggaatgaaggccaatgcccccaagaggatcttgaaggctagaggtgtggtggtggcagtgggtgccacgaggtgtgacctattcaccagatgtggattgggccaaggaaatgtcacacagaggcgattttgacagagccagagcccctccatccagcttgtcctcacatagcctgatatcataaccgcatcttccccagaattgctgagtggatggggagaagagttgactcacatcacaattcattcgacaaatattgatagtgttcccacaaggtgcagtaaaggctgaatacaacacgtttccaattctctatggcagcaacatctaatagaaatataatgcgagctgcagctgcaattttaaattttctagtagccacactcagcgagtaaaaagaaatgtgaaatttcttcgaatagtatgttttattttagtaatatttcaaatattattaattcaatagattataattataaaattatttgttagctattttacctttttttaggtaatgtcttcaaagtctggtatatatttatatttccagcatacttcagtttgagctggccatgcttcaaatgctcactgccacatgtggctagtgatgagtgtatcagatggtatagagccagagcttattaaggagaaaaaattgtatgtataattataattctagtatgtgcattattattattatagtttaggcccgcgaagtaattcgctaaacactttcacatacattatctctgatcttagcaattttgtgagatgattagttattgatattttttatcagataaataaaaataaggccggacatggaggctcatgtgtgtaatcccaacactttgggaggctgaggtgggaggatcagttgagttctggggttcgagaccagcccgagcaacaaagtgagaccccatctttacaaaaaataaaaaaattcattgagcgtggtggctcatgcctgtggtcccagctacatgggaggttgaggcaggaggatggcttgattccaggaggttgaggctgcagtgaattatgcttgtgccactgcagctcagcctaggagacagagtaagactttgtcacaaaaaaaaaaaaaagagagagagagatattcagagaaccgaagtgacttgtgacttcagagcagtaacttgacatccttatttcctactttctgaaacaagtatatgtacacacacatttttctgtgtgactcagtatggcacattggaagaggcagcgtaccaccttattttcctcttcattacagctgctttcttcttaagaacactctgaagaacaggaccggaaaacgatgtgaggtccccacactgtgttccacatacaattattagattggtgcaaaagcaattgaggtttttgcaattacttttaatggcaaaactgcaattacttttgcactaacctaatatctccctttactaatctctgctgctgtccccagatcagctgaggccccacctttggccgatcctctgcctcctagcctttctggcggaccccattcttagaaggctggggagtgggcctcaggaagcagccggggctctgaggagcccaggcattgtcttttctgtgagactcatcccgctattcagcaggtgaaacctctccgcctgtcattctctccccaccccataatgtgcaacaggcctgactttgtgatgggcaaatatctctctgagatcttctttacaggcattcaccccccacaccctcctcagcagtcttgggctaatgagctcagttcctttaaacccagctcctgcctcagcccttctcagaaacttatatccggccatgtagacaaagctagaattaaggcttccagatttatttcatttaacaagaacccacaaagccagcccagtagcccattcatcccaaaatagcttctgaaagcctgaacatacgtcagtgtctctttgcagaaaccacactgcattgtcatgaaagggccatttgaacaaggtagctacaatgaaattatctcaatgcatttcaatcactttgcaacatcaaggttcatttctcagtaacagtctctttgacaataaatgaattgcgtgattggtgtgtgtttgcgtgtgtgcatgtgtgtgacaccccttcatgatgaattcctgggtatgccaatgttacaagtgattggtctttgcatccatctcttagcataaatccccagcatcaacgtgacatgttgagcagcaccgagccccctggattctctcagtcttggtgagagagggagtggggactgtgttcacgctgttacaaaaggacatctaagagggacagcagggaggaagctgggcagaaatgctccgaatcaatagctctttcttcttggtggcttggagcttgcaatctctcagcctgtgtcgagtcatcatgaaactgaagaatccttggaaagtcactgggttgggcacttttaaaagtagagtcttttctgttctgcttagaaactctcatggcatgctacagagaaaagaggagcagaggcccacagagctcccttcaccagagaagggagcgaggaggtcagagggtggaggaggtgggctgggatctcccagggcagcacctgggcggagttctggagccactcccagcctggggagaagccctgcccctactgtttgctaaaagtttggacaaatccttctctgccctgtacctcaggttttccatctgtaaagtgggaagacaaccatcccacagaggtgccatgaaagatttttagggagtacctaaaaggttctttaggtgctagtcaagtcccggggtctcgatgtgtcattaacttgctgtgtggtcttgagcaagttacttaagatttgttaggtctccttcctttctttataacagggtaataacctacctccctatttaacttatgagtaaagcagaatggctgtgagagtgggcctggagccaaagatacctgactgtaaatctgagctctgctccatcatcttgggtagtctgctaaggtttctgtctcctgtccaaaccttcatctgtaaacgggagcaaatcatctctaatttgtagacctgttgtgagaatttaatgataatgcatgtaaaatgcctagcaggggcctgtcacatagaatgtaccctattgatggtagctgcaggtatattacaaggttgtactgaaaaacaaatgaaagaaagcaatctttccttgaaaaatgcacagagctccacaaatctatgacatcatgatgattatgatgattgttgcaaatgtcacatcttcatgtggagtcgaggtgggcattagccacactgttcccattactcaaaccccagatgctccaatgacagagcctctgctgagaggctgacgtcagggagaggtggaggagggcagatctcccaacccttggcttccaccagcttcctctcaccgtggagccctaaggcctcagcagacacgctgacttcttttcagaacaaagcacagcaaaacaaaacacacagcggctgctgaatggaaaacacttgcactctagaaaggctggcaaattccctgcctcgtcccaccctgcacggacagggccctctctgcccagccacctcctggtgcaccccgctgtatctctgaccacactttaaatgtgcaccctaggaggtggatgctctgcagagagtgtgtgtgtctgatctgaggcctgtggtcccctgaagaaagaccaacaggactgggtgccatcctgtgcccaagttgttcccaggaggagaaagcctgtaggaggggagcaagctcccattctgcctccattccttgcaaggtcagccagctacatgctttcttctggctgggcccctgagggcaattgttgctttttcctcttgaggagtctttttattttcagagtggcagggaggatggtttatggtgagtatggacctaaatgagaagggtgagtagtagatggcgtattctctgggctgtgaatcctggtcaggtgggggtggctgggctggggcaggagacactgtaaagagccagtaggcctggattccttccagccgtgctgcttcctgccatttactccatctgacctacttcacaggctgggctgccatgagcggctgctgcaggctgtgcactgcacaaggccaaggcttaccatttgcatggtctgcggaggaatggtgctcctgagagctgttctctgcagcagctttgctcatggggcactggtgagcagcaaacagaatcatcgtcttcatcaccatcagcaggagcagtgactttaccaatgattgatcagctgttatgtgccaggctctgtgctaagtgctttacattttatcctcccctccaccctatatcaggtaagtactgttatatctcatccccattttataagtgagaacactgaggccaaaggaattaagtgatcggtcagaggtcagtcagatcgggagtgatggggctgtaatccaaatgctgggctggctgactcctaagttcacactttgtcttcattcatgatacaaaagagatgtctgttttcctgaggcccacgggcaggggaggcaggactcctaagcctgggccctctgactgcctgggccagtgtttccgtgccagaaaccctgtctcagagggcaggaaagagaatggggagcccttgcagaatgtggttggatccttctctcttggctctgtcatccttgccttgggatgtcctcccaacacaggccattaatctcactcaagggccagtgctggcagcggttatgctggggacatctacataccttgcattcctcccctttcacagaaaggaagaagaaatggaatttctgtcagattgcttgaactcactctctggaatcactgcgcccatcttttcagagatgttgctaccagaatcattccccccttctcttatttatatacactcacacaattagatataactatattcacacatagacacatattacaacttgaacttagcacctgctcttgatatgtatgcccagaaggctgtcacacaatcttgcacacacccacacatttgcacatgcccatccagctgagcaacatgtatttacacagcacacacatttgcatcatatctgttcatgtgcatgcatgtgcacagctgttccccttaactgcagaatgaagtgagcacagcagcacagaacaacagctggtaggaagcatgtttgtcggggtgtggggagtgcaggagagaggaggtggggtggggccgggaagaagtgagtactagcagaacagaggcttgcaaaagactgcagcaaccagccccagctggctgtaggggctcacagtcttgtcacttagaaggtctgtctgagagaccttggtggagtgcagcttcagcatttggggccacagctctgcaggctttttctctaaaaggctgccctatttgtgttgtgtgtccctgtacacgtgcgtatttggctcaggctgactttccatacacagacagggctctatttttggatgtcttggttctcatgagttgtggctaagtgaggaagtctgagtctctcctgatgcccacgcttccaggatggctcctggctgtctgcgttagcaggtcacttttgggctagctacctataccagtccaaaggcttgatacaggaaccacatcagaattggtgacaaaacaagctggggggctcctaaaggaagatactgggattctcaataggccatcacccaagggaagcagtattctcctcctgcgaccatgccatgggatgaaagcctctgccctgtatgtctggccaccttgctaaaaactgtcagccagctctaggcagctccagagctgtatgacaggagtgggaggactcttgggtcagaactgtatttgtgggtggtaaatttatatcttacccactgaatatagctttttatggctcaagacataggtttggttttcttaaaaaaaggttttcttaattcaaaaaatgtacacatttatagtaagaatacaaacagtacaaagatgtcagtccttttctactcgtgccaaaattataaacagtttatttgcatcattctgcaaattttatatatgtctttgtgatatggtttggaggtttgtcctcttcaaatctcatgttgaaatgtgatccccagtattgaaggtggggcctggtgggaggtgattgggtcatgaggtcggattcctcaggaatggtttggcactaacctcttggtgataagtgagttgttgatcagtttgttcacatgagatctggttgtttaaaagtctgagacctctccttccctctctcttgcaccttctctccccatgtgatgtacctgctcctgcttcaccttctgccatgattggaagcttcctgaggcctcaccagaagctgagaagatactggaaccgtgcttcctgtacagcctgcagaactgtgagccaattaaacctcttttctttataaattatcccacctcagatatttctttatagtaatgtaagaatggtctaacactacgtatgtgcaagtgtatatgtatatgtaatgtatacctatgtgtatgtgcataaatggaaaatgcactgtggtaaattacagatggctacaaacacttagccactcctcccagaaagaggtggaggctacctctcctattttagaactgccatggcactgtgacttgccttgaccactaaaatgttgagaaagtgatgctgcgtaacttctgggaaaaactttaagagatttgctgtttctgcttgcagtcacttagaatgctccttttcagaatctggcccctgtgctgtgagaagcctaccccacatggaaatatacacagaggaaaatggaggcagtggccaaaaacataagtcaagctcctagtcaacagccagtgctgattatcagccatgtgagtgaaccactagggccttctagcccagtcaagccttcagatgactgcagcccccgatgtcactatacggagcaggtgaaccactcaactgaacattgccaagccacagaaccatgaaagttagtacatggtgggttttatttccagtggctatattttgggatagtttgtcacatagaaatagagaactgaaacatgaagatatatttgattcatttaaataaatatttagtaattttctgattggctataccattttctttttaattaataccacacttaataggtaaatgtacagctatgtgtataatggaaagtgtactggggacatgcaaatatcgtttaagtacaattaggtttttatctagttatttgcaaaaatgcagcaatagacatcctgtgtgtggatatttgttcacatgtataaatatatgtctctaggttaaatttctaggaacaaaatgcttaataaatgacatgtaaatttaaaattttaatagacattgacaaattctcttccaaaggtaccatgccaccagtggtatgaatgtgcctgattccccacttccttgtacacaggacatggagatatgctcaaacctttcatcttcggttgtgtaataaatttttaaaaatcatttattttgcttttcttcaataacaattgaagttgttcatcttttgatatgtttatcagctatatttttctttttctgtaaacatcttttgcccatttttctactggttcataagagcttttttctgtattgaattttaataattctttttcctttttgaactgtaagaactcttagatgacaaatgaaagaaattagctctttatcagtcatttgtgctatacatttttttccacagattgttttttgactttttttttttttttaagagatggggtctcactgtacatacatcacacattttaagagatggaatgcaatggtgtgatcatagttcactgtaatctcaacctcctaggctcaagcaatcttcttggctcagcctctcaagcagctgggactacaggtgcatgccaccacattggctaatttttaaattttttgttgagatggggaccttgcccaggctggtcttgaactgctggcctcaggtgatcctcccgcctcagcctctcaaagtgtttggattgcagacataagacaccttgtccatggcttttttttttttttttttggcttttgactgtacatacatcacacatatatacatctgacacattttatttttgtctgattttatggtttcgtctttcatctaggcggaatttgtcttgctacaaggggtgaggaagggatcctgtctaattttttctccacaaatgtctagctagttccccatagctttcattgatcattgatttatcccccactgcttcaaaacactgcttggtcatatactaactgcccaggtatatatttgggcctatgtctatactctatgtcagtccattgttctctctgttcatatgccaatactgaaggctgcttcttagcctttccagtctgcatttcctctgagtctgctgttcgctgttggagccaggggctaaagtactcagcctgtactgtcagtcccggatagaatgcttccatttaaattctcatctaactcattctattccccctgtggattcttctcagcacttctttagaaagtctcctttccctgggtcatttctcccagactagaaaaattccttcccataatagctcttaagtgcttcctcttggtccttgtgatgagcttttttttttttggctttcctaggaatccttccactctgggccaaaacttcacccttcttgcctcccttgagaaagcagttatctttttgtgggccatccccatgcattcattctcctgcctgttcgctcgcttgcagtattacatggggtagcggggtcaagtcggtggagggtgaaacaggcgattggcaatactcccctccgcatccctgaagcaggtgatgatctccataggtcccagggtatccgtgccccgtttgatcagaaagaaacacacccaatcttcctcttccactgacttttcccgtgtgaaaggactccctggtcaggcggtattcatgccgcctggaaactcatctgcctgtgccgctgctttttcctggcagtttacaatgttatattgctaccaaagcgggcaaaatgaggatgtgaagtcgagcatctgagaaggctcagaaagtctgaataagcaatactggaataacaatgtactcctcaccaaggcatttagccagaaaagtgctcctgcttaggaattctatttgtttttctcttggaaaatggggaagtacatctgtaattcagctgtgaataccctattttctttgcaggggaagactggaaatagagtcctttatctcagatatcaaaccctggcccaggatacacaagaccaggagtcatcaccatcagtaacagtaacaacagcttcattaacaagttgctgttccgacgtgggctccggggtggggaaggaaggagggcgttcggctcaacgtccaggagaggcaccggcgaactcgagagccaagagcggcactcccacctgggcactccttgctgatggaccgggacctcctctcccatttctccggggcctccagggccctcccgcacattcagcatgatctctgaggagttcactagctttcctccctccgctctccagctcccgttcctaccaaatgcaccaatcatcactaagccaggtcaaaggccatgggatcagctgtgatctctcccttcctttttcattctcctctcctcatatccaaactgtcattaaactcagtgtttcttccttcaggctgtttcttgaattggtttcttctctatcccactattactgtcctgatccgtgctaatccaacagtttctgcccccaccccaggacagcttgtgttatcacggccaggtggatctttctagaacaccaagctcagcgtatcccttctgatcaacagagaaggagaggagagcctacactgtgctgggtcactgtgttacgctatgtgcttgtttcatttaataccgtcaacgaccatataaagtgtgtttgattatccttaagcaaaaaggtcaagaaattattagatcaatttcaagtcctcttcctggcattcagaactcgccccaaaatatggctgccttgactagttggctttatcatctcctctatcccaagatgacctttggggttccaatcagtcctatctcttccccgggagtaggggtggaggggcagcacccccgggcagaagatgcagccaaacaggaaagacagagttcacacctaactggctaaagtacaggcaaacacctgctaatgagtggtggtggcagtggtagggagtaggttgaactgtgtccccaacattcatatgccccaatacttcagaatgtgtctatatttggagatagggtctttaaaaaggtgattaagttaaaatgaggtcattagggtgcgtcctaatcctgcatgactggtgtccttataaaaagagaaaatttggacacagaggtacagagggaagaccatgtgaagatgagggaaggcagacatctataagccaaggggaggcctcgggagaaaccaaccctgtagacacctccatctcagacctcctgcctgcagaattgtgagaaaataagtttctgttgtttaagccacaagatcgtggtattttgttacagcagcccagggaaactaatacaggaggccgggcaggcattgtccaagggagctggagaggctgagcactggggcacgagggtaggtaatgatgtgagctaccttactgagcatcttctatacagcaagcaccaggctacgctgtgaacattctgcattcattatcactaatccttacacatgccctgccaggaagttactgtcacagccattttagagatataagatccaaagttcagggtggaaagaaatgtccctaggagacacacataatgagtatcaagtctggcattggaatcccaatctcctcctcactaagcccatgcttattctactattctgtcctgtgtccatcagtagatgggctggcatcagtggaccccagatctgtccacaggcagcagggccctgaccaacaggtggcttctcggagcagtgccttgtcttaggggggcatgttcactgaactcatgaggtcagaacacaggacttcacaaagctgaggagagaagggagatagctagctcagtgtggcaccccattcttcccattgagccctctcctcttcctgttgaagttcagcgtggttctggaagtacctgagtgggaagtagctttagcttcccacgactgttcaatagcattcaagtaacccttcatggcatgccgagattcctaatgagatgagaatacattctttaaagctccagttaacgtgtatgcagatgggagcttggaggactattttgctaaatgatgcaccctgtgaataaccatcacccccatatctactagggcaggcaccccttctctgtcctcagctggggacccctctcatcccacttggactcagagtccctggtgccccgaaggaaagcaaatcagcctcacttataattaagtgtctcaaataaagttttgttttaggctaaataagaaaagtgataccaagtcaaacagatcacaactgattattaagaacagatctactacagtttgacaactgccacaaacacaaatcttatttgggagttgctaaaactcagtaaatatcattttaataattaattaaactttaattaatgtcttgacagtagtctcaacctgataggcctcttcacaatgtgcaggctgtgatgaggatggtggctgctgggacggccaagggcagctaggtttcaggtgtcccctccttggggcaaggagaactaagttcactttcccccaagaaaaatctgtggtctacacaaatcaacctaaccactgaatcatcaaacactctgagaattcaggttaccaacagtgactgcaggagaatctaaagtgcttttgcatccttagagaaaaatctctgctccatctttttatggatccagtgggtggcagaaggaatggagttactgcaacatgacaatctccatcctgcctgatgcgcgagcacataaccgcctaagtttaaagagaattctggatataatttattatataagcctgtaatcccagcactttgggaggccaaggcaagtggatcacctgaggccaggagtttgagaccagcctggccaatatggtgaaccccccacctctactaaaaatacagaaattagctggggggtggtggctcatgcctataatcccagctacttgggaggctgaggcatgagaatcacttgaacccaggaggcagaggttgcatggaactgagatcgcgccactgcactccagcctgggcgacagagcaagactccgtctcaaaaaaacccaaaaaacaacaacaaaaaataatttattacatgagtagctcccaaatagcataattagtatcatgttagctgtaaaattaaacaaaaaagacttctgtccagttccctagaaattctaatttagtaggaatgagctaaaaggtctgatttagtaaggtgagaatttagtaggctcaggaatctatatttttaaccagttcccactgtgcgaggatgctgtgccagcaaagggcttcttcaagccacagagcctcccctcccagctgccctctctccactgagcctgaagcatgggcggcggtgggagccgcttcattataaaaagcagaacatccctaaaaacaggatattctagggacaccaaagagccgacactccattggaaacgcctcctctggggtccaggaaggccactccacagtggcgctgaactactgtttctcagcaaggtggtccgggccttctgccgtcagccagccacgccccactcccagtggtcctcttccgacatgaaagatgccaggaacaggaaaagcaaaacagcgcgcagcgactttcctactctagtagcattttctttctgtgtctctggtgagtcagagtttgtttgaatgtgaattatctgcaatcacgaaagtgacagtacagctggctgccgggcccgaaggaaatgtgtgctccagataagggcgagtgtgtgtgtgtgtgtgtgtgcgcgcgtgcatgcattttggggggctggggctgtcctcacttatcaaagcaattcccaaggcggcctctctgagtgaggcagggtctggcagggccgagcccctcagagccctctgccccgttggtgctgtgccggcgaaaggccacgcctcttcaatctggggcacccctgccgcctgctccacctcgcccgtccttgggttctggtcaatgttgggttgcccccttttcctagggatgtgggaggagaagagaaaatggaggtctatattgccacctcattctccgggtgcgggaaactttccctcagaggcaggacgcaggcaggtgaggatcacccgccacggcttttgtccactcatggtgtgagtctcaagaggagggaaagtgggtagggtctttaagtttggtactgtggccctctgaggttggcgacaacctgaaagctaccagcagagaaaagtaggtggagacagtgcttttggccacgacccgtttttgtcatcctcgttcctcctacaaaatgaaaaatggtccagaggccattcagatccccgcaccagtcactgaaaagaaaccagtttaggtgtccaaggctttttggtcatttactagacatttattgagtgccttcgaagctctggcgtggtgctaggtattaggtgctaggtgttaggtgttgagtgttgggtgctaggtgctaggcactgggtgctgggtgctaggttcctcatctcagggagctcaatctctcataggagtggcagataggtaaatagctataacaaagtgtgagaaacctgaaactgaggaagcacagggggctgtggaagcccacattgctgattcctaaccaagagcggaggagttggggctgtgaggatgaatggtctgagaaggccatttagggtacggactgatgctgggatgtgcagaaagggagaaaggaggctccatgcagaggtcacagcccatgcaaaggcctggaagccagagagagcctcatgcatttaggaagtagcggacaataggcagggtagcatcactgaagcaaagcaggtgggccaaggtggggaggggatgagggcagggctaggggcagggccccagatgtgaagcgccttttatgccattcttagaagtttggacgtcctcatggaggtaaaggggagccccaggatgcctcaaggtatgtaggaagatggggcaggaggccattgcagagacccaggtaagaaacgatgaaggcctgggacagggctgcgctgcctgaggtgatgaggagggaaagactccaggcttattaggaagtagacgcaacaggctctggtaactgacaggagtgtacattctgcagagggcgacagacattcaacaacaaatgacacaatcaactatgcaattaccatggtgataagtgtgctgagggagagtggagggtgtggggttccgtagggggatctgacctggccagaagtgggcgagacctccttgaagaggtgatgttcaacctgaggctgacgggcgaggaggaaatatccaggtgaggtgttgagtggggagcacggaacagcatctgaaaatgggttgcagggggagcacagtgcttggaggacctaaaagaccagtctggctagatagggcaggtcagctaaggactgcagaccaaatttgattccctgactgtttttgtaaaggaggttttgttggaacacagccacgccctctgcattcgtattgggtagagcagcttttgcatcacatagggccagggctggggaggggaaagggaggtgcccagggtgcaatactgaagaagaccctcactcccaggctggtgcacaagccacagcccggacagtcagtgcctccctcaattttgtacctagagcaccttacctgccttacacagttctggcctctctgccacaatacaatgacataatcaatggaggagttgcaacagagaccttctggttgcaaagcttaacgtatttactctctggctctttgtagaagcatgtagacccctggcttagagcagcataaagaggggagcgtgtggcccaggccgagccctgatactgttgcagctctggccacagccccttagcattcaactagacatgcagaagaaacctgtgctaatgcctgcgattctctgtgggacagcgggtgtgatggagtcacggagatgtgatggggggcatttgggaacatgctcattctgtcttgggcaaatggcatgtgctggagagtttccgccctgggaggcagccctctacacatgataggtatggggctggtggggataaatgccccaatttcctcacttctccttggggagaatgccacgtcccagagttgcacggtgggctgactgccagttgcacacagtggtatctacatgatgatgaatcctttactggcgtctttccttcctttcctactcacttcctccctcccctaccagggtttcctgggatcgccccctgaaacaaactacttgcatttgaatccttgtctctgggtctgctttgagggaagatgtgggatatccctgagctgcctgaggtgggggcttatgtaccaaatcccaccatagagaaggaggcccctgctgggtgatcagcggagttttacttacatgaactttcctcctgcttccccatcccaggcacccgaggcgtcaagccacagggtgaagactcaggcttcatctttttctcagattctaaactcacaccccacctttctgtgtggctgcatggctggggactccatcctcctaatgatcaggttcttgtgcaagcctgtgacactttcaccttgtgacaatgcccagacaactaatagagtctctgttttgccaccggataattgtttatttcctctttcaagggaactgtgtagaggaagaaatcagttgagaaaaacagtcttgagctactcaggctatccccatctattttgtgggggaagaaaactattcagcattttcaggttccttcctttcagatcttcccaaagatctcagtgcacaaccagggctggtctgggacagttgctgtgcttctgctctgccctggccagcctctgagggggtctccaaattaaaatgcaagttttaagtcagtgctctcctttcctggggattgttgacagctcaagaccacatgggctcatcactgtgatcttaaggaaagaaatgatcagggcaaatggctccaaatgaagatgaaaaagcttttacagtgacagggaagaaatattgcaggctgcttgagaaaatgcagtttgggaatataggagaacgtggaccattttgcaaatcaaaaacaagaggaaaagggactacagcacgtgaaacatactaaagagaagagcaaaaatgagattagaaataaaagaagggcaggcaaaaggaggaaagagaatgcgggggaggcaaacatcagagagactgcacaagagcaagagggaagacagagaatgttcaaacaccatccacgatgaacacggttgcagagaggccagtgttccaccgtcaagagcgcagaaaagcccttggtgctcctctgaagaatgcaagagcaatctgcagtgttattgactagtggaaaaatggctcctctctgacttagcacaggatgcaatttatcttcagagagtaccctccatacacccaatgttagttcttaggcatgaggttgggcaggagaagggcggaggaagaggtgtgggaaaagaggcagacagggaggtgagggggaatgtgggaggtgatgagaaagaaggaaaaagaagaaaggagatggagagagtgatagggagacaggaggggagaaggaggaacagataggagggagctatgaaagaaagagtaaggttagaataaagatttgggaaggagagggaggcggaggaagaaagaggaagggagggagctggagagcaagattttgaaactcttaaactaagaagagcaaagcagctaatatgtatggagcacctgctaggtgtcacgcattgagctaggtgtcatttcattattatttgatctcatgctaacaccaccttggtgttatctccctcatttttataggtgagggatgggtgctctgagtttcaataactttgcccagaaccacagcgttgaggctgtagggaggttaggattggagctcaggggacaaagcctgtttcagatgacacaggtcagccacatcccagggaaacaggaagggactgacttttatggatctctagctcccatctaagtgatactgatggagcacagaagattcctggggacactcactgtggcctgtgaaaacctgggcctccaaacaccagggggagctatcaccctggaagaaacagccaaatgcatctgaaaactggccatatcagtcaaagaaggtatttactagcctgagtgtgagtgtgagtgtgtgtgtgttggggggggggggaagtgtgggggagagtaacagctgattctttctagctgattttcattttatactggacctcatctagatgggatccacccattatttgcagtgggtgcctgttttgtttcctttcccctgcttgttggctgctgactcatttgccctggttacctgggaaggcgggaatgagcctagggcaggcatagagctcagcgcatccaagatgatttggtgcgtttttgacagatgaatgaccaatgggaggatgaacacgtgcttgaactggaagggttctggaagaagcatttgattcttcctcacccaggtcagatcaccatctcaaacatcactttaaaacaaagaacgccacaaagggagatttctttgccttccttagaccttcacgctggtccttaccttcaaggctgtcctcgctggactttagctgttgaacccactggcatcctttcggaagcctgaggttgggagttaggagagaagctaattattctatggtgtcttggatatgctaacaataacagctcccgtccaaggctgtcatgttatttaatgaaatagtggaagcgtgattatagtttataaactcaagtactttgacagtggtcactgctctgaaggtgccactgttgtacaagtggctatgtgaaccagcagtgatagaatgtcccagctgttggctatgccttaccctattaccctagatctattgactcagatgctttgaaagttctcgcggggaactgttccttgtagactctgctcaggcaggttggcgtggccaggcttgggaatggctgtcaccacacaccttgtcctccatcctcactcatctctgtcctcctgctggccagtcacccccacctagtggttctcgtctgttttaatgagttcagagtcattgccaaactaagtagtcagcttccatcagtgctattcttcatgttgagccacaacataaaacactttattgcaattacaaatagcaaaattattttctgccgagcctcagcatctgaacttaatggcatgctgtaatgccaccctgcgctgatgtgtggcatatctaatatccatctttcttagaaataacagtgttcagaaattagaagggactttagcagtgaaataattaatgtggataaccatcataaacggcacaaatggaacaaatacagatggtagtgagccgtgattgctaatatgctaacctgttttgacagaactctacattttttcattgggaggttcatggatagaagttaaaatatcccttgcctcatgacaagagctttgtctttctgggtaagagattcaatgatctcctacctgggcaaggtagcatcaccggaatttgcgctgagaggagggcttgcatcccagctctgggctctctcacacccttccatctcctgcagccacatttctgccctctgcctcaggctcaggcaggcgggcccacccagaactgcagccagacacccacctcttctgtgctatggctctgagggaggggcaggggctccctggctgggctcactcagtgggaagcagctctttgaagatcctagctgcatgcaggtgcaagttgcggaacccaactccaagaggctgcacggaaatgaaaaattgccatagaaagatgactcaccaaatcacagacactaagctattgagacaaatataaggacgagggtgtttgggggcactggaaacacttggctgtgcctgcttttggccctgctggcctttaagcagcattagcagcagaagggccatccaagtttctctggatgagtcagaggtcctcagagaaatgctggagggcaaactggggaaggaaggtagaaaggatctagctttaacttattaaggataagtgctgtgctttacacatattttatttactctcaataataatcatttgccgtgggcatggtaagttaatatttaagatggggaacctaagaattagacaataagtgatttgccaagttcaccaggggcagggaagctatgggcagagcggctagggattagggtcacaccaccccggccaggagccccattgatacgatacagggggcctcactgagtctttctgccccaggaagccaagccctcctctctgatgctgaatcccagcccccttctcccactcaagggcgttgatagaaacctttgtctcctttccctccagagtcatcattccccctttatttaatcatcttcttacaaatatgctgtaatatctctaacttttttaaaatggagaagcctttctcatgtttgttttcctcctgctatacctcctttgctgtgttctcttttacagaactcagaagagctgtctctcactgtctccttcatctagacaaacgcatttcccttcattccgacactcggtaacccacttattctggttttgtctcaaatctaaaaatacgccactgaaacggcttcttcctaaattaccaatgactccatgttgacaaatccaatggtcaactccttgttgacacaaatggccagctcttctgtttgaacgccttcttctcttagcctctgggagagcagtctcttacgggtctactcttactcacagctactccttctccatctcctttgctagttcctccccatctctattattcccaaatgttggaggacctcagggcttctccgagctgtctacattcactgcctaggtgatcttacttagtcccatggctttcattccacccgcatgctgaagtctacttccttgctgggcatttccatttgaacatctcttaggtttctaaaatgtaactcatccacagccaactcctgccttcaccacacagcccctcccgctagatcctgtcaaaatcatccctatctcagccaatggcaacttatccttccttttgcgacttctaaggccacaaccttagaagtcatccctgatgcctttctctaatactttatctttcaatcttttatccagaaaatgaccacttcttacaacctctgctgcccccaccctggtccaagacagcatcaccttgcatctgttgaggctcctgagagacgccctgcttcttccctgcttcagcctcttcttaacccagtggccacagccatccttacgcaatgtagcaatgtcagttggatctgatcgctcctctgtccaaacttctgatggcttagggtcagggtgtggtccctctgcctctgatttcagctcctactcatccccctttgactcatctgcttcagctgaactaacctcctttctcaagccaacctgcaggctccctcttcagcttcttggtccttactatttttcctgcctcttgactttgtcttatgtttcttcattgaacttattgcctgacacagcatatatttatttgtaaattgtctgagctcccacttgaatgtaaactctttgagggcaggggcttaatgtgtttgtccactactgtatctccagtgctcaaaatagtaggtgccaaataaatatttgctgaggggatgaatttagacctggtgagactctgcagtccttgcctgtcccaccagccctcacggcagtgtttgcatgcaggagatgccatgtttgcatggtggggctgtatctgcctggctccctagtgatatgaagttctaaattccaatgaaatctcaaatccctcaaagaaagattttaccactctggttaaaaatcagacctagaggaaatatgctagattgcagggtgtatctaaggaaataaaagcattaggtgggtgaaaaattgcaaaaaacaaaattactttcaacttagatctgaggagtttaaattagttcactcccatgcccagtgtaggtgaagacattcaccacccaaacacagacactcttgagagcgaatgagagttataattatcatagttatgttagggctgcaggcacaagccaagactgtcctaggcaaaccagttatgatcaccctcatgagagagaaaggaattggcttgtggctgggccagggcacatgcaaatgacgctgtagggctggcattgaagaggaagcctgggagaaggtgggagaagatagcgaggggacctggaggagaggagtgtccaggaaagggcagagagcaggaagatctggagtcatacattaaagggcaggggcagggaacaatctgggagaaaggtctatttcatgtgcttgagagaggggagagagagaaactgggattcctagggaagaagctaattgggcaccagccgagctggcaagggagggagccctgaaatgagaacaattttggctgagagccaaagtgttttctgagacagactgaatgagaaacaacatggtgatttggaaagaactttgagactagattgacttagtctcaaattctggtgctcattcgctttgactgtggggatgacactgcttgtgcttagcctcagtttccacaagacagcaccttccttaaagaatcatgaggccgggcatggtggctcatgcctgtagtcccagcactttgggaggccgaggtggatggatcatctgaggtcgggagttcgagaccagcttgaccaacatggagaaaccccgtctctattaaaaatacaaaattagctgggtatagtggtgcatgcctataatcctagctactcgggaggctgaggcaggagaatcgcttgaacacaggaggcagaggttgtggtgagctgagatgcgcctttgcactccagcctgggcaacaagagtaaaactccgtctcaaaaaaaaaaaaaaaaatagaatcatgaggaataaataagataacacatgcaagacatctaacacagtgcatggcacagagtaggtgcctctctggcaatagcaaagaagcctgctcaagaggacagagattgaaggccaaggcttcattttggatttgcagagagaagtcaggggatgagcttgagcccccataactgcgctctcccctagggtctggcaaggaggccttgatactgaaggaaggatgataacagggtgcgttggagggacagctgcagcttcacacctgtgaagagccatctgggtcaccagcacggtccctgacataggacagctccatgtggctgatactgggatggtgcctcacagtcaaaaagcctcacagtccaaaagcctttttgtgttccagaaccatttgtgagtgctctggtcagaagcgaagggttcccatggaagtccttccctgtgaacaatgtcaggaccccttagcatggcagtcaaggctcccaatgatatgtcataatttccacttccagccttgtcttctgtctgtaactctactgtatatacctcatgatcctgccaaactgttcctcaagcacctgctgtcacttctctcctccatcccaatctatctgcctgaaaacatcctgtttccagtcatcagcccttggctgacacttgaacatggcagagtcattccacccccaggggtctggactagctgttccctcttcccaaaaggcccttctcctggccatctgcatggttcactccctcacttcctacaggaagtctcattcaccttttggggatttttttccctactgaaatttgaagctctttctccaacatttcttgtatgtatttatttattcctgatttatgttttctgtttagctcttctgactatctaacttacaccatatcaggggttggcaaacgatggcccttggggccaaattcagtccactccctgtttttgtaaataaagttttattagaacacagacatgcttactcatttatgtattgtctatgactactttcatgccacaatggcaaaactgagtagttgcaaaaaagaccacaagatctgtaaagactggaatgtttactgactagtgattagccttttccaggaaaaatgtgctgagctgtgctctaactcatgcatgtcatgtactttatgtcttccccactagaatgtaagctccgtgtggacaaggatttttgtctgtcttctgaattactgcattccccgttatctgggaaaacaactactcagtacatatctgttggatgaatgaatgaatgttgaaaattctattcattggcaaggcctagctcaaatatcacttttcaggaagcactcctttgcatcatggtgatttccgcacgaaatctcatttctcttactagatggtaagcttcaagcgtcacctctatcatgaaactatcctttgtctcccacggtggaattggcctttcttcatctattcctcttacagtcttctgtggctgcacatagtgtacggtaggtattgcggtatttgacacatgttggactctccacttgactgagattaagtgggtagggactgtggtttgttcgtctccgtcccaggcatctatctcagagcctgcagccctgacacattgcaggtacttagcatacagagctggatttcccccactgaaacctccacagccctcctagcagagacagacacacttttagtaggggctaagctatgtttgtggagtagaatgaaaggcaaagggaacagtgctgagccagagaacacagcattagtgggagctgtggagaggaggctagaaataggcaaagaagggaggggacaggctctgtttcatttcactctaccataaagaggtaacaatttaaaaaaatcaactctcctcagcctccagacacacatgctctgtggcatcattaagcagctggtgccaacatttacctcacacctcccttagtaggcaagaaagcatttcctaaacccttctcctctatgcttttaaaataaaggccttagtggatctcaacttcagcaaacagaacattttctacttttctatactgtaagatttttgaaagcagtgactgtgtcattcttttatattcctagtacctagaccatgatgacataataatagatgcagaattaattttcattgagttacataaatgatacaatatgaaaagagaagggaagaaggaaagatggaaggaaaagacttgcacagatgctctttgtgactcagaactttggaaaaagtccaacgagcaacaaaatactcaaaatactttaaatgaaggtaaaaaccatcattgttttctctctgcctagggtttttaggaattttcttctattcaagatcataattgcagaaaactagaccaatgatctgattgctttcataagctccatgatgattaaaagaagtgtaggcagctccaaggccacacatgaaaagagaaatgctgaggctgttccatttgagcctttttgtcttgcttggctctttgtcaaaaccaagtctccttctggagatagagatgcagatcaccacctaccccaactgttcccacttgacttaagagacaatgtggggaagaacatcacccccatttcaaccttcagaggcaggttgcttctgccacggcaaggagaagatcactttctgtgtaagatttctgattcctgtctcctgcaggttggttcattttctttcaaacacctgtgctgtaatatgctaacctgatcctaagacaggccccaactagtacacacgcagatccatgcacacccacacacatgcacatgcagacttattgtcatagcttgtatctcttatggacaagatgcagagtgagtgagccagcagatggacaccctggaggttcggagccatgtcactccctatcagccctctccaaacatccaggcaggatctgggagggactgcccttgagatgggtgggctccatgaatttccagctgaagcaacacgtttctgtccccaagggatgaagaagtttcttcagctgctctgtagatatgtcatgtcgagattgaattcaggtatagttttagctgccttccttcttgaaacttccctctccccgtttgaattccaatgaggcatcttttgaatgctgagattgggaagcaagactgagacctgcttatgggccaagggttcttagtattagataagagtcaggattattagacctgcctatgggccaagggttcttactaatagattttgaataaccataaaaacaactttcctgcattcctctttatcatagatcaacttgtcagttagtcattcacttaatgagtatttattgtaccttgactttgtgtcaggtagtgtgctaggtgcaggagtagatattcttatttctgttcttcagatgaagagacagaggttcagagaggtgaggggtttcagtggaaagtggccgagtcaggaatcaaaagcctgtcttctggtgcctgcttaatggggttttaaccaatgtgggtattaggtgagaggtggccaggagaaggcaggacattaggggttatttcttaagcctgtgggtaaccactgaggcagcaggccagaaagtcacgtgacccagtgtgatgtatgggagaggacagcgtggtgcctcgtatgccatgaagaattaatctcaaggagatgctagtgagctccagagacttagcatcagtgccaagagatcaaagatatgatatctctggcagagtgcgctatcaggagcgatcaaagcaaaaaaaagggttcatttcagtgccctgtgcattagttgcctgacttgctgactctgggcacaaaggaagcagtcatggtttggaaatggtgctaacacccgcatgggcatttctttcttgacatctccatacatctcattgttgcctgtccataaacaaaaacattatcatgcccatgggtttgcccccgctcatccccaagctggctgtccccgttttcttctgagtgtgtttgtgtgctcagtggctttcctgccttccttggatgatggtggtagaggccgtccttgtctggaggaggcctgtcagggtgcactgctgcaggctggaccctgagcccgctctgccctcgctgcaaggctgctgctggggtggatgtgcggggctggtggagctctgtggcctgggtccagtctgcacaaaggcagggccagggactacagagagcatggggggaggcatcaggattggccaccaactcactgagggactttgtcaagttgcttcccctcgctgagtctcagtttccttatctgtaaatcaggcagttggtctgtgtcagtaactttcacccccagtttctctggtgatgtaagttttccaatcaaattataataacccaaatagaggagatgccccataaatacttcttgaatgaatcaaagcaaatctataaagataagcatggaaacatgtggactgcagtggacagggccctggagaacgcccttctgagtgccctccctccattctaaccccctgtgtcccgaagtgggtctctaaggcccttctgtggaaccctaaggctccactgaacccagcttgacaaccacaaatatggactttcttgtttcttaaagctctgacattcagtgattctaggggaactattaagtctcaaatcccttacaaattaatgaaagatctctgacatattttctagaatttttcctcagaaatttccctggacttctctggggctatcctgttggctttatgaaaaagtctgaactacacaagatgcctcctttttttctttttagatggagtctccctctgttgcccaggctggagggcggtggcatgaccttggctcactgcaacctcctcctcctgggttcaagcgattctcctgcctcagcttcctgagtagctgagattacaggcatgcaccgccacgcctggctaaattttgtatttttagtagagttggggtttcgccatgttggccaggctggtttcaaactcctgacctcaagtgatctgcccacctcggcctcccaaagtgctaggataacaggtgtgagccatgtgagccactgcgcccagccacaagatgcctctttatgagaggatccagtctacctttccagctgttttttcccactcctatcatttcccttctcctagcaaaactctgtattggcctacacatgccaatgtgttgagcatgccatgcgttcttgtgccctgcatctttgcttttgccattccttgtgctattgtttttccactttcttcctgcaaaactcctattcatcctctaagacctggctgtgatgtcctggctcttgaacggttctacctctcactcactcacacagggaggtcagctgcttctttctctgagccgccttaccctctgggacacgcctccagcacagatttccgcgtagcctaccttcactcatctagatacatcatcttccctggcagatggagtgcttctgaaaggcagagacttagctttgaattcccagtgcctagcatggagcctggtccataaaaaccactccatccatgttcatgaaatgactgagaaacagcaagggctcctgtgcacttgggtgtggctccagaagaggcagcttctgtggctattccccttggaggccggctggccactctccctgcacagagcaggctggcttcgccatcacaggctgcttctcagaagctcagctacctctccttcctcacctcccagacccctcggaaagtgttccccaccagaaatgtctttttggtggcctcaacctgagaaggaaggctacagagcttacagatttaaacttaaatgcataaacaattcacagtggtcccctggcttaggctgaatctcaacttggaggacttggtgtccatggtaagtctggaggcctgaaggtgggaggcgctcagctgtctgcagcagctgtaccctgcaccctgcccagcaggcatttccctgctacatggctctcctcccagctccctcgggggggtctggccctcccaccctgggtgagctgcatttttgtggtcctccttcttctaatctctctgcctgcctcacaaagtggagaattcgattttcttcccaaagaaaatcagatttgacttagctccatccattttcacaattgctacggaaacgctgtctctgtgaggacaaaagaactaaacgaaggactttcagtgggggaatgagcacgtggacacaactgtgcctcagtgagaatcccttgcagacctgggagagacatctgcaggcagtgggatgcggatcagaagccctgggtccccagagtccaatgatgaggagacccggagggaaggaattggcttgaagtagggctgtctcgggggtgagcatttctcccgcagccccacacccagcagctctgagagaagccagagcctcctgatgcacctggcatgacactgggacaaaggcaatccattatgtgactggtatatcagagtcacagaggggctgggtgcagcagggtaaagaggctgcaaggtcacagatggacaaggtgtggctgtcacagctgtggtggctggccccatgaaataattgggacaccaggaggggcagggtcagaggacctctaaatagctctgtagtcttgggtgagtcacttgaagcccccaagcctcagctttcccatctgcagaccagggagaaatatcacctacctggtggggtgtcctggggctcagtgttctcccgtggcatgctgcacatgcctctactgtgcatgagagtgtgtgtcccacctcccaccgtgttaaagcatgttgaccatgggtgtgctttcccacaggagtgtaggcttccagagcaggaaggggtgcgtcttactcactgctttattcccagggccaagcaccctgcctggcccctgcggagctcagggtgtctgatcacctgagtgagatgatgttggttagagtgcttgccacctgctgcacacaggaattagcttccaggctgaagtggggccagtgtagggcccacaggaacctggaccaccttgactctttgtatagggaggggaaaggaggcaggagaagccctgagtacttgtcagtggagtgaagcctgttaagctttaagcgggaggattcagttcagtaagtaacttcgtcccctgggagggcccccaggtcccttctgtgttggctccatggcctctcttctctcctgcattaattcaagtgaggaaggcctgagcttgcctccctgaattccctgcaccccacagacgctgccccattctcaaggtgccatgtgtaatcaggaagcagacgctagctccaaagctttcggggcagagggaggagggcaatggctgggcagtgggctgtcctgttgctgaggagaccttgaggaggaggcttttggggcaggcatgcctgttgcaggcttggagtgggccctggggaggggcagtaccctctaggccagaaaacacaactgggccatcttccctcatctctagcagaatggctgcctccttagtccagactgagtcctgtggaatgtgtggttggagcaaaaagatgaagagtgagtctaagaggtcatgaagaaggacagacccagtagactgtggctcagcctttcttgggaagcagacttctaagaaacaagcacgctggcttaacaacaaatctaattcttttagggaaaagaggtagtgcatggataaaatgtggaaagatatagaagaagaaacaggaagtggagcctggtgaggaacaaaaggtgtcacaaggctcattttagggacatattgcaggagagacaggaaattgaaattggcgccattcttctagattgcccagagtcctccagagtcacagggggagtcaaagggtcaataggtgcttctcctttgcagcctcagggagtgattacctgcaatatgccagggtactgtccctgtaaacaatgaggctggaaggcaagaaaggagcagctccctggcattttgctgctggagcacggaagcagtgctggccaggagctcacaggtgggtgtgaacctggggaccctccgtagatactcatggggccccgggcactccactggacaggtgaaaagctcacagctcagggtcccctgctattttatgagcttgggaggtttctgtgtccagaagcacaatggagggagcccctgatcataatcactaagagcacaccatgtttgctgcttttaactgtttccaaatccttctagttcataggctcctctgctcctaaaccagtcctttgaggtatctggcagacagttttctgcccttcccttccttgacatttctgtgacatttggctctgtgacggcttccttcttcaggaaactcttttgttgtcttatttctgggacaccctcctccggagtttccattccctctcagtccccgtcctgactctcattcctgtccccagccacttaaatgttgatgtccctaggttctatccccagccgtcttctcattcagaattcccctcctcaaagtagattcatcactcccagagacatttacatcacgtctccacttagcccttggccctggctctcagccccgcagaacccactgccgactagccccatccacatgggggcccacaggccccttgagtgtgacacgtccaaatgagttactcaccttctcctccctcttctcatcatctctgcaccatcaacatcccctaattgtccaccagaaatcagggaacaatcctggcctccaccctctcctcaccctatacgtctggtcaatcatgccttcctctcaacctgactcctacaggtatcttcaacctgtgcccattctcgcagctctgagcttattccatactacataagtttgcttagactggtggttctccaccatgggtgatttttgtcttccccacctaggggacatttggcaacgtccagggacaatttctgatggtcacaacgaagtggttgctactagcatcaagtgggtagaggccagggatggagctgaacacgatacaatgcaccaggcggcccctgcaaccaagaaccaaaatggcggtagtccccaggtaaagaaaacctggcttacaacatgcaatacttttctttttctttttttttgtttttgagattgagtcttgctctgtcacccaggctggagtgcagtggtgccatctcggctcactgcaacctccgcctcccaggttcacgccattctcctgcctcagcctcccgagtagctgggactacaggcacctgccaccacgcctggctaatttttttatatttttagtagagatggggtttcactgtgttaggcaggatggtctccatctcctgacctcgtgatccacccgtctcggcctcccaaagtgctgggattacaggcgtgagccaccgcgcccagccaacatgcaatacttttctaactggtgtctctgacaatcaggttccccttcaagccactctctttgctgcctcctgcgagaatgcttagcttacaaatgaatctgtctgcatgtctccatttcctaacttctcagcatagtttacaaagctccctatgatctggccctgcccaactctccagacccaccttccatttctcctgttagtccatgccccagcagtactagataatctgccgttctctgagtaaatcatgttcttccatacctctgggccactgcctaggtctcaaatgaccctatcccagggtccatcccgctgtgtccactgtttgcattgggtcagagcttacttagtccttcaagactcagcccgaataccatttcctggacaaagctttctcttggctatgcttctaccacagcttgtacgtattctcatgtctacctttcacatttctctttctgcagtcttcttgaggtcacagatgtgattttatttatctttacagacccaatgcctagcgccatgtctggtgagtgaatgcacacaggaagaaagctttgccaaaatttgcacacctcgttgctggaaggactaggactggcattcaggtctttggactcccaagctatgctcacctcatcagacctgatggctctaagtaggtcagttttaggtcctgagctacttgatccatctggctcccagttagagaacaacaagaaactaatcacatgtggtggctgctgcctccgtaagtgcttccatttattcacaagctgaaagacaaaagcttggccccccagcatatgctggatcaaaagcaaggaacaaaaaggattgtaaaagaaagacgctggaaatagtagctactttgatgcaggcagctctttgaggaagcagctgaggactgtgcccccagcagcaaagagagagagaagtcactgccagagggtgaaggaaatcactgcaggaagggtgggacctcactggcttctctgctggtttccagcgagtgccaggaatgggggaggggtgtctcattaatctcacctccttgctgccctgcctggggtctttacaatctgctccatttggagactaaggattcctacaggaatggcaatctgagccagagatttaggaaggaggtttataagtaatggctagagcgatagagtaattaataggaaactattattaacaatacagtgatttcataatgattccgcagtttataatacaaatgtatacatcatttgatgaattattgtattgagcccgaggatgcaggaatggccagattctgtccttgaaatagccaccccttctcatgaggacccctgagaaaatatagtaagcacacaaagaaaggaaagcaaagcaatgcttcattgttagctggacttgtgatcaaaaccctagcgctctctggtcaactggactagatgacgttttctactaagcaagttaggactaaacagctcataacaacagccaatccaatatacctgcttgtctcgggaaagtgtagtcagctgcagagagacagtgagagagtgactgtttcctttgaattcctgctctctggagttgacttgggcagcctggctctgaaccaggacaccatctctgggttggtggccatctgagaaaacatggagaaaagacactttgaggaaggtaacctcgtaatgctgagaggaagcttatgcccaaggagactccaaggagaatttgggatctaaccccagagcactgcagagtggaaaaggccagggggaaccccttatcttaccagaaaaccaagcaaaggagatagcaagaggctggactgaagttaaagaataatgcttaagtgtcttgtttgggactcaaagggcttgccctcccattgtattcacagatacagcaaaagactttggtgaaatgcaatgtggaaggaggaagattggttcccattgtgaataaggaaaaaatgagtcctggggttctgaaggcagcttgagatattttgagcatttcacctctgaagtaagagtgcaaccctccaattcaaaagtgtaatttctagtccctttgttgaaaagtcagttatgaaactttacagtttcacttttggctttcggctgaacttttcagagcctttaaggcaaggtgggtaagtatttttagagatggtaacgaggcctgggggctatgcacacagctggagctcagcagatgtctcagaggagaaagatgagaacctcagtcatggtcaagacccctctccgaatggcttctcatccctcagacccacaagagaggtgcatcgtaagctcaagacacctgagacaccttaattctcttccccagccctctctctgtcccttgaaaggatgcaatgcgctggggagatgaaaccagtttgcatcttaggaaggatctggattgttttccttctttctctgagctgtcacttgctataaaagcgatcattgatattcagccattatgccattatacttccataatcattaatattcttaaaaggctcttgaaacacatttatacaaggctacatgatcagttcctacatttactttcaatttaaataacagttttagccagggttttgatgtgctgtttactttaattaccatcctgcccctttctgtgtcttgacacagtgtcatttaatattttatgaatttcccttagccctttttttccctgatatgtgtgatttgaacgggttgctgcttttttagaaaaaaatttgtagttttaacttttctgagacttgctgtaaacaagatgtgtcatgcctatggattctcttcccccagtgataatgggaggaaataaataaaacagcagacagctgctttacccagatggcacagggatgccagggggttctggccctgctgcaggcacagagtgacaggccagcaacttcaggtgaggtgggaagcagcccagaagaggtcagcgtctgcctctcaaggtgtgggctgtcagcatgaggatcacctgggagccccactccagaactactgaggcagaagctgcattagaacaagatccctaggtggtttgtttgaacactggagtttgggaagcactgcactaatggaaatcaattagtggatgtaaagaaaataggcatttcacggctgttctctcccaagtcccatgctttcatcagaaaaaaagctctacttttgggatctatggcaggttcttggggtcatttataaataagtgctatactttaaatactgtgttcatgatctgcttcaagatttccccctctgttttttcagtgatccatttgtttacttaagaaatatttggccaggcgcggtggctcatgcatgtaatcccagcactttgcgtggctgaggtgggtggatcacctgaggtcaggagttcgagaccagcctgaccaacatggagaaaccctgtctctacgaaaaatacaaaatcagctgggcatggcagcgcgtgcctgtaatcccagctacttgggaggctgagacaagagaatcacttgaacctgggaagcggaggttgcagtgagccgagatgtcattgcactccagcctgggcaacaagagtgaaactctgtctcaaaagaaaaaaaaaaagaaatttagtattctatgtactaggaattacagaaagtgataaaggagactgtgtgatatggtcagtaacagagtgtgtcaaagtgctaaggaatcacagtggtggagactgatgagcaggtcagagaagttttcgttggaggggtactttctgaacgattcttgaagaatgaatgggagttaggggtggttggggaggacagtgttaattgtggcaggatggggtttgtggttggaacggtgctgtcttctggtccagctgtgcctggctccgaccaagggcagggtcaatgtgcactgcctgcagcaagcatagcagtttggcagggaggctcataacggggcgtttacccatcctcagaaagcaagggctttcctatgggactgttgttggctgctgcctgatggaggaacatgcactggaactcggggctaggaggttacatgcaaactcagttctactaattgctagttggggcctttgatgacaccttttatgtctctgtaaaagttgtaaaatgtgcttctgtgagggctagatgagataaaacccatgacagaaactggcagtcggtagtaacattagctgggtctgaacgtgaatccacgtttgacgagtacgggaaggaataatagcaaagacaaggagaataagcccaggtaagcatctctgggatcctagaacaacagagaccattgcatgaccaactggggagacagagaaagagagcttccaccggccccatttcccacctcctccacctactctttgttgacacttaatatagaaactaggcctgtaactggcgacagatcaatacttccactgaagaataaaacctctcatggggcagcccagaccagggatatgatctcaataatgtgcgtcggggaattggggcttattggagaaggtggctttggaggtaacaggcagctgtcaggccccagaaaatggaaaagaagtggatatcaaaacctgtaactctggtttagggacagatattatttccttgtctctttctgtaggaactgaagtcaattgccctttaggcagaaccaaaccaaagaggagacataaactcattttgagtgaacaaatccagctaaaaattactttctcattgcttcctttctcagatacggcatttatcatgggtaacagatgaatggataatcttaatttaaaggcaaaaataagggggatccttcctgatactgaaggtacaaaataaacatcccagtatttccaggcccccaccttccaggcattggcaattcagcagaggtctgggtttattctccagttattactgcatttatgaatcctcaattagtcctgactttgcttgagagtttttatgaaactgcctagcgtagtgcctagcagagagtacatgttgaatacatttattagtttctttctttccatagctactgctgctggctaccttgcatttctgtggatttggtcacaagagggattgtctagagagaacagatggtctggtttactttcaattgtagtcacagcaataatagcaccatttatggggccatacactatacgctagaagttttacacacatttcctcatttaatactcttgtgaaatgtgcactatcatctccattttgcagataagcaaaccgaggctcagagaagtgaaatcatttgacaagtcatacacagctaaaacgtagatgccagagccaggatttgatgagaggtccccgtgacatttcaacccaagctgtttttggtgttcatatcactttctaaacagagaactggagagctggaaggaccctcagagatcatctgggccggtggttctcacctgggggcgattttgtccccaggggacatttgagaacatctgaagatattttcggttgttacaactaagtgggggagtaggggtacctgctcctggcctccagtgaggagcccagggtgctgctaaccactctgcaatgcacaggccagcccccatgacaaggattatcctacccaaaacgtcattcgtgctgaggttgagaaaccctggtctagaccaatctcctgattttacagataagaaaacccgggtgtgggtaaggttaaaggtcatgctaatgtccatggacaaaggctgctgggaatcaccatacatcccccacagtcctcccccaccctgtgctgcccaggaaaaagagctcaaagggagtgccccagactggctgtcacaagcatggtgtggaaaggtcctacttagttttccagggagccagcaattggttacatcagaaaactttattctcaggggcagtgcccttatttagatttcagggaaaagcaaaaacagctaaagttttctcaaatagtaagtttcccaatttgctccggttgataattttctaatgtagattcagtggaatctgcctgagagggtgctgagtggggatgtgcttgccaaggggaaaatgaatgtgtcccctgattggaggccggcttgtcagacaactgtgactgtcagcacactgggctggggcctggcctcaggaagggagtggggaggagcagggatggggcctggggctcaggaagggggcagggaggagcagggatgcaccttcagggcagagagggtgctggtggatcccagctccaaagcacagagacggcacaaggcacagtgggcagggagagggcggaggagggagtgaactgtcccccctcctctgtcatgcctgcatcactgcccgggcagtctccacagtcctgggggcctggggaaggagtggaggggacagacgatggtctcctgagtcacaccgccccatggattctggggaaggatctgggcaaatctgcagcagctcggagtctcagtttgtttccctgctggtacgacgatggcagtaatacccgtgctggataaagtgagagactctcgagacacacagtacatgcctgcctcttccccagctcggaattctccagtagaggggggcatttttagacacagtgagctagaggaggcttttttcggtttcttaattctaaatgtttaattattataggcacctaatagttgtatatatttatggggtacctgtgatgttttgacacaagtatacaacatgtaatggtcaaatcgggataactggtatccatcaactcaagcatttattatttctttgtgttagaaacattccaattctactcttttagttatttaaaaatatacactaaaatactgttaactacagtcaccctgtggtactactgactattagatcttattcttctatttaactgtatttttgtccttcctcattaaccatcccactttatctctcccttcccactacccttcccagcttctggtaaccatcattctccttagtgagggctgctgtttgcagaatgttggccagggcaggagaatgtaaatacacgagtatacctagaccttccgatatgccagctgccaagcatgtgccaccaacatctaagcccaggaacaaaatccgacgcattttcattcataggggaatgaaattaattaattaattttgaattaatcataggggagtagcctccaacagcccctgttgccccctccacccctgtcttgccttatctggtccttttcctttgagcaggtgagcgctctcttgcttcctcactcagagattcccagtcacgggctgcagctggaagtgggtttcacagaaggtcccaggctggcctcacctgatatgctctgtgtggacttcacttgagtcctcagtgccaaaggcaggactgtatgtgatgcggggtttgcacagagcactaatggagtccgttagtattcagactgagtttcctattttttttccccctaggagtgcaacactgtggttcaatatttgctgggtggtaattaatagcacttaatctgtaaatctggagctggtttctcatctgctgagaaatgaggttaccatagccaccccatgtttggctccttctctccttttcccttcccagaaatgtccttttgtgtttttctcagccctagcagggctcacgacaagaaggctaaaagcacccagagagatttgctgctgcattagcaggcagctacctgaaagaaaagtttatgaagacgagaagaaatgggcttccacccacctcggaggcctgatgtgctgtcacaccagacaatcctcacaggcagaggagtctcttattcttccacacagggtcctaaacaaagcatcttcggtgatcaaactatgatttttttgactgcctactgtgttccaggtggctcagatatatattatctaattctcataacactacaacaatcttgaaaggcgggtatatatgatacaaacggtacaaatgaagaaactggctttcagagagaccaagtaacttgctcaaggccacacagctagaaattagcaggatggaaactccaatccagactgttctggctccaaagccaaacccttccacccgttccgtgctattgttggagatgtgaattccactgatgtgaatttctagccttctgcatatgacttgcccacagagcattaggtgatacttatagtattaattcgactgccttttggcatggttatggggcttctctgcaaattgcttcatcctcctctgcataacacccttgtgtaggaggctgggtagacattactaaattactttcactttacagatggagacactgaggccctgagacatgaagggatctgggtaaagcaaaacagctcttgagtagtatttgctctgtcagtcagtgtgccaggtgcaggtagcgtcatgtgccctacctgggtcttaaggaatgatgagatccaggcagctggtgctgacagtggcctgttcatactcttcctgaaggtatgtcacctggctttgtatgacagcatgttaacaacatctgtaatttgggcaggagtgaggagaaggaaaccacagttaaggtatgtgtggaggtactatgcaggcaaaccagcccacaagggatgctctggtcactggtgcagatgatggaaaacacctaaaggagaaccgtagccaacactgcaaatcaggcagcatgtatcagagtttaaaaacctcagggagttttgggccagcaaataaaatgtgctccattttgccagagctgaggggattgggcaagaaggagcacttagaattttgacactgcactttgatcagtttgacgggtttagtattatagaaatatttcattgtttcagcagagatgaggaaatctaatcatccatacagctgcactctgaatttgtcatgactcactggagggtagggtgtatggagggagggggcagagaaagaaaggaagaaagaaagaaacagctgatttaaaatgcagtttaacctgaggtaatttggcccattagttcaaattgtgtttttttcttccctccttcttttatttaagtcattgctctattttcaagatattattttttagaggtggcatctaattatgttttctctccacattcattttgagcaggtaataaaggctatagtgggggagttctacggtgattaatggaagaaaatgcagatggggctgaattgaagcaacagcatagaatatgattttataaacaggatagaaagaaattaaagtgctgcattgctaaactcagtggagatggtattcattctgtgtttggtgctgcagtagtggtctggaattgtctgcagaaaagtctttctggatataccagaccagcctttggtgtcactaggtcctctgacttgagtgtgacacaaaagccccccactcacagatccctctcctacccaggagacatgttccttatatttgtgatgtattcctatgggcaaagtatcgctctagcccagcatccccttttgtcttgagagggaaggccaataagataataatcccttagcttgactgtggctccaagggggaggtgctagtagaggggctctagtagggtgtcttgatggggcacaggggatggggctagggacagggagcacaaaaatggcctgaaagataaatttgtatttttgcattgctgggctaaaatatatcctttccttgttgggagcagagagggtaatccttgttagatttacattaaaatgaggtcgtgcttcttggaaaaagccactcactgagaaagaagatatccattgttccatgagagtcccccatggtagagtgagtgacaaggttcttggaaatatcatcagatagtgcttactttggggctgagtgagaataggaaagtggcagaacagggaaaaggttccaccacaaggagctcattcctgcagacccggaatggaaaaccatctcctggcattacataacacaggccaactctctcttcttaacaacaggaagaggcaattcaggtcaaagacagactctcctttcctatgcagagggctcttgtcactttgttaatttctttgtttgtgcttcaccttctgttctccatttccacttttcccactcccttggagcacagatccaagttttaatccagatgcccataatgctgctcacccatcacctacctgtgatatggatattaatatgcatataattttaatgatacagtctttatggtctttcaattcccttacttaatacttactatttctgtgtttgttcatagtctgttggctcccgtggggccagcacaatgactcttgcaggtctctgtaattcatacggagccagacactgaactccaccttcagatatcccatgcccatgtgttgagggtgacaaggaatgatttctttcatctaaccagagttcaacaaatgcgtcttgatcttcaaagaaaacacctgagagtccacaacaagggccataggatgaatgggaacttttagtacatcggagagtttaaaaagcacataggggaatataagttgaaaagggatattcggcaacaaatcagactcttgtgcatagaaaggagagatccctaagtggagaggatgtgaaaaattcagaatgtggggctttgctcatggagattgtagttcagtaggtcagggttagaagtccagaatcttctcctcaggcaattctaatgcagctaacatttgggaaccactgaggtcttggatggctcccaaatgaagaaactgaagcctaggaaagttcaatggctcatccaatgccatacggctaggtgagagggggagagtgagactaccattccattgctcttttcattaaccttaactccaccactcagcatttcactagcagagaatgttggtctgggggtaccaggaggttgaatggaggacgcttgtgctaagaagggagaactatttagaacacatgtgaaactctatttacaccaagctttaaattgaacttcccatttcccagtttcagcttccagaatgcaaccttaatcttgttcatttgcataagctttaaaataagcctttagaacaaatgtaaatggatcttcaaagaacaatattatgatgggttcagtgtaaatgactcaaaaacatatggatggcatttcttgaggatttcccagagagtcttgctgtctgtctgtatgcaagggaagtttattatcaaagcaaaactgggggttgggagaagtgtggtattcttaggatagtgtatcctaacctgcttgtggttctaatttattttcatgcctcagtgagctggactgataatatggaatggccaacatgaagcagaagtcaatctcttcgtcaggctgaatgtggctcacagaagcatctcacaccccaggtcataagacacacaacatggatctcagaactggaaagaacaagagattttcccataaagctcccctcaccatgggcatgaggaaaccaaggttcagagagggcaagtgacttgtcaaggtcacatagccagtacatggttgaactgggacatcagcctaggtatgtctaactccgaattttattttctctcaaatatatatcacctagcagctaagaaatcagcagacagtggactttagaaccaggcaggcaaacacagcttcagggtgaggttaggcagctagaacgttattgatcaacaactttgccacatcactggcacattcgttgctgggcaacgtggctcctctctgaagaggcaagaaaaagattctgaagatgatggatctgcattaagcaaaacccaataaccaggcactttcaggtcaaaaacttggtttgctgtggtttggagtttctaggtcagctgcccaggggctgtcccctgctcagcttatctgagatgaggccatcagtgaggacctcctcagagagaagagacaggaaaaccaatttaagattcccttagacagggcagatggagatatgggcttgttttctgcccaatgttagtattgtatcttatcttacagctaggttgaaattagagtagttggcaaacaaacaaacaaacaaacaaaaaaaacagcacaaagagatgacttggggatgggaggtgggtgctgctaaacaggggcaagtcatttactgccatgggcctcagtttccctatttatagaacggtgagcctggactagcttcatgttagtctatctacaggtgctggctggctataataatcacctggaatgtttgttaacctagagactctgaggccccaatttcagctattctgatttaggaggtttgacatgatactcaacaataatttcatccatgctatcagaggtatttactgcatgtctaggagatgttctgggctctgtgttaggtactgggaatataattgtgaatgcatattgaatgcaaagcactatataaggcaaatggggtatttaaatctttaaagaagaattcttgttggacgaatggcagtgtaatattacatatgtgagatttagtcagaattggatttgaatctttacttttctacttactagctgtgtgaccttatttatgcaatttacttaacttctttgatctcatctctaatatggggatatgattacggtgcctacttcataggatggttgattattacatgagataatctggctgagttgctcagcacagttcctggaacatagccaaggctcaccaatggcaaatacacacagattcctggggttttaggagcttgtaggagtgtgtgtggtatgtatatgagtgtgtgtgagacccacagcatgcatgcatgtacagtgtatacgtttctcagaagaaatttagtgatggggagactactatatttctgcttggcttcatcaggatggcctcatggaagaggtgacattagatttgggccttagcaatgggcagaattttgataagcagaaaagaagaggagcagaaaatgttccagaaagttgggactagccaaggggcagagggcccaggaaggtggagctgtgcttgggaaagtggtggacaggccattcatggaaggcttccaatggctgaagggccttgggtgccagtcaagggacaaaatggacattggtttgtcttctgaaacacacaactttttttttttttatgggtggaaagcctttgataagcatttgttgaatcaatgactgagatgttgagcaggggagcagccttttctgggaggttcacccgcaggaggtgtgctgaccagagaggatgaaagggaagctggaggcagggaggtcaggactgccatactgtcccagacatgcagaacaggctgctggactagacggggacaaggaaatggagaggtggcgcaggtgcgaaatgtatcttgatggaagcagcaccaagttctggagactgatcaggaagcaggtatggaagaagcagcagagacctcaattttcaaagtgtgtatctggaacaatacagaacagacagagccactaaatggggctgaggaaaagcactcagagcctttccaggctaagccagggctccctggcgtgtgccccatggtgctggcaatagtgtctcgtggaaactaaggacccgatgaacagtactcgtattactattctttataatgctcatgccaatgtcaatgttttgaatgctgccttccctgctagaatataggcttcatgaggcaggtactgtatttgccctgttgcctgctctgtccctgacacaataaattgtgtctgccacatagtaagtgctaaaaaaaaaaaaaaaggtgggaaaagtagctgagaactggtttactgaggaaagaagttgactcactttcagacacattaggttggaggtgatgcgaactgtcttgctggaagtgtccactgggtagttgcatattctggttagaggtccagtttcaagagggagaccctggtcaccactgggcacctccttccacgccaggtatcacctccctgtggccctttccttgagaggatctcatgggacctccttccaaatccatccctagtctcccggccacacatactggtttctcccccgaaaggctctgaatttgagctgtggtgatatctctgtgatacaggatagcctcttttgcctaaagaaaaccactctgaaattgcaggctttcaaatgaagctttgtagtacatgctatagcaattcaaaacggtggagggaggggaagaagtctgaacaattgcttagctcattaaaaacagcatttggttcacatttcaacatctgaaaaaaaaagacaaaatggaattttacaatgtggtcacctgagctaagaaagattagtgaagcaagatcaagatggaaaacaaacaaacaaacaaacaaacaaacagaaaaacaaaaaaaaaaaacaaaacccaaacaaaaccctcagataactggttgcattactgtgaatacttggtacggctacttccagtggctctttatttcccctgtaaatttgaagatactggcatgaaagccaaaacaggagatggggagataagaaaaaaggtattcaggtagtatcaggtggtctaaccactgagcttcacccccttggtgctgtaggtgagagcttagcctgcagtgtctctctggattcttttgatcattcattgcttgaaatgtgggtttccataacttcacaattcacctccaagatgtagactgcatggattcccaaggaaaaggacatctgaaagttccagaggccaggcttggtgttgggcgtttatcaatgtacaagtccctccctgccttactcctgaaaggggcacactagtggttactatgactagctggagcctgcttggcctctgtaacaactgaagctgctggccaccctgccattcctgaagggtttgtgtctctctttcctccttgtcactgtttgcttttgctttctctcctgccactccatctgctttttgttaggtttctttgtggacttctacccaccctttaaatgttggtggtccctgagggtccatagagattttcttaattttgtctacattccttattctctttcacctatccggcaattttgaaaagaaatttctatgtgccagacaccgtcctgggcatttggggatatgaacatgaatgatgggcccttgcctttaatcagcgtgtggtttattaaaggagaaactatgtaaaacaaatacaacaaagtgtgatatgtattgtgcaaggtgtcatggaagtgcagaggagagtgggggtaattccgcttgggacttcaggatcagctttcagcaggaggtggcaatacattgagactccctaattcatttctgtggccatgaccacccctgtcttctgagctccacacttgagtttcagatgacttgccagacatctctactagcatatgctgcggatacatcagactcacaattttcaaaatgaaacctcaacctccttacattgacattgccagccacccagtcacccaatctggaaacctgagcttgattctggtcccccctctccctccctcacctaaccacaccctgatctctatgatcaggtgtatctctatgaaagttctgacctgcctctttctacatgaccacgaggtctgctcaagttcaggccctcgttatctctaacctggagtattacaagtattgcaacccctttccaactctttggtcccaaaccccattgtgcttagcaagaacctgcggagctcctcacacactcacatcctgcagtccctccccttgagattctggttcaggaggaacagcctcacgtggccctgagaggagtggtttgtggaccacactgaggatagacagtgtctctctgcttttagtgtgctctgttctaattagtgctggctgcttccagggtatattctgaagcatagacatgcttctgccatcttggcttaaaaacctccagtggttctgaacatcttcacaaggcattgaagacctttcctaaaatgactggaatcgcctcagctgtgtagctaacttgttttccttccccatcaaatgagcaagttggcctcatagcatagagcttggctcttggcttagtcccaggccagcaggcctcatacctctactctgccctgacaagttgtaaccctcagtaaataacacaatcagtgtatacttacaaaggctgttgtatgaggattaaataaaatactggggatagagctctttgctcattatctagcgtagcgtaagtcctccatactgaaagctagtaccgtcgtcccatgctcttccccattatgtcctctacactccagttatcccagaccatttaccattctctgattaagtcatgcaacctcatcgccactacctgggactgtctttccttaattagaaaactcctattcatccatcaaaggcctgctcacatgttccctctctgcaaagcagtgctctctgtggtcgtggctgtgctcacagaaaaggcactgtatatccctctttcgtggtattaggaacctggtataactgagagcgcatctcccttgagttccttgagactagaaacggttttatttattttggaatctcaaacctagcaaagtgcctgtcacagagtaagcactcagcgccgtgaatgaaggaatggggtgagggaacgactgtgtgcagagagtcatgtgagaacccctgttcccctccctctgcttggcagagctgtcctttgtagaagtgattctcagtggcccttgccccttagcaacctcaggtcaactggaagactcccctccagacaggcgttgcggtctttccctatcccacagggtctagatgcggccttcccaggtgactttctgctctactctttctcagtctccatctgacccgtgcctagcatcgtggcccctgtaaagggctcttccattaataattgcctccctagtgactgatttatctgctccttgaatctgaggaggttcaccttttaaggtgaaaatggccagtcactgaaaagctgaattgtttttatgttattcccgttccagtgacttcagaggtggcccagggcccatcatttgggggcaagaagctgcctggatgctttctggccttctgggtgtgcagacaatctcactgtttcaccagccacttccttttactcccttgcccaggcttcagcggcagaagacagtgtaagccccaggaaactgtgacagcaataaaagaactaaatgttttctaggtcaccgcctgatcaagtccccacttaaacaataatcttgccattgcatctgcaaaaccccagactcaggccccaaaaggttatttcatcaataattcttgagcttgcctacggcgagaattattcccagcaggcgtttcaggccatctctaaacaggctctgtggaggcgaggcctggctccgttcaagtgcttaggcagggaccattaatattgttgaagggcaagggcggggcaggaagggagggaatcgtgtgctgtggcaggaaagaagaggcctctgcgggaagggggcaggggcaggaaggccaaggctgattcggccttggtctggcaagggaagctgcgtttcgtggtaacaaatgaggattaaaccaggccacgtgtgccatccatcgctgtgataaaagcctctctgcccaccgaaactgtgcatgggatccttttgtaatctgtaggcttcagtctatccagtgcctagctactgtgttgttgaaacgagcttctttgatttactcagtgtatttaccaagcaatttgcaagaccaagtaattccttctcagttcattgcctcgtaggtgggagagccgcttaggtcctcttatgtgacctccatccagccttcctgggccttcttagactcctgttcctatcagcttttcatctcctctccctgcagtctccaggtggcagggggttgcgaccaccttccctggagagtctgggcctctgcccagtcactcctctgagccatgaactttttgctattgtgctttccatctcccgctccaagttgacggctatggcaccttgtcctccctgctttggagtcagtgatgaattccctccgttcatttcgactgttttcgtggaggtatttatagaccgtgattgtgttcccgctgagccggatcctttctcaactatataaatttgactctctcgctttctcccgatacgacttatctgctaatccctagaacatttgttggtatttatgtcttgcttggattttctacaccttttctaaattgctccgacttgcgtggttcaagttaccccattcctcggtgctcaatcaaaagagcctcatctccccatcctcgccggtttgctcctggggacatcatctgctgagaaccagaaagatcgtgcaaggggagaggaggttaacagatggctcataattatattacaagagcatctctaaaggaaataggatcatttttcaagtgacttctttaccaaagtcttctgtttcaattcgttctccccaccccagcaaaaagtccctcttaaaaaaaaaaagtcagccattcatcttccgagaagaaaatacaaaagtccacccagtctttacaggggaaaggagacaaatattaaggggtggaggtgaggaaggtgaaagtgactgctgtgatcattttcataaccggaccctcaacatgttcaggctgcctgctgaagctaggaagtccagaatgagatttatcaactctcaaggccacggaagaccctagagattgttgtctaacctcattttctacgtgtggagaccgaatcagggctgtgtagagaaaccagtgcgcgttttgatgccactcattctgggttttcaggtctgctcatctgtttactagaaatgagtggttctggatgaagtttcctgactttactgaacttcagtttagtttcctcatctgtaaaatgcaggctgtgctacttaaatgggggctttttgtggatattgaaaataatggatggaataaataagtgccttgcacatagtaggcacagaatacacaatcattgctactgagtcacagagcagtgaagccacctgcccaaagccactttgtcaaacctggggccagaacttggggcctttatttctcagttcgggacttctactatggtacttccttctccgtagccaccccattgaacacatttctgttccttgaaggtggcatgaggatgttctcaactatggcactctggttgtaaatatgtttgatgctcctacgtgtgggtgctcgaagcccacagtgaagcttcaagtgaggttagccagagaggaacactcttaccctctttagaaacagaagggactggagaggtttggctgagagacttaagaatgtagtatgaacttatcagtgaatgtagcagctaggcttttcttagggcaactgggctgggccagggtcactagcctgagctgtggctagtggtaaagcttctacagaactgtttagtgggaaagaatcaacctgtgttgccaatcattctgctgtgtgatttacaaatgccatctaatttagtggttccccagcttctggttccctgacaccaggaagtaggtataatgtttattattttataggtaaggaagctgagacctagctatatcacatggattgtccaagctaacaaatggtagtgcaaacgttggaactcaggtcctcagtgactgatgctcatatattctttccattttcatgagtactaataaaacacatgatagttatcactttagggatggctttgatttgcagggcacctctccctaaggtgctaaacacatttatagatttttataaatccaattaagtttattatcttaatatgatcttgtctaatttatccatatggatgtgtacacatgtgatttggacaggaaaatcaatttaaatgatttggaccaaatgtattttatcttatgtcaatgctgtggaatttaccagagaattgatgaaacttcatgtcaacagtatagacacactgtcggaatgcatcctgtagcgccacaggactcaggctggatgaacttccccctcagctcattcaatccactcctctaggtctaaaaggaagcaagctgtcttattctgaaaggtcttcaaggacaaccttcctggatgcaccatctccttgtctcacaattcttcacagccagaaagttcttatgcctaagcagaatgtctattgctttgagcgaaccacttttccttctgttccattcttgctggctaaggagaacagctgggaaggtttcaatatctctgttatgaacttgaaagctgttttaaaaacactgctcaagtttctcttctgctagcccaatacacttgattcttttagcattcgtcacagggagagatgattttctacacatccagccatttgttaagagagttacgatgattttggaatgtgagatcttaggggggcaagagtgaccactggttaaaaggctgcacaagtaatcatcgcaatatctgctacaagtggatcctcactaaatattctttttgaggaaaaaaaaaaagaaaatagtgagaactattgctagatcctggtgtctatctgaatatgggaagggaaaaccatagaggagaaaaagagtcaaatgaaagaggctaaatagggaaaaaagatagtccataccccaaaatttgtatttctctgttagccaaggtagtagaatattatcataaaagtgtggagtttatttcttgtttatttttatatttttagagatggggttttgctatgttgaccaggctgatctcaaactcctggcctcaagcgatcctcccatcttgacctcccaaagtgctgggattacaggcatgagccaccatgccaagcttagaatgtagagtttagagtaagaaagaactggcttcaaattccagctctgccttggtgtgtgacttcaactgagttgcttcatctccttgtgtgtcagctttttctttgcaaaataggaacaatgatgatacctgtccctgagttatgaagacggggtaagctaatgtattgaaaggatttcccaggctcagcgtgggttggttgggggggtttcttgaagcattgtagctcccattattctcttaaaccaatagttgtctatgggtcttgggttttgaaactatcattaggaacttcctcacttttggattttgcagattcctttcctgagagttgaaatgatggctttaaaaaatgtcaggattagttgggcatttatgagttcaagggatcctagatgctaactggatgatgagttaattatgtagctatggaattaacattatcattacagtgctaataataataattgcataatagcattattcttacagcggaataagaccactgagtgttgttcttgaaaactgatgcagaattagagaatacttaactctctcaagtttgggtacaatttctaagaatctatagtttagtgactcattggcactctaatgactactattccccccccacccactgcctcccaagattcacatgtgaaagaatgcaaattcaattcctcctgacaaagaaatctaaattcatggattttcccagctgtacccttgagcgagaactttcccaaagtgaagagcatggaaaaaaacaattggttttgcatgtttccttgggaatttcaggaggaaatggagctggaaaggtggtgttggaggcacggaaatgttgatggagaaaagccctcttctttgtataaaacatgtgccctttgttgaaggaagtggtagcaggctgccatgaacccagttttctgagctcttccagaatctcttgtgataatattgctttgttttagctgagaaaccttggggttttatgtgacccatgggtacaaagatcatgatggagacataagccctccacaaatattctaccttcctcaagtcaccatttagggatatggggtgaatgaactcgaggaccagcactcgtccaataaatcctgctctaggaaagacaggagaaacaaataggctaaaagttccccagggcatgaaatcttggtagatgtttgtttgcccgctccttacaccagaggaggcctcaccactcaaagcaacctggctcagagcagacagagcatctggagctgcctcagaggggctccatggcttcctctccaatccacagccagccaggccttccagaaccagacaggagggtgcttcagttactccaaggagccactttgttccatcctgcactactgggatgtagacggcccccttccttagattacttaggaaaaaacaacaagcaaatatcacaattgaaaaagaggcttttggattgcatggtgattttttaaaataaaatgaaataaaagacaattgtgggggacaagagtcttctctccagctctccagatggaatgtctgtgttgattcattgactcaataacaactcaagtgttctattttcttggacagtggagatctagttcagattatattaagatctagggaagggtgacaaatggagtatcaccctataaagcagaggactgagaacctgagcattggatctgagctcctgcctcccatccccagttctccgtatgatgctgggtaaatctcatcaccacctgtctccttacctagaaaatgggaatcatcacatctgttccctcatgaggctccatgcatcttcattacatgcttagagatgattagatagaagggtccacagatcgtattagtcttaactataatggtcttaataaatatgtatgctgcccaagaagggagtgtatggtgttggaatggtttatgtgtcttccttttcagactgggactgggaaatgaggggaatagcctactttgtcactatttatcattcttagttaacaatgtaagatacatgatggctgctaaacaatttggtggcagaacctcataaatgaagtctgttttccctggaaactgcataaccatttgaattaatttaatttgaaatatcaaattaaattaaactgtagaataatccccaagggagagcatatttcatttgcaatgtcttttgatagagtagtccctgccaaaagttttgctttgcatctggctacagatctaaatttattgcattagctttgagaagacttttaatagaaagtgagattaaaagaaaacttgatggaaaataaagatgttcactgctgaaacagcattcctcagaacgtacctctctaactttacactctctatatgtctgtctctggtcttcaattcagaccgtgtaactaggctggatgcctggttgaagggctttcttttgataatgctaattaacatgcacagaaaatatcagaacaaaatgggcagagtctacttggtttaaggcctacaaactgcatgtctttgctagataccgctgaaggggatcgtctgcgaagaaagaatagagatacgagataaattaaagggatcatttttaaagtcaccagggagttcgtgcgcactcagtggtgtcaggtggctgtgttgtcttctttctgagttgtcttctctcttctccttcttaataatctcccgtctaagtgcaggtcttgattaaggctttgggtctacaggttggaaggatagaagctgatggtgaatccaacagtttcctaaaatataggtcaccacaaatcaccacttaggaaatgactggtctctttctccatggccagacattgatgaaaattgtactgagcagctgcctgaaagttgatgcagtgggaataatttatttcttcttcctggtgagcaaatacacagcaagagaggcggatgtgaagaaaagctgtttgcttgacacaaacagggctggccctttaagaaaggtttgtatgagtttaaattgggcccaaggaacccagataagagtatcttaatcaaataaaaaaagcattaggctttaatctccagcactttagtaacctcctagtttgttttaaatcttgattggaagaattatcctgacaagaaaattagtagtaagtcaataagtctgtggcccaaaggtagggcattaagtaaccagagggaaaaaaatgtattcccatccgaggcccttgcctgccctcctgtagccacaaacatagccctgcagacagttccctcttgatcccttgcaccaggctgggtggagaagttcattataattttagccatgaagtcctgaagtgcaggtaatcgtgtttaaaaagatagggaacatgacaggaaaagaacccagcttcatgaagaaattctaattttcagcagtcatgggtggaaaatcaatactactctgatgcgaaatgagaaccggactggataaagccacctcttcccattgctctctttaaaaaagacacacaccagaaagtaaaaaaacaaaacaacaacaacaaaagaaaaaacagaaaaaaacaataggcctacaataggaaaggtctgcgtgctgacactctcaacttccctgagtgcctgtacacccccgcccccaattcttgttgccagagagccctcccctggcagcaatctaattccagctctccttgtcagaatgtgtcttcctgccagcttcaagcaactctttccatgccccttctttgcactttttccaccccctcaccactaccctgaatgcgtgctcgccatctgccattcaggcagagagagagagagagagagagagagagagagggagagagggagagagaaaaaacagagagagagagagagagagaagactgagctgagcacccagcacctaattttggaaactcactcgtaatttcaatcacatctaggtgttatcttgatataagaacaggtatcattaattgactagcaatggaatgggagctcttttatactttatgatccattgagagtggcagctttagacatattggaagatttctgttttaatcaccgattatgtatttggccaataaagctcatattgttaacattaatatatacatatttataactcgatgaagccagacataattaagtagaaatgttcgaattaacaatgatgataatcattcaaaataagattcccatgatgtcttccagcagacgactccacccccaacactgccgtgagaattgtatgtgctgagatgttgttcttctcacccttcaaaatgggctgtcaaatttaacaaatggtaaatagaataataatgaatgtcttcattgtgttgtattgaatgtcatctgtattctaaaacctctggtgttggaggaattcttgcagagaaaggggcttccaggagggcttcagtacaaggcccatgccagtatggcaggtcccttagaaggcatgtcttctggatgatcaggccaacagttgaccaggaccaggacagatgtattgttggtctaggcccctggaatgccagtggcgctatctcacatccctggaagagagtggagccatctgctcatcttggcttcagtagttacatgcaacaggttccccaaggaggaggcatgcagctctgaagtcagcagggagacaggggagaagtaaagcctttcttttgggtcaagcagacatctgctctccattccacctccactcccaatgtgccagcacagctttctccttcctttgctttgagcagtgtatactctgaattacgtttgcagtatatccctgcgtccctgccaaattcactggtggggaaaattggtggtattgtgggtaagctgacttgggacagaagtccatttctcgaaggcaccacctgcactcaagacactggtttctttgagtgcctggccagacatatccaccaagactcaggggtctgtcttccaacaaatgcggctccaattctcacatttttatatgccatgttacacacatcatttctgaacctctcagaagcccatgcatttctgagcattggcaatcaagcataaagttctggggcaagctgtgaaatctctgaaatgaaaatcaattccatctccatttcatggagactaatgtggcatttacaacataaacaatcacttctgttagggaggaaaattaaaagctgtgctacataaaggcacaatgtttaaagttctggtggaaatgagcacttggctttgagatgattacaaagggaattggaaaaagaaaataaaaaaaaaaagaaaagagaagaaaagaaaaagccagccccaacaattcagaagtgcagaggtttcataatacaaatttgctatggctgacaccactggcctcagctcagacctctgggagaaaaagaaaatctttgggcatttcctaagcaatgtgggaaaggtatttcaagggcccaggaaagtcacatctatttccttttttgatagtgttaggagacacagacaatttcctatgggaaagggcttgagacctacaggataggcagggggcccagcagttttagggtcccctcaaagtataggtcttttgaatccttgatctggtgacatttttcattatatcaaccttcatttctgtgttgttataatagggctcatgagtgtctatgtgcagaataccaagatttacagattgaaataaaaattaaaggcaagaaaaaaaaagagtctactgttcttttaaaagcctggaaattagctcatattcaccactagctaactaaggaaatctagtcaaggatctccacctctgaagactcagtttccccatctgtacattgagatactagaccatgtgatactagccccaaagggagctgtctctaaaattttgtcattctcttattctgtatgggatggcaaccaaccattcaattggtatcatttgcaagggtggtggggaaaagcataagttgttgccaatcgggaggtgctcatttgcataatgactgattccctaattagccagaaagacttccagtgtcgccatgtaggagcacaccagagttcctgctgtgacgttacttagttgagctctccgatttggctattaagactctcaaagtactagccagccactaaatgacttttcgataaagctgcccaggcaattaagagcattagcataaaggaatctttctcaattagctatttttagagtgggctggaaatgctatcttgcagctttttagaaatttttataacagtattatgtttgttgtattaccagtgtcacatgtgtatttttcattctatttttgttctgcatcaagtaatttgtagtagtactattttgaggggtagttatttgccaaccatttgaagagaagtcaaatgaatttctgataaaggcagccctcgttaattccaatctgagcatgggacagcccagggtatggcttgtatacctatgtcagccagtcatctcatcagacatcttgatttgccttgatcaaagaagcaatttgtgagacattccctcccctctccccaccaaagtgctaatcaccttttcaaggtagaagatagatgggaaacaccgcacaaattgcttgccattgccccaaaatgctaatcacttacgaacatctaaattatgactggagaccttgcatgataaggtaaggaaacagtgtcagtgcatacagaactattatttaccagtgtcaaaaataactatcgcatttgcatagctgtggcgctagatgacaatttctccctcaaaactgcttccgtagcagaaaaagctttgaccgatatgaagtgtggcatactgttatttttttaacccttacaaaatggaatgagacctcttggaattagatgttagagcactgatttgggaaacaggagctacccaagaaaaacaatttaaaatgctttctttgattatatttcctttgggtgcattggttgctgtcttgtgtaagccaacggtctccagagtgggtcatgtacaccccagggagtcatttgacccttctgcatacaggaagaaactattttatttcttaatgctataatgtctactttgtgggtatttttgttgtatcgtttgagacgaagtcttgctctgtcacccaggctggagtgcagcggctcatggtgcgatctcggcttgctgcaacctccacctcctaggttcaaatgattctcctgcctcagcctccggagtagctgggattacaggcacccgccaccatgcctggctaatctttgtatttttagttgagatagggtttcaccatattggccaggttggtctcgaactcctgaccttgtgatctgcctgccttagcctcccaaagtgctgggattacaggcataagccactgtacccggccatgggtatgttttttaatgcatgtcatatattagaaccagagcacgtgtatagaatttacagagaaatgcatatattctggaggtatgctcatagtttttactgatggatgttagtgataaaggaaaaatctgtggagatcattagacaacacgtagcatcgtgctggccaggaagatggcctgcttctaaggagaagtttctagagggacaagctcattagctgtagctacaattatattgttagagaaggtatttccatgacataaagaagcctgcttatgagcactagacataagtatatctaacatcttgcacccatttctattcagacaataatgaaatttactttcctacagttataaatatagtctctcaaagtgaagaatcacagattgaattctttttggggtaggaaaatgcatctagaataagagacacgtcagagaggaagggccaagatgaagaagtcgcaggaaataaaactagtttaacaagcctgagtacctaggcttcctatattaacacagacatcccatgccaaccccagcgcaaccccaggactccctacacagacagaaagacctctgagattgcccaggcaactggttttgatctagcacagttttcttcttatccccactggccctgtcctcttgtctctcattcattcaatcacaaatatttattgggtgtttaggatgtgccagacatagttctggcaatcttgagatttttctttccttcctcctgtctgtctgggggtcacccataggtctccacgcaggaatttcgagaggctgcaaactcatgattcctatttattgttcattgctgccctactgagatacctagatcatcaaatatgtttcaaacagagctctagcagtgggagtagagatgagaactcatagagagaggagccttctatgctcagcctaactgctctctcacttcagaatgtttcacctagttggtcttttcagttcgcatttctgggaacatcaacaaataccccattcatttctgagaagctgcttcatggtcaatcttgagcttattgctggagagatccaaagaaacaccgaagaagagtcagtccctgttctcattgagcttgcacaagagttggaggaattaaatacacacctaagactatacagaagcaccatcacagagcaggacatgggtaagtgggagagctctgttcaggatctattcaggatctgcaggagttgagaggctgttgtgatatactggaagcagtctagaccttgaagtcagaccattatgattccagtctcagctccatcatttatcagctatgtggccttgggcaaaccacttctctctctgagtctcagtttgcttatcaacagaatgggaataataatacctattgataggattgttttaaggattctgtgaaacagccgatgtggaaaaacactttataggctggaaagttgcaatgcacattttaggaattaccattaatggagggtaatctctctggtctggagtggttagagaaggctttattctgttatccactgacaccctccaggacagataccgttaaacataaatgaaagagggaagatgaagcccagttgctctatgcattctttactgctggaccatggaggatatatggaatgggtgtggaggtggctcacttcctcctgcctgcttcttctgaagaatctactagggcttggaatacctgtcttgatcattctgagaagaatggaaacactgggaagatatggtgttggcagggactcgggaccctgcaagacccagtgggaaaggaaaggtggtcaggttgtcaggcccctgcactctgcccaggcaaaggtattcacaaacctccctgggggctcaccagaggggactgtgatgagttggcttctcaggagtttcctactcgctggggcctgtgaggcacagcaacttgcctgcttgtccccagcaaagggcagtgtccagagtccattcttcctgcctcatcactgaggaggagcaagacaaccccagtcccagccctgctcctttctctttcaaggcatggttaacagttgacagtgcaatgtaaatgctgggaagtgtcaagattagtaaacaggaagaggatttggaagctaaatgcatgcctaactcaaaggacagattatatggttacactgttattactttgagacatagttactctttcttctaaggaatcttgtagaaatgtgattatggtgtagtttgtgtatatcaccagatcttatgaagtagaccagtgggccccactcagcccctgggggctagagaagagttatgagctgcactagtttgtcttggttttatcttcattcctatgaactctcttgggaagaagtctccctaggaagctgctccccgctttcaatctcattttctgatatctagttgtgaatttcctataattaaatatagtttgggctgggtgaggtggctcaagcctgtaatcccaacactttgggaggccgaggggggcagatcacctgaggtcaggagttgaagactagcctggccaacatggtgaaaccctatctctactaaaaatacaaaagttagctggggatggtggtgtgcaactggctaccaccagttgcatgttgaggcatgagaatcacggaaccctggaggcagaggttgcagtgagctgaggtcacaacattgcactccagcttgggtgacagagtgagactgtcataaataaataaataaataaataaacaaacaaacaaataaataaagtctggtctcctggttgttcaccttggcttactcatctttccttttgcagatgccctggtgagtgctgttctgaggcaagaccaattgactacaaaaccaggtcaggttaggtacccaaggcagatgtgcaacatttattagaactagtgccaactgagacaaaaattcctagctgttctttaaaatgcattcttctactcttctttagctactgttaaatattagtagaaaataagactgctcagaaaaggcacttcattccccagcctcccttgccgctatgtgatcaagtcttgggcaatgggaggtgagcagaagggctgtgtaaaacttccagatgaagcctttcccatctgtttctcacctccccgttgaccagaatctggtcacagcagtgggagctggagcaacccttgtggactcagaaatggaaatcaggctcttctgtgtacctcctgatgctagtgacagagcaataaggtcttttctggtttcaatgttgttaagttgagcctttgtcacatggccctcaatggagacctttgctctggagatcttcagtggaatacctgagagcgtagactcatgtcacagtctctttcgtcaacctgcttggcaggctatctgtggcttaatgccaagtggggtctcgagcaaaactctattgaatttgggaccatcttttgcaatagcgtctgcaactcacgattgaccccaaatttctcctttgtttcatttccctttggttgtggctgacagctgtggggctgcactctcagaggccacccatcctcagggatcctgggattcaactttgagagcataactaggtaggtagagaggggctatgcccaggagtattgccccaacttccaaacacattcctatcctcgtctggcattgagagaagagtgcaggactgggtttgagagcagattctggctctgttgtcagcaagctgtgtgatcttgaacaactcctcttctccctgagcaaaatgagggggctagatgagacgatttctggaacatctcccaatgtcggcgttctgtgatgtgacaattccatgaccagcctcatggctgaggtgccactttcgatacataaaacaagagtccacatctgtgccaagggctgggcagggcagtgctcctcacttcctccatctgctcagcacccaacagtgctctgatgcagggggagaagagcagggagagggcatgaggatgcagtgggtgggaggtgttaaaaaggggactgatggtggggtccttcttttgagaattctagtctctctggggccacatgacacccgaacacacagaatctgtgggaacaagttacccaagaaatgtgcccaggctgagggaccaaggcccagcgagagtaggtggtaggtaggcaatggccagtggggccagcgcgggtttgaaatctatcttccccatacttgctgcatgaccttcaatgagttcccacgcttttgagcctttgttttctcacttgtgaaatggggacaatagaaacacccctctcaaacgtagggaaagcttgtccacaaagcacttgacacacagtaggcactgagtaaattctagcttccctggtgtcccctctcctttcctactttgaaaacagcagtctgtctcattaagtatcctacttagttttcagttgacattcccactctcttaccttctgccccctgaatttttcctctcttttcctgtatcttttttcccccacaactctgcattcccctccccatccacagcatagttctcccatcattccttctttgtagagggcaaggaaaggtgggttatacagatgcccagtgatatttcagaagctctaattaagtggaagattatgcatgccatttgagttttaaaagacattcagatcagaatgaatgaaatgctaacttttcccctgtctaacccactcacccacataccctggggcaaaatgaaacataactcagtttttcctggaaaggcatcagacagcaggtcgctctggtcaatgggcccacggcagcacccactgtcttggcaaatgtccattctgtcaggcgccctgcctcttgccacctctttcttagctagatacagatggaaaaaaaaaatgacagcattgggctgacacctgcatcgaatggaagctacacatttctgtcctagagataggtggcagtgtggattcagggctgtgtggttcaagatcaacttcgcagagaaacaccgtttccagaagcagtgaggatctttcatcatatgcgcctctgatgctcaacaaccttctttgctgcacccgccgctgcctcatgaggttcctggcagctcttactgcgccagtaacaactggatctcaatccccaaaacaattccctgctcattctatgagttacagtttagttaatctttggttagcacatgcacacgtgggcacgtgcaaactctctcagtgtaggctctgaatgctgcttttatgttattgcacacatgagtggaacatactatccagcttcttagggcctgtgctgtaagcctccggggccatataaacgcggctattttcacagtccaacttcagaactcagaggggcagctctcctttggactaggcctttggcaggagtcctctactctcggcctggatcctcttcaatgaaccacctatgtgtcacttatgtcaatatctcagctctggtttttcaagtgcaagggttatttgctatattttggaaacttttgagggtacaaatagtatacaggtcaaaaagtaaaaggtatcagcttagagaatacaaagcaggcaatcatgacattcctagagatggacaggagaccatttactggagatcagagagtaacaaagagtttctggaatcttcaagccatctatggttgcagaatggtaactgagaagcccctgatggtcaccaaataccctggcccaactataccccgtggctctgccagttctttccattgactaaatatcagtttcctcatctgtaaaatacagaccatgacaatgagcaaccttcttaggtggaaataagatgaatcttgtcaaaattgtcttcaagcttatctacacatgagagtcaaaccctcaccccaacaccacaaagctaagcctctgaggtgtgtgtgcggggagaaatctaaaacgaaaccagcaacccactgccatgcctgctcaaccaaccctcccagagcatacggcttttactcttccttattacaggtgttcataatgctttatctcaacgggtctgtgtctcctgcatttagctgtggaataaacaatgttctgataattgctgggtcaccattatttactactacagttatttttatttaagaaagcccctttccttcgggctccagtaagaaggcaatactataattttcttcactgtctccctttaatgaggtcgaaggccaggcaaagggagtcaggcagttttcggggaagcaaccccgcaacaaagctgacctcagccaggagagtccaacataactcactcctcaggcggattaattgttcctggctcctgcagcctagctgaaaagtgaagaaatgatgacaccaggcactctaactaggttcaagctcaccatttctttttctagttaaatccttccccccaactcccaatttgctacctgggcaaggaagcccctcccttccccccataatcaagtgctctacaatttccactgtaactttatgttacagaatccatcatcagctacctgagcttgggcatgctgggagaatgatcttagctgagcaaattcacctccttgctttgccgtttacttccaaattcccataactcactgcttttgccagccctcctgggatggtatctagtatcgtttcatcgctaatgttgtgagtgagctagaacaatcatctcttaggatgcccacactaactggagtctctacctctctcctcctcccctctcttctccttgtcttcctggccctcagttggctgagaacagtaggagcccataacagacagcatgtcatccattcctgacagccttggtgctataatatggtcctgccaaacccattacagtaatgacagtgttgcagaattagaacactcactcctacgcggagaagaaaaaacttggggagagaggggtagagttagaatcttctgctattttgctttttctctcttttctcctccctaggtatggcattgtcccttttctttctcttttattctattaaaaaggtaagtgagcacacaaccgcgtgttgctaactcggcaaacaggtttccagggcaggtggtggtatcttctgggtcttggggaaccatccaaaagagattattgtgcctcatggtggcgccagtagtatcattccattaccatttcctcaaatggggagtgtacacacggaagttcttttctggggctttgataatctcaataggcacttacagaattgacttttctgccttggcctgggggaggcgggtgttgtaaaacttaatgatcatctttctgactggggatcataaagtgctgttgataattgtgatagttaaagtgatttgcttacagtaattagttcctagggctcccttgtggaggtaagagaaagagattgctctgtcttgcataggggcaaagtgaggcacagagggctggggtctattacaaagagctagtcatgtttgaccacaagagcctggtctaggcacatagattagagactctgcattgaggagggggtacttggtggctctttgtgggtaagagggcattcaacatgagaggtacagggctgatttaatgtgacaaagagatatgcctggcccagagggccccagagctccttctgagtgtgaaagcatatcagtgcaaagactgggagacaaaaggaccagtagtttacactaatacacaagaagagagcaagcctgggaatcagcctccaacccagtgcttttcctacctgacatcccgcccaagggtcagaggagctcttggaaaggcggagggtgttttctaccaaatctgacaggagggagctggtagcatgcttgggacaagaggcagaactcatgtcagtggtgatcaagctatagaaacctgagggagacccccaccctgagctcttgcctcagttgtggctgagtcagcttctgggacagacactcccagggactcctaaagctgggaatgtagacaactaattccagggcagcagggaacagcggaaagagccctgagtgttagttttgaaccctggccctgttgcttgttggctgtgtataatgatatacactgtgtataacgacatacactgtatagaccactgtagggaccaaatatgtgaagcaccttgcccagggttcaggtcattgtagtgctgatacatgttagtttccttccttttactcttttaaggaatcccctcagacattaaatcagtcagcggatatctattgagaatgtacgtatgttcagcctgatgctagagacggctgaaaggggaaacttgccataagaacccagcaaaataatggacattgaaacactgcatagaattcgctgcaagaatttgttaatgctatgtggctgacaatttgattggtgagataaggttcaggcataagaaattgtcagaagccagtgcaaggcaagagataatcaaatgctaaattgtctggtaggaatgacaatttctctaatgtccccatcagctaccatagggtgaagtccaaataatcttcatgacatccaaagccctgtgttctgcttctgaaatgtctctccatcctcaaaattttatgattcctcttatcagccatttctggcaactgtcattcattatttcatccatctgtccatccatctgtctatccatctatccatccatccatccatccatccatccatccatccaatccatccatccatccatccatccatccatccatccatccatccatccatccattcaatctgtccatctgtccatccatacatgcatccacccatccatccatccattcatccatccatccatccatccatccaatctgtccatctgtccatccatactgcatccatccatccacttatcccacaaatactgagtgctcattgtatgcaggcactgcatgtcccaggtctggaaatgcctatgaatcagtcaggcaggccaaggatcttatgaacttggtttatgagatccttggtttagtgtgtgttgaagagacagacaataaaaagactagacatacacaagacagattccaacagtcagaagtgcaaggaagaaagaaaaacaggggcatgagctagacagggactggaggtgggttggaggactactttggatggggtagtcaggatggactcttggaggatgtgacctttgggctaagacctgcacaggagagcccatccctcaaaatgagaaagagagttccaagcagctggaagagcaagtgcaaaggtcctaaggtgagaatgacccaggtgccttcaggaatagaaggaaggtcactgtggctaagcttgatggtcctggggaaaggaggtatggcaggatgtctgagcagtcggcggagaccagacatagagctccatggagcacgagagccatggcaagaaggcgatgttgcttcccacatgcgtgggagccggtgaagtgttgtaagcagagaagtaacatgatctgctttgtgtctcaacatctttttacatgatcacgacttgcagtttcccaaatacacatttccgcagcacatttccatgcctctgcataggctgtcccctggggtctcctttccgcatcttgtttacctgtcagactcctcggggcctttgagctctaagtcaggtatctcttcctctgtgaggcttcccctcttcccacaggtcccatctctgccagtcactgctttcccttcctcctacgctttcaacacatctctaatatggcacacggtgtaatacattgccattacctgcttatgtgtcctccctagcgagtagcctgcaacatggtaggggcttaatagatttgataagggccggtagtcagggtaggctctgtggaagcaaatcttgaaggatggatagaattttggtgataaagagaggccagagtctcacaaatcctgcaatatctgtccaagtcaacatgagacattattggatagatattgccatcaagaagaggggcccactccccgtgaaaaccgtgcactcctgtcttctctctaacagttaatgagaacgataggtattgatttgcatatgatattcatgcattttgcatattttcatttaccactgaatgcatggacagagttctcaatcctgtctttcaagccttctttccttcatttagcaacttttaattaaatgatttctgaatatcctgcacaatgctaggccctgtgaaggacaagcaagcagacatttgtccttggtgagctcacatcttatagcttccaggggcaaggtggagggtgcagtggtttccagctggggttctggaatcagacgacgcagatatgggtctgaatattggccctgatgaggtgtagaatcttgtgcaacctgctcaatctctctgagtcttgatttcctcatttataagataaaggtaataacacatacccaggggggttggcttggcggagtgttgggcacatagctagagctctgtggatattagctgttgattatagttgtttttcccagatccctgtatgggcggatgtgcagatcccattaaaatatcctggttgggctctgggtaggtgtgtgaagcctcttttctcccgcaattccaagccttctgagtccagctaaactgcagttcaacttagaacaggtactgagcagtccagtgggaagcctgagttgggggggaatttgggggagcctccctgcttcctgcttgtcaagggcccacctccccttgcttcttcagttacaagcagaatctacccgttcacatcctttctcttgtcttgccttaaacatgcctgagagagatcataaattgattttcaccctgacctatagacacccgcaaaagtcttctggttggtccccaagacttctgccccatccctgcccgtcagtcactgttcctgtcactacagtcgcagcgacactgggggtcagtgagtgggttgagagagctcagacaggatgtatggtgtgattcatttgcaccaggggattctgaatagataataattgtctgcaaatggcaattaacagaatctttttaaaaatgccttgatggttgtaaaacggaaggcgaagcacatcgtgcctcttgttgcaagtaattacggaggcggcctgttatgcacaggttttgagtgacctgatatttccactcagacactctgcacagagacactccctcaactccagtctgtgaccctcagacctcatcctcaaagatggcatttgaagaagactcactttgacttcttcctgaagccctttccttggcttcatacggagccccagagcagggaagggaactgaaaatcagcactcattgaagatggaaggggcagaaagaggaaggagcatttacttatttattttcttttgagacagaatctcactctgtcacccaggctggagtggagtggtgcgatctcggctcactgcaaactccacctcccaggttcaagtgattttcctgcctcagcctcccgagtagctgggattacaggtgcttgccaccaggcctggctaatttttgcatttttagtagagatggagttttgccatgttgaccgggctgggattgaactcctgacctcagggtgatccgcttgccttggcatcccaaagtcctgggattacaggcatgagccacttcctctggccagaacgatcatttattaaagagtgttgtataccaagtcttgtgttagctgcttttacaaccattgtctcagtgcgtccctaaatagcctggcaaggaagggaattttattcccttactgtttttttttttaaacagatgaggaaaccgaggcttagagtggttaaatgacctgcttgagtccagttaacagacatgaggtttgaactttgaaatacctgcttacagagcccatattcctttccactctacaatgctccctgcactgtgccctgcctggaatctccttcatggtatttaaagctgttattaattatccatttatctgataatttctttgcatcttttttggctttgctgtacagattggtgcaaaaataatcacaatttttgccattaaaagtaacagcaaaacctgcaattacttttgcaccaaccgaaatagttttaccagggcagggagacactgtctttcacattcagtgctgtattaccagtgctcctcctgatctctatccatgggcagttaataaatatttgctgaatgaatgactggcttctactggtgataatgaatcattggaagtgaccaatacaagattatctaatgatcaaccaacatctttattaaaaaaacgttttcatgtgaagccacagatttggcactggctaatccaggtaggcatgaatggtatcttgcagacatctaccctgaaatagagacctgaagttcatctctgcaattcctttgttgacaggctgagcatgcagcaatagaagacgacgtcctcttgccttggctagatcctaatgccctcgaatgcagtccagctttcctaaatgcctcctctcctcctgctttctgtctgaggtagaggagaggaggcactgtcgggaaaccatgacctttccacctgtcagagctctaaagcactaagaggtgccagctcattctcagggcagaagaaccagtgtagtctctcactaatgtcttagctctggtctgttctagattcctcaacctgagcaggttcatatggttttgctgaattctccaagtgttagttgggagggaggatgcactacaaatcagaaagaacagtgctaagatttggataggggaattgaggaagaatgtcaatattttttgggtcaatgtttgtaagaccagactcttaaattcaaggcagctaagaccggttcagggacagagaacagcaagtgacaggcatgcaggtggaatgccaggctcagcggcaccacgtggtgcggggatggcttataatttgagggagacgtttgggaggaggatgcttcagccgcttggcttctaacagcttttgacaactctgctattctgatgacctgaaatggcatgtgtgtgacatgtgtgtttcacctccggagtcagtcaatgtggctcacagagtgggaagggcagatgagcagaatcaacgtgggcaggaaagagcaaaggcaagtgacaagttgctaactcatgtttgtcaaaaagcatccctctcctggtactcatgcccaccccctaactgcctcagccttgaaagctctggagaggccacaggccagcagggaagtcactgcagcctctgggggtgccatcgtggtgccttctgcttcctcctgccctgaggagtttcttcctctgattccttggttttgagcctttgcccctaatgccagcaccatacctactgcatctggatcttcataatttggccagaaacctgcttggccaacaatctccccagtgattcttacggacatcaggactgaggtcctggggttctgtcatgtggactaaggtaggggtgagcaagctatggaaacatttagtgacatcagtgatcttgtgaaagccactaaaggtatcatggttctccaaagagttcctaaaggaaaagactgttgttgaccaaagccattagctcctaaaatactgggaatgagggaatcttcaaaatcactgcacattaatccattgattttgtaggtctgtgatgattgattttttgtgtcaactttgctgggacatggtgcccagatgttttgtcaaacattctggatgtttctgtgaaggtgtttcaggatgaggttaacactcttgaatcaggggactgagtgaagtcaatacagtgtgggtcggctttgtcccatcagttcagggccagagtagaacaaaaggctggcctcacccgagcaagaaggaactctccagcagacgacctcttgacttgaattgcaatgtggactccttcctgggtctcaggtctgacagccaaccctgcagattttggacttaccagtctccatcgttgtgtgagccagtcccttaaaataaatctgtctttctctatatatcgcttcctgttggttctgtttctctggagaatcctgactaattcaaagccaaagagtgctagagctgggtctagatcctagatcacagagatgtgggaataatgatctccttacagggagcacactagcttctgccataggaagaacatcaagctgtatgtatgtgtgtgtgtgtgtgtttgtgtgtgtgttttcctgtgagctccttggaggctggggcccacatatattatttatctctattattgcagccccaaatactgaatctggcagatagtgtttagtgagtgatgcatagatgaaaagtaaaaacagaatgtgattccaaattatttgaatacttctgggacttttaaaagtgcaaacagcagaacacaccccagggaggtgaggaggttgtgcacttgtccactcttaactcttttttactattgaatatcttatcaaataggaacaaagccagggacagggtaagagtctccggctggagaaaaaagtgatggggtccctggggtaaagtgagtgaacgccaagggctgaaggaaaggagggaggagaaatacctctttgtggctgccactctgttggatacttgcatgtaggagcttgtatttaatcttcatgtcaacataaataagtagagagtaaagctttttttttttttttttttaaataaatgaattgggataggaagtagagaagagggttaaggaaaagggctctaaaacctaactctaaccctgcaggaaaataggccctaggaagaaacccctcattgccgaagaagggggaaagaactccgagtccactgtggaggccacctctgtaccctctagtaggtgcctagagcttgcacactggttcccccgtggcaggagagtggggcctccttggcctttgactttgttctcagataaacaaacaaagagctatgggtgagatctggtttgactttaatggaattttgctttggtcatccacgctctgggctacctggacccaggacagtgtgcatgccttcacccaggcctggagcagcttgagcgtgcagtatgcaaacggtggggctgagcgtgggtttggcctgcacgctctgcacccaaacgctgcatttacatgagctgtgccttccccagggcagaggagaaaaggggctctcatcaagttctctcaggtccagctgaaaaaaactctcctttggacaactaagcccatgggctgggttggtttctccagggcagggctctcttggagacagagacgctgacccatcttctgaaccaattggatctgcatcctaaatggcaaccaagctgacagcctggatcctgctgagcccagcttcatattccctcaagcttctatttttaaagttgctgctcctgctcctgtctgctctgtaacaagtcttggacattgcctataagctgctccaccccacagcactccaggatgaacccctgctgtacctgagagctcctagatgcagtctgtcttaagaaaataataacagacttccctaatatgcaactggtaaccagttgtctgctaggctttagttttcccgagcagctggggcaaatacccaacaaataccgaactccccaggtcccagaacagtttccccttcttagacttcattgcctttcacctcccagtttatctgtaaaagaatatgccagccatgggaggcaacatgaggagctgtgtgccagatatgctcacttaaggagttgatcgatttaaaaaattcaggtagaggcattggaagctggttcctgacagcaaaaagaaattctccccagtcccactgagttaaacaccaggctgcatatttttcctgccaggatggacacttccaataaagcaaattttgcggaggagatgcaggctggtaactccttgaagggggtgcccatcttgactccctgtgagataaatataagtcccaggacagtgttactctcctttcatccccgtgacgacaggcttggccttatttgtgaccctcctttccagctcccccagttcatctttctaaatgagtctgaacagcccagttcagggcctgcctgactcactcgctgctgggtctttagggcctattagcattcccggtgcatagtaggtgctcaagaaatactccctaagaaaagaatgcctttgatgtaccacatactgggaattatcttatgtatgtgctctttcaatttttattttttagcctgacacagatcttggaggtggaagtgctgttatgtgcattttatagacgagggaattgagctggggtgtggagctggggtttgaattcttatcttctcaatccaagcatgggctcttccacacatcacactggcaatgtccgtgctctttttgcctgaaaaactctgggaaagaggctgccttgagacctctgacccctatggcttgggggaggtacaatggctgaggctgatggacgacagtactttctgcaagctggggctcctggattgggggccacactcctgagacagcagagtgggagcctggggaagctcccccagagggaagtcaggcctggcctggggattgtggggtgaccttcgctgcaggggatccctgagtttctgccagctctgccgggagccctgacctctagaagctggtccaggctggttggcaggtggcttccctcctgtggctgctttcaggggcagccctactctctcttaggctccattcatgctctttgaacagggaggagctggaggacttggaagggaatgtgtgcttccggtggagtttgctgaagtgccatggagggaacactagcctgagagtcaaaacacctgggcttcaggtctgtcttacgcaagtcatgaaacctcactgaaccagtttcccattggtaaatgtgctgatgcctccttctcagggtggctgtgagaatcaaatgaaatgatttgcagcaccatagcagagatatggtgctgcaggacactggctgcagacaggtctctactaggtgtcagagccgtcggtagggttaatgcaggtcccttaagagagattgagtccttctctagcaataagacctagcatgactcaaaagcttgcagaaacactttagttgaacaagtctctgggacaaaccaaggattgtggggtcacagaagtcaactgttaaaaccttgtggtaatccaaagagaacagagggaatgcttatggaacaccaacaccacttcttctttcaccaagtcctctccctgctgctctttcccatgggaagggagcattttcagaggagccctgagagatgggggctcatacccagccagcagtgtcccagctttcctggccctgcctggggtagtccaaatggagtgcaggagaccggtgcccatgggaagcctccaaaagtcttgaaagtttggatttgcaatcacagatgccccatgtggcttcttgagagatgtcaggactgccatttgtgagctgtgttaaacctcagatgtcaggagagaaactctctcctttccacagggtcctggaacagcataaccagtaggactgtagtataggaacgtccagggccaccaaactggacccatcttgcacagtggagtgtattgcttgctaattgctggattgcaatgcctggggatttttttgattatcatgaccgagggatgctattgaatgcagcaaggaaaggccagggaggctgcagacatcctacaatgcacagcatggtcccccacaatcaggaattatctggccccaaatgtcaatacggctgaggtgaagaaaccaacatgtgcaaagcactgggcctggcaggtctagggaacagtgataattcaggtatgaagcaggagcacagagttaatgaaggcaatggcaagagatgaggctgaaaatgtaggttggagccaggcagagaaggatcttggacaccaaatgacaaggttttactcaaaaaaaaccccaaagcattccggggttagttaaaaggccagagcagagctgactcccagcacagggctctttccatcctatcatttggcctctttccccaccatgtgttagacaagacaagaatgattcatggagaacagaactagcagcccaaagcaagtcactttttaccacctacaggataaaatcagacccctttgtgaacacataaaaccacgtagatatttctatcactggtttaccatctgcatctttgaagaggggctaaatcagtgtgaacatctttccatgtccataaatatacttcctcaccatgctgtaactatttatctctagatcagccttcttgttagattgtgggctccttgaagacaggaaccatgttgaatcatcgttgtatacctggtaccttccatggtgatagaaatactgagtccattgagcaggatggctggaaaaatgaagcaataggaaggagcagactagcctgctgcatggttgcaaggactggggacggcttccccctactctcttttcctggtatatgagaaatacatgctcattgtagaaaaaaaaaaaaaaagaaaaactatagacaatccaaaagagcaaaatgaaaattatgccagccccctgacctccccacccagagataaatacatttaacatttcagtggatatcctacaccctttctagggttgtatattcatgagattcacatgcacatattttttctttttaattaaaatgggatcatattatacaccttgttctgtatcttgcttcttcacttaaaaatattttggaaactagtgcaagaggaggccaggggatttgtcttgaagttgtgtttgcgtagcaatcacccatttttatggagactgcatctttgaagaggggctaaatcagtgggaacatctttctatgtccataaatacacttccacaccatagcatttaatgtctacaagctatgcaactgtgaggttgtgctataatgtattaagccaatcctcaattgttggaatttgtattacttttatgtttttgctataacaacaatgctgcggtaaatacccttttactgaaatctttgcacacatcccagatttttccttcgtttgaatttctagaatagaaactgctagaagaacacaaaaatgcatatggtacagcttttgaatggtgtgatcacatggctctccagaaaggtggtaccaacatacattcccgctagtaatgttcagagagtgctatgttagctctttgtgaacaaaagctatcatgcagggcccatgtaaacaccaagataagctatttccattccattcaaggacccatttatataagtccagcatggaaaaactgtcgttcttgttattttatagtctaccaggtaaatgtacgcagttttggtaagatgagctatgcagttgttcacctgtttctgaacacacacacaaggtaatacatgtaagagcacctagcgcggaacttggaacacagcagaaactcaacaaatgccttccatgcccagaattgctgctgtgcttagagccctatcatcccttatctggatggctaaatccagtctcctgtcttggaaactgataagccaatctacatacctgccagagtgaatgatcaaaaatgtaagatggagcatgttgctcccttgcttacacatcttcaggtgctcctcattgtccatacatggaagtctggactccttggtaaggtttggaaggctccatgacattccctgagatcccacagctttatccccgacagatctcacctctcccagctcacccaggtcccagccatgctctcccagtgggccacccagtaagattcagcccttcattcctctgtgacccagcacagggcattctctctccctgaaacctgttgtctcccttcctcccttgtttgtttgcagaattgcctcctgggaaacaattccatatgttgacagccttttctacttgtcccacccaagcaacacaatccttttcttctatattcccagaaaatcttgcccaatcattataacacatctctcattgcactgtaataattgtttttatgtgtatatctccagctaggctgtttagaatcaggacattttaaaatttatgtccatagtctcaacacctggcgtcaatcttaggacacagtaggtgcttaataaatgcttgtcacataaatgaacaaaattataatgtccttcctctcttccttccatttgtctagccattgcagggctctgtccaccgtagttactattggttactaccaagccatcattatgatgccttctcctttttcaagtggtgttccagtttccatgaactgatatacataatacttctgtcttaggatcaagcagaatcagctgaaccaagtgctttgctaccattgggcctttaggaagagacagagctggcagggaaggagagagggtaggtgcatcacgagaggcagagcccacgggagcatctagtggggaaagctcggctgagtctggctctgtggcttcaacagggagccccacgctgtatctggaagggaggactgaacttcagagggaaaagcaggaggcacagtacaggaagacacagaaagggagtaggataggggagatggacatggaagcacaggggagagacaagcggggagaaattcaggttcaatgaaaggaaaacaggaaaagactgcagaaggaagaagataaggaagcaacagaaaccccagctagcgtgggtgtgtggactgcagatgtgtaagagcagcctatcttcttccgagtccactagagaagtgtggcacaggagagagccttagctttttactgaatgtaattaatgacattgtggctttaaataaaaaccagctattcgtggggaagcctgacagggtttcttttaacttaatgtttgctgaaccatcccttctatctcacttacctgatgtggaacatatgctgggatcagaatgacagagaataaatcaccagatttgcttggcttctttgaaaaatgaatttgggggctgagatttctcatcagtatatatcttccccgagcagcctcttgacagaacatcaagcttgggggatgtcccatgcaaaggtaaacgagtacccagaggtgcccagatgcccacatctggcaacagatccatctccttgagacacaagccaggccacctgtgctaggctggcaggtgtatccagggcaggatgtgaaagcctcctgcagtctcaggaataggatacaattgtggtctttacatgaaatcaacaaacatatatggagctttaaatatgcatcaaaaacaccacacagcagggaggcttctcagctttgccactggcaaccatgagcatgccctagtgtcttcatctataaaatgggatgaagctgccttatggcttagtttgttatgagtttcaatctatcatagatgctaaataaaagtttgtattttctccctggatacagctagcagctgcaagagctcccaggcctctgggctgaaacagaggcagggaccaggaagcaattttaactctggaaactttagatgagggtgaaaagggtgggtgtggacgtgcatgtggtgtgagtgtgagtgggggtcacgttttctgggttcttagtctatgtctgcaagactttctaacttggctcctgacctttcactttaatatctgtgtgatgttggacacataatttaatctctctgggtatcagtttcctcatctctacaagggggagatgagttggattgactaccttaaaatttttttcttaacattccttttcaggttacaaaagtcacacatactcgttacagaaagcttagaaaacacatacaaagatataaacaagataatttaaaacacccattattctaccacccaggggaaaccagtgttttggtgtattctgctttctctatgcatggtgtattagagagtgaaatcatactgtgtatacaattttgtttcatgctccctccctttaatgttaaattatcataagcattttatctgtgtcattagaaaattatctggacctcatttttaaggttcctcctcacactaaaattctatgaagaatggggctcatctcctttgctattaaaaacatttattctcttacagcagcagaaatcacattgtggaaggtgcccttgaatggtgcttctaaactcccttcggcccatgcatcacgcaaggacaccaaagggctctgtgggccacccggctcacccactttgatttaccatcttagctctcaagaataaaaggaatgatgttgcttttaaaaaaattgaatatcatcaaaaatgaccttattcattggtagaaataggggccacttatacgatagattttcaaaggtggggttgctgaaaatttccctaaaccttcttttccctgttcccttgactatgaatgcttaaaattccttttaaaacaagaccttttgttacaaagttaagattttaaataaaaaagatttggggaaagttaacacattgactaaaattcacactaggattaaagcagagacaatgcgatgtgctcagcatataatttcctcctcctgggttcacaggaagacaggcattgctcagccttcctaggaattaggttcaggcctgagacttaaaagagtcctgtgtgatctttcagcccctcttccctcccgtccctactctagaggccacgagttcaaaatgataaagctaaaagttgaagagggctgcccgtgcgccttggaatctgataggaataaggaataatgctttgttgtgctaagctgagattttttgatgtttatttgttcctgcagctttgcctggcttattcagactaatacaaagatataactaactgatagcagttccctttgtgagactaggtttgggtattagagaagacgagggagaaagtacaggctcttgaactcagctgggaggaaattcagtttggagaggaggcaggggtgccactagctgatttagcgacttttgtattaattcagaaaagaaattcgtaggtttacaattctatatgctgtacatgtgcactgaaactgaacagttaagtaaatggatggcagatggtgggagccaggcgtttcactgttggagtgggaggttacagataagcaaaaggagggggctagaatgatccagatccacgtggtaatgaattagtgttggagacatcagtatgaacttatatttagcttaatatagatatagatgttatgtatggaaatatttatagctatgtatatgtgagggctaatatacacacagatatttcccagctatatctcctgagaaagcctactagcaacaacattacagtagcaacaagcacacctaacaatccagagtttggtttctgataccactctgtaataaaaggaaccagggctccttgaagaaatggccaattctagcacaggatcaggaaatacacaagatgaactggagcatcttgtagtgccagaaaataaggaagtgctctgtgctagtttcctagagatgtcataacaaataactacaactgggtggctaagagcaacagaaatttattctctcacagttccggagaatgcacgtttaaaaattaaggtgtctgcagagccatgcttcccctgaaacctggaggagagaatccttccttgcattgtcctgttttctggtgatttttggtattccttggcattccttggcttgtagatgtgtccctacaatctctgcctctgtggtgacatggccctcttctctctgtgtgtccctcttctcttcttatgaggacactcactggtcacattggattaagggcttaccttactccagtatgacttcatcctaactagtgacacctgcaatatccctgcttcaaaataaggtcatattctgtggtattgggtgttaggacttcaacatattatatttgaggaggaggacacaatccaacacataacatattctcttccaaaaaagccacactaatgagggtctgtcaaagggacacagaagccaactgaaagagctcccattgaccaaagatggcatgctttagcaacaaaatagtgttggaggataatccaaagcaagtccatactgatgtaaatagatgactgaaggaataaatacagaaataaataaatggaggagaatagatagactccagtgcagaattccaaataattcacgtagatgccttgccctcaaagaagtagagtatagcttcccgctccttaagcgtgggctgcacatagtgacttccttctaaagaatacagtgtgaaagtgagagaaaaagaggagctttgcagtggaggaaactgaccaatactatttcagccaggtgagcaaggttggcagcaacagtgatgtgccatgttgatagcacacacccttgataggatacgatggaaacagcacttgtctttgtggtcttccccctcgacctcagtgtaatcttgaaaagagcatcaaacaaatccccatcgagggacactctgcaagacacctggccagtactccccaaaattgtgaaggtcataaaaaacaaacagaatctgagaagccgtcacagccacgtggaggttaaggagacaagactgctaaatgcaatgtggtatcctggatgagcccctggggcagaaaaaggatattatgtaaaaactaaggaaatgtaaacgaagtatggactttagttcataataatgtatccatactggttcattaattataacaaatgtaccatactaatgcaagatgttaacaataaagaaaactgggtgtggggtatatgggaaccctctgtactattttgcaacttttatgtatgtcaaatctaaaactactctcaagtaaaaaggttagcttttaaaagggcactgctagaataataataataataagtgaacatagcctcatgttagggtacatgacttggttagaggctagtagcctgggtgtcagtctccacttacgtcctcagtcaggtgcccttgtgcagtgaacaacctgtacaaccttggtagtcctacagtcagacttaccctctatcaccattttacttagcgcttatcctgcacctgaacatagtactaattggtgctaggaatgaacatagcctcatgttagggtatctgacttggttagaggctagtagcctgggtgtcagtctccgcttatgtcctcggtcgggtgcccttgtgcagtgaacaacctgtacaaccttggtagtcctacggtcagacttaccctctatcaccattttacttagcgcttgtcctgcatctgaacatagtactaattggtgctagaaataaaagcatagtcaattacatcatagattacagaggatcacctatgactgtcaaggagaaaccccatgaacatccatgatcagtgaattcattgtcaagaagcacttccttccaagcccggagagttacagctctggttccctacctgtgtggaggtagaaaagcccagtgtgttaagggggatagtgttcttatggagaaagtgtcctcaaatcacattttgcctgtgaagatgaagtaggggagaatcttatactaaactctactgaatcctcgtgggggcaagggaatgtggctggtgcgggccgggagagtgatggaaaggagagggattcctccagagttttgtcctcagagagttgttttttgtcatttacacgtggcgtggtgacagcaagccaggtgtctccttatggaaatatcttaatacagcagaaacaagcattttgagttatgcatgccaagtctgacattaattttctccttttcagccttacaaagaaatgcaccagtatgtttcttcccaagactggccccacctcctgcatggtcagagcctcacttgtcccttccttgtccatcacatgccctgtgatatgaagcgttccaggggagtgggaggggcttctcaagaagccttctttctaaggggcaggagagcccaggtgttaccgtctgatgcaatgtaagggtcctattgtgtccctccaaaatataaaacaacactgctgattaaaaagcctatagaaggccaggtgcagtggctcatgcctgtaatcccagcacttcgggaggctgaggtgggcggatcatgaagtcaggagatcaagaccatcatccaacatggtgaaactctgtctctactgaaatacaaaaatttagcagggcatggtggtgcgcacctgtagtcccagctacttaggaggctgaggcaggggaatcgcttgaacccaggaggtggagattgcaatgagccgagattgtgccactgcactccagcctggtgacacagcgagactccgtctcaaaaaaaaaaaaaaaaaaaaaaaaaaaaaagcctacagaatacagttaagctaaaatgtggattagaaagcaatttggcaatgtgtaccagcagtcaaaaaaatgtacatgccctctggtgcagtaagtgatgtcacttttgtcaacctgttccaagaaaataatcctaagcactaaaaaaatctgtgagggtaatagcaaaaacagcctaaacattcaacagttgagaaatggttaaataaatcatggttcatagacttgatggaatattatggaatcattagaatgatcatttatgagaattacataatatgaaaattgcatatgataactatgctaaatgaaaaaaggggaagataaaaatatgagtaaagataattactaccatgttaaaatatgcataagaaaaagactcaaaggaaattcaccgaaatgctaatagtgtttgtattagacaggtgggatttgagttgattcttttttcttttctttggtttccaaattttctagagtgtggtaatattacattataataaaacttttttttaaatgtgttaattcctgtttcctaaagcaattaatagtagaccagcatttcattttatttgtagaaacacataataatggtcatcaataataaaataaccttcataaaaattaatagcattaaaataaacatggcctggaaaaaatagtgtaatggtttcctaacagagacacactgacttcctccaggatcacgtctgggaaactttttcttatcaaaatgactgaagttttgtcatttaggctagttgaggaaaacaggccaactctaggcctgcatgctgctcacagcctggcagcccagtagcaaatgtgctgccaccgggctccttgggctgaaaccatgaagcatgagctggcctggtctgggcatctctgttggtctgcttggagggcactctggatgaagccctcatttgatttcctaacagggctgaagctactggccaggccgttggttgagatggagagtctgcaggaagggaggacagggcatagagctggtctttcctaatgagcagaaggagctgctattcctgcaagcaggggttggaagggagaggcagtggctctcttcacactcccttatctgcagttagaggaaatcttagcagatagagcaatgggttctggcttttgcctgcattaatggcaaggaaagggccagcacaaggggccagttatgtgatcggtaggagtgtgggctgaacataatgttagttcagccagagggccactcacaagagagaacacctgacagaatgatgaaatgatggagccaatcaacccccacacagatgtattttctcttcccctatggcacaaattttcaggactctgatttgcaagacatggaccagaaaaagacagcctgctttatgtgtggggagtttgcacaattaataatataatattgcaagggccagcaatttgatggtatttattattcacataatttaaatcattgccaaatgctaaaaacaatatagtccaccccacccaaatcaatataaacatatcccaaatacacagcagaactttctccatattgtttttcttgacaaagctgaagaagggagacccaacttttcatgcaaacttctggcatcttcttttcatgtttttcactagaggaaaaaagtctggttcttttttcctggaaagataaatttttaatgaatgtaaatgttctttcaattccttggttagatggaagggatggtacagcttggacagccagcctccggaatataattgacttgcttcttgttatttcttttccctttcactacccagtgaagcacaaatgctctcagcttgtgcctttgtttctgagcttgtcataccctcagccagcagatacaggttgccttagaagggaacactcctgatgaattggcctcactgcattgtcttctaacaatggaagcaggtctactctgacatatctgctcttcaccctgcttcttcttggcattcattaagtttgtatttatcaaatatctattatgtgccaggcactcttctattgaatcctcacaactctatgatgtagcttctattatcatcatcacccccattttacaggcagggaagctgaagcacagagaggtcaagtcaattgccccagctgatccatgaccaacttggtagcccggctctggagcccatactcttagccacgacaatattccgcctcccatagcatctaaaatctgctagacattgtgtgcaaaaagagtgggtgatggagttgggcttgggacaaatgcacaatctggaaggaaatcgtttctaaccatctctttttcattcctatggacgttgcctcccagggctgctctccaagccccaattcttttgcatacatttgggcttccacttccacttgctgagatatggtttttcccactgtgctactcagacagggtatgcaagttgcatttgacatttctgcagggtctgtggcccttggttttgagactgagacagggctgtgcttcttcccttgcctcctctgtccatgttctaacaggagctctgcagagtggcaaacactcctgtcaaagaagtccaagggaacagtgcagccacttctcagggtatccacctggagagaagcctgcagcattaagctcacctctgagggctgctttaagaatggaagaaggacctatgttctgccaggctgtgctgcagttgctatgtcttgggttaaaagtctgtttagcctcaccagacccatcatcaccagtcctccacattatagaccacaaaggccctacaattgctatcaaaggaactgattgttttgatctggaagccgtcagagttcaatctggagtcatccaggcagctgcatgttgtattatccgcatcatagggcaaggagagagaaataatagactcttcggtagatttcagttcccaaatcatgacctccatgtgtagaaaatcagcattgtaaataatcattattatcaaagagtgtcatgtattaagcatctactggagtgtgaggctgggcacctagtcaaacaaatccctgtcaagatttctttgacccaacggtgggctgggttgtgcccttccttcctgctcccataaatgtcctctgaatagctctgtcactgcatgcgatgatgctgtaacacaggtgtctgtcttccccatatgaccatgagctctttaggggcatggactactcttcatcacctttgcttccccagtgcctagcagccctggcatacagttggcacgtaatgcaggtgtgctaaatgttcatcttttcttctttctttctcctaaatttagtatttctcatgaccaaagccaacccttgccacgtgcagtgccccatctccttcgccttctcaaggactccctccctcactcagtccctctccttcttgcatctgaagctctttcttccttccctggaccattcccacaaagcagaaagtgagcaaacccatattcaattatccttcactcctgaaatctcccctggacctcacactctgttctggctgccattccacttctctgtatcccctcctagaaaaattggaaaaagttgtctgtacacattgcttccacttcaccttctctcattcactcttgagcctactctttctggtttttactctctggttccaaaaaattgttttgcccttgttaagacccttgccagtctctcaaactgccaaatcttgaggtccctctgtctccatctccccggagttgtaggaagcattccaccacagtggcctagtccaaacttctccagattcatttctcttcaatatggagacagggtaccatgcactctgtggttttctgcccacacttttcttccagccccttcccagtcttcctgttagcttcttcctcttttccactccctaaatatggaatcccgtccttgaactttctctttctgggctgtactctctttcataatctcaattctgaaaaaatatagctgacaattcccatatttataccttcagcccaaacctttacactatatccgactgctaactggcatgtctcataggacctcaaaacgacacagtcctgaacctcttgatgtctcattattctccccacaccacatcctcttctagtcttctctgtcttagtaactaaaacctctgtctacttagttgctcaagcaggaaacctgagtgtcatccctaactccccttacccactctattggagtggtcctcccatgacctacagatttgttcacttgtttcttgtcctcttgcctctctttccgcaatctgaggtcaccgaacattgcactgggctttaagcattcattgactgattagacggactcggtccacatgctctgttggatgaatggatggataaagactggttgaagaacaggaaaggcccagagccttggattcccagacaaaagcatagcctcccagtcttcatgtcaagaggctctcccctggttagcttgatgacattggtcatcgaagttaaccttcctaacactcagtttcttgatctataaaatgggaccagtaacacttaactcatgaggttattgtaaggattcaatagcataatacctagaatatagttagtgctctattcatgtttaattaaaaaaaatacttgttaggcaaccacccaaccatgtgatccattattttttttcctattgttttggcctgtgtcgcaccaagcttgaggtgaacgtaaacaacataaccaggaatgagttcacgagcagagtcattgccagtgagtcagaggaaagagtgatttccaaccctaatcgcagacgtgggaagagccttgctgtgctgggagtgactggagctcggctctgtggagcagccacatctgcttgggtgggggcgctcttcccccatctctgtcctgcatctaccacaagctgggctttgccactgtctcctgttcctgatcccagggggcaaatgacggatggaaccgtcataaacaagaacaatgcctattgtgctctgcttagaaatggcctgtgttcttttaaaaaatatgaataaaataatatactgagcaaactgggtggtgtggaggatttgtcgatgagaatgcaaatgagcatgatgtcacttcttagctttgggaggaaaaaatgagtgatccttgaaatggtctttttctaccgttaggacaggaaggaaaaaccatctttggtaacaaaagatcagaaattgcctcctgagcgctgcctggctgcttcagaagaaaagtctgtgtttaggaaacctcttattgaggaaagagtacattttggggggcctgtacagggaatttagtggtatttgttgacctgatgagatgagaaatagttgaggtattaaatcgtaaagggagggcaggtgttatcataataggacattccaattcatcgtccctggcctgggctgcatgcagccagctacccgcttcccaggcttctgctcacgggagcttcagcttggcctcagcttatgcggagtgaaagcccagccactcctgatggtgacggcatttgcagaaaattgtacatattgtgcagatccatctccttttcttgcccttctttccaaagaaatgaattcactgggcacttatgaaaataaatgactgatgggagaaggctggagccaagccttttgtaggcaaagggatctgagtgcagtttcgaagcccatagccaggggtcagccatccaggccacagggtccaggggcccagattcccatggccaggccaggtgtgaatgagtctgagcccagtgaaagagggagagggaacagagagggatggccagaccttgccttctttgatttctagaagacttcctttgcttgtagacaccttttagcaggtggagggacagttgtggggctgtaggggcggtttctcagagtgtgaggtatgggaatgtggatgtagcattgattcacacttgctgtctgctgtgaaaacagtttagagggaaggcggggctgctttcaaagaaaaacaggtgaaattcattggtggtgtggttctcctcttctctgtatgccacttttccccatttcctggtgcctctgccgaccttcccaaccccagcctcccttttgggggagacttgctcttagctggctagtaaggaatcgagccagcagaatgttaacgatgggaggcagcgagatgtaaataaacccggctctgaggataggtgggccaggaatcagatccctgttctgtcactcattagctagcagaccactgtgagtcatttaacctcagtgctttccaatctgtagaatggacatcatcatggccacctcacagtgttgttgtaaacacaagatgaaatcatgagtggtgttggcaacgttgtagtcatttaacccttcaaacaactttatgagataggtcctattattaccgttatttttcagttgagaaaatggtgatgcagagaagttaagtaatttgccccaagtcacacaacttgcaagcaatagagcctaggctgaaaccaagcagtttagtgccaaaactcgtgtacgtaaccactggactccactggactcttaagttgaatctttacctgtctaatggcccagcaattcttcaggtataaatcctattgcctccgtcagaaaacatatacaaggcagctcacagcagcattgtttataacagagcccagattggatacaactcaattacccattaataggagaatagatatataaattatgttatatgcacacaatgcgattaacaatggttacaagtaacaacatggataaatcttagaccatgatacgaagtggaaaaagcaaattggaaaatgctatataaagtcttaatccagttttataaagctcaagagcaagcagaactaaactatactgtttagggatatacacgtgtgataaagctaccaataacaacagcaaaaaactaataagaagatgaaaaacagtggttacttgtggggatggagaaggatgacacaggagtggggtgggcaggctcaggttcttctattggggggttcacagatggccatttccttattaagcttacatctctgctgtgtgtattcctttggacctttcaaatattacacaataaaattaaagtgttcactatctcacatgtgttaacttttacctttttagctccccacccccacccacctccaataatgtcttgtaaggtttattgcaaaacagcagaggacaagataatgacctttttagtgagacaacaggccagggcatgtaaaagtcactggaaattcctttagactctggaagaaagccacagtgcacggggctttcttgttgtattcactggggaccatgggtcttattttagttttgctaatgcaataaggttgtagtgctgaacagtgcaggcaatctgggtggagtgagcagtcaggctaggaagggttacttttgttccttcaaaccgctcttagttcctttggatgtgcatgctcagctagaggtccaaggagttagccagagagtgaaggagaaagagagtaggagagacagatgataacaggtgcaccagcccagatgtcacttgcagggagttcctgcagaaggtgcatggccacggcagatgctgggtggacaactcaggtcactggcagtgactcacacagaggaaccaaggcaaggagagcacaggtccttcctaagagggagcagttgaaggaagaggttggaatttgagagactaaactatttcacccaaaatgactgagaattaactaaggaaaatgcgtaaatgattgcactggaccaagattactggagtggaccggaagcgtgctcatgctcatgagacactcagataaggaacaggcagaggtgaagaactcgcgttcctctgcatgactgagctccactgtgaataaatttgcaatccaaatacacatgttgcttctcttcattctcccccactacctagattttaataggcacctattgaaaatctgaaaagttatataacggcctgaaagggtgcatttctaatggttgaatttccaatgctggtgatagactgagagataatttgactagggagagagcagggctggattaaagaatttaaaggctaaaacactgaaaatattatagtatgctttcttacgttatttaaaaatacatgtgattctaagacataaaataatggtaaggaagtccaacagaattcagatatttctcatgatggctgggattaatttttaaaataaaatattaagtgtcaaatttcattcaaaagatgtttaggtgtctttagcagttaccttgtctatctcctggataatttagtactcatagatcatgccagcctgggccatggttccctgcacagtattttctgctttctctctgtgaaggcttgttcagtggggtagactcaagaggacatgggctttttaggcagaagaccagatgccagcccctgctctgagcgcttcgtataaccttgggtttttcatataatcattctgagcctcagtctccttatctataaaataaggataataaaagctccctcacagggtggtaacacagatcacatgagagaatatagggaacatgtccaataatattgatttgtattacaaaaatattttaacctgggtgttttcagaaagttaattacaaccaaatgctggtgagaaacaacaggaacatccctggaatgaatgcaaagtggtacggccacgtggaagacactttggtaccttcttacaaaacgaaacagagtcttaccatgggatctgacaatcgtgctgctaggtatttatccaaaggagtttaaaacttacgtccacctaaaaacttccatatgaatgtctataacagctttattaataattgccaaaaatgaaagcaacctagatgtccctcactgggtgaatggataaactgtggtacctccacacagtgaaattttattcagtgataaaaagaaatgaggtatcaagccacaaaaatacatggacaacttaaatgcacattgctaagcagaagaagtcagtctgaaaaggctaaatactgtgtgatgtcaactatataatattctggaaaggcagacaaaagaaagttcagtgtttgccaggggttgggcaggaggaggaggagagagatgaattgtggagcacaggtgtttgttagggcactgaaactattctgtatgatcatgtaatggtggatacatgtcatcacacatttggccaagcccatagagtgtacagcatacagaatgaactctaatgtaaactagggacttcaattcataacaatgtatctatattggcttaccaatggtaacagatatactacactaatgcaagatgctaataatgggggaaactcagggcagaggttgggagggagaggacgtacatataaattttattttattttactttattttttgagacagagtctcagtctgtgacccagcctggagtgcagtggcgtgatctctgctcactgcaacctccgcttcccggattcaagcgattctcctgcctcagcctcctgagcagctaggactacaggcgtgtgccaccacacctggctaatttttttaaaatatatttttagtagagacggggtttctactaaaaccctgttggccaggctggtcttgaactcctgacctcaggtgatccaccctcctcggcctccccaagtgccaggattacaggagtgagccactgtgcctggccagaaatatgtagaaattatttgcactttctgttcaatatttctgtaaacctaaaaatcctcaaaaaaatgaagttttttaattaaaaagaattacagagccacttcaaccaccagttcttcttccccctgtgcaccccaagagcgtacatcagctctttggaggggcatgtagataccccatgccaggccagcctccgtactgccaggctcgtcctcaccctgggtaaaggctcatgcaggcattgggaaaagcatgaatcagaaatgagagtacatttttcacgttgagctagtaccttgtctgcttatgttgccattcatacagccagtaataagccactccactgtcatgtcttcatttaaattgttatttagactaacctttcaatgggacacgtttttatccatggggtccatggatcttattttagttttgctaatgcaataaagttggaatcctgaacattcttttcagtctctagaggtcatgaagggaagaaggggttaaaaaaaaaaaaggcaagacacaacataaaatcagactgattctatgttaaaatggtgaacaaaaaaaccaaggacttgaccagatgaaaagagaggggctcgatccatgtgagttccctggcttgctgatcccagactgggctgacccagggcatcagggctggggattgtcttggatggaaggatctcattctgcccgtcctgtcccgcagcattgggtgtggaggaaggctgaaggaggggacgcgcagttgtgggtaactggccttcaccttaaatatagcaagttacttgaatggtgcgatttgaaaagcctccagtatctgctgctgacatctgaaattcccctccttcctcatgtgaagtgcctagctggtacccactgggtgattgggcactagaaatgttggcacaagtgccctcttatgttaagcattgcccccaaccctgctttttatttatttttattcttttatttttatttttattttattttatttttgcaacaaggtcttgctctgttgcccaggctggagtgcagtggcatgatcttggctcactgcagcctcaacttcccaggctgaagctatcctcctacctcagcctggctgattttttcccacccctgctttttaaaaatgttggtgctccaattagagctgtaccttaggtagagtacatgaaaatctgattgttggcagagccctcggacttagaaaaagatctgcctgattggggttgtgagctagcacagagcaggaagtggggaagggaccagggagaatgtttctggggtggaggtcatatcagggctggggacagaaaggctgatcctgtgaagattctctgcacactattggaggagctgtctgttgcgggagggaagaagaagcctcattcagatcccccagagcccacattcggggccacctggagttagcaaatcagaggcttggggatgtggcactgaatttggggctgtgttactgtgcagggaatatgagcctaggctctgaatatgggaccaatttgaatttagatcccacctctgccacttattgacctctctgagactcaatttctcatctatgaaatagactaataacaacattgtttcaaagagctgtgttgagcatcaaatgcatctgattctcagcgtaatatctggcacagagaagcactggatgctgatagttttggtggcgcggctgttattggttggaagaatctgctggtcagtgtcgggggcccttcaacttctgcttgcagaagcccgattcatctgttacctgggaagctaaactgtccacacccttctcccatggtgatccccagaagaagctctgagggggcactagagttttattagtggcttaccatggcacttagtcccaatctactccacagcctgtgacagctggggctgtgtgatggggcttctgatggggccctggcagcgggagtctcagcatccaagcacaatcagcactgggtcgatgtatatgaggaaagcacagaatcacatggttgaaaagaactgtaattgtaatggaaattcaaatcactccactgaacctgttttctgattcgtattttgtccttgtaaatcagaagcaccgggagcaatttatttctaaacatcaacactccagaatgcaaagaaaaatgaaataattgcattctgacttgctcaaaatgattcatctgcatgtacatgctgatcctgagggcctatggacactgcaaagtaacacatgggctgtttgtgcttttgctaactcctgtgtgctcctggagaggtggaggaaggctcatatcttggggccaggtggatttctgctccccactgtgagaatctgatgactgtggaagtgatggctcattgcacccaccacagccaggtggagaggaaagatgttcctgtgcctgggggctccaggcagcatctgtgcaacccccttctgcttccctgattcatgagcccccaagggtggcctggagaggccaccaggtggccttccctctctgagatcccgggtgcacagctccttcctctctcagaacacactgattcttccttttctttcccagatttctcccttgccaggaccctcccttattgcttgctggggttcctaacctgctggctgatgttcagggtgcctcctgtgattcttgtccagggcattgagtatccagtggatggcagaaatgaattctctggaccccagaaaagcagaggtaaccaaagaattaggtaaacacattttggaaataattttccatttgatgtttcactgaaataattatcattaggaaaagcaaaacattggagggtttccttgtgctggctttatggattagtattatttgtaagtacatttagcctggagctcagtggggagtgtgggggaacccataatatttttaacatgtagagcctctaaatttcccactgtggcctgcccttccaggttcttccaggtccttttgatttctaaggttctaatggatgggtggccacttatttggggttagcataggggatatccttagagaaaccatacggagcagcattagcctgggaaacattttttgactgaggaggcaaaatgctataaaaagaaagaacatgggtttggggtctaaagctgggttcagttttgtagtggctctgtgattttaatcatgctgtgtctcagtttctgcatctgcaaaacgaagagtacagtgggcccgccacagaggagcacatgcagggacacacacgaaaggacttatgaactaccaagtgtgagtgtgtgtatcatctgtgtgtgcctgtgtgtatctgtgcgtgtgcatgtgtgcatctctgtgtatctgtgtgcgtgtgcacgtattcgtgtgtgtgcatgcatgtatctgtgcgtggatgtgtgtatctgtgtgtgcgtgtgcatgtacctgtgtgtgcatgtgcgtatctgtatgtgtgtgtatgtgtgtacctatgggtatctgtgtgtgtgcatgtgtgtatctgtgtgtgtatctgtgtatctgtgtgtggatgtgtgtatctgtgtgcgtgtgcatgtacctgtgtgtgcatgtgtgtatctgtacgtgtgtgcatgtgtgtacctatgtgtatctgtgtgtgtgcatgtgtgtatctctgtgtgtatctgtgtatctgtgtgtgcatgcgtgtatctgtgtgtgcatctatctgtgtgtgcgtctctgtgtgcatgtgtgtatctgtgtgcatgcatctctgtgtgcatgtgtgtatctgtgtgtgtgcatgtgtgtcagctatcccccaaatttctcctgagttatgaattttgttggaaaaataagatgataagagcttggggaaagaaggtgagactcctaggaacttgagcccgtgtggaactcatcattctgcagaaaactagggaagaatctggtttcactccttagagcagggagccaggaggaaggaatggggtggagcaggaggagccgggagaaccagagagatggcagaaccttttcttcctccctggaaacccctctgcccccagtttttattaacttccagtagaataatggaaggcttgccctgagtgatttcttatggagacactaaaaggagctaagtctgctttccagggattggggaagtaactgagcaaatacacctaaaagcgcaggagcctggctgggatggtgagatgctgggactcagggaaggcatcagtaagtggtctcaactccagctgctgtagaatcatctcaggagttaaatgacactccctagttcaatcaatcaggatctctgtgggtggggctctgagcattggcattattttgtgaaccaaagttgaggaccattcctgacactgttgcaggccacctctaaccagatctccaggggctgggccccgctgcatctaggacacatcagttatgactcaggtctggcatcaccaagaatgtactggtgatctcagggaagtaatctagaccagctgaagactaattaacttgggccatttagaatctgactccgtgagacaaagagccttggacttggtatcccagggccttggagcagccctgtgtcctcatctgagcactcagccacttgcttgagctcctgctctgccttctagtctggggaaagataggttctcacaataaagctggagcttgcattgtgatcacccgggtcagaggagcttgaagactggaggctacagaaacggtctcattagggcattagcataagtggtacagaaggcaggtagggaggtctccagggaaggatttctcccttaattaagattcaactgcagtgaaatatcagcaaccttatacctcttgtatgtaccataaaaaagtgctaggattctcaaatatccttctctcctcccttttctgcctgcaaacagcatttgatagtgcaaccttcaggattacctcaggaataatgagctccaggcaccctttcagctgcattagtgagggaaatgcaacactctattcctggcacacaaacaggccacccctacagccaggtgtgaactccaggctttctggctgcacagaaccattcaacccctggacaatgagtgagcaaactagaagcccaggtatcacttttcagcggatttagctgtgatgggggataatgggatggtggagcagagtggctgcattctgagccacagctgtgggaagctctggttaataggatgtctgcttgctgttggaggttggtgagggacagggacatttaggagtgaggacacggggaacactgctttagcagctgatatttgtggtgcatgcgtgcccacatacctgacatttgcaaaaatccaatcccattgggctttctgatttttagaaaaaccttgattaacttgagtgcttgaaaaagatgtagatttatggttacctaaatatattctgcataattgggaattaatgagaaactccaccccttttacatttcaatttttatgaaaaatatttcttaaatacactagctctcttttctatcctaaggattacagttaattgacaatttttgggtctttggggacatcagcctgatacatcatttttcatcaattcatttactcaaatgttttgagtttccactttaagtcaaacaccatgtgagctgctggagtaatgttgccataggtacagtcaccgatggggatgaggtagcccctgaatacaaatctcaagacaaattccataactcagagtatttctgtgtggggtaaccatccccaaatctctcatatgtggaagtcagatgagaaaacaattctaccccaatatgagccatattagcaccaggatgcagtgcaaagagcgcatggtttgcacgagaggccctgggttcaaatccttgctctgccactcaccagctgtgggaccttggccaggcactttctctcctggcccatttcttcgtctgtgagatggaactgttacacctaccctagaaagtgggaaaggaataagtggcagacacaccagtggacagcatagctcctggcctgtaataaattcttagttaatatttgtttgaaatacaaagtcatgctgggagtagtggtgcatctgtagtcctaactacttggaggatgaggcaggaggatcgcgtgatcccaggagttcaaggctgcggtgaactctaactgcaccatggtactccaaccgggctacagagtgagacgctgtctcttaaaaaaaaattgaatcagtatcctaaaatctaagaaaagcaaaagtaagatttcacctcactgtctccaaacacccccaaatcagttggttgaaacctgattaattgctattccataggcaaatgatgctgccaaacagtcatttgtggctgtgaggaagaatggccaggacagtagacattcagaaattcagttttaatgtcacaggttatgactgtcgtttaccaggtgccttaaccatctgcttgcagtttttcttcctttctttgccttggccctacctcacctggagaagttaaccaaagaggagtaagagatcctccaggtggagtgggccatggtcaaggcaggtgggggcagaaacaaaggaaaagcagcccagggagatggcgttagtgccaggcggcccgtggagaaaagctttcgctatactgaaggtctgtgaataatggtgatcattcaatgccattaattaaaacattgatgagaaaaatatatcactttccagctgggtccatagtctgtgtggcgtcgttcttctcatgtctgcgtggattttctctgtgtcctccagcttcctcccacatcccaaagctgtcacatgaggtgacctggcatgtctacatggcctcagtgtgagtgagtgtgggcatgtgtgtgtgtgagtgaccctgcgatgggagggtgtcctgtcgggggctggctcccgcctggcaccctgagctgctgggacaggctctgggcactgcaaccctgaattggaataactggataagtaattatcctactctttaaatcaatctttcttaaatgtatgtatagatctttttcaaaatgcttaacattacgagtattttggtctttgtttagttcagtgatatttctgtgaccagaaatatgccataggaacttaactcttgtttatatcaattagcctgtgggaaaattggctttgttatatggtgttttgctcaaggttgtagtttccaagaacctatcaatgacattaagtgaggacttactgtgtaagggagctgtattccctggaagcttcctacatgggtattacagagttagctaattgattcctccattcacgtgaaaattaagtgccagcccagataagattccaggtgctttgaggaactgagaagagactgagggggcacacctggctctctgcagtgcccagtctgaggggtccagccctaactgattaaacgcaacatatgctccagcagtggcaggctcatggctcaggggacttcataagaaagtgtgagacgtccatgctgtttagaggaaggtggaaaggccacacagggatgaacacaactgagctgggccctgaaaatgaggaacagagatcaccaggcacagaattggagaagtggcattggaagtagaggaaaccgtgtgtacaaaagcagcaaggtatgagaggtgcattggagaggtgcctagtcgcatgaggactgggtgtcaacaaaggattggtgttaggaaactcttaccttccaaagaaaaaaatatatattctctcaatcatatatatgtattatacataaaaataaatatttattattgtacatgtataaataaatcccactgttagtagtgttaataaaatacacaaattatagtatttggctactgtagaatcagattgagattagctggaggaaatggcctcttaatgaaaagagggctcccaccccagaatgattgatctaactttccccacactcttccctcaggcaattgctggctgtcacctgtgctgtccccacaccgccacccccaactcagtacatggggtttttacctcttttctaacctgcttgttttatgttcaatttgttttagctatcaactagatacactcaagggtaagagctccatagggacctgggatgctactgccacacatacaacatctatatctgttgccaaggcaatgggtaataacatcaaattggaagcgggccctttgtggtcagacatagctgagtggtaccttgaagagttatccaaaccaaagagggaagacaagtggcctttgtggttatgcatgtgtctatgtgtgcatatatgtgtcatctatgtttgtaagtatgtaggcatgcatgtttgcttgggaatacatgtgtgtgtgtttcagacactctggctgtatttcaataagggcatgtgaggtacagtttatatcccagtcaatggccagcaacacgctaggaaataaacctgatgaaaccaaaaacctgtgaccattgaggtcttaatctgtgaaggaaattacagtttaggagtgtgtgatttctcaacttgctgtcaagaatctctgagttctgtggagtgcaaagtctgaagatgaccttttcctggcagaggcgagagtggagaagcctattacagagcataagccaatttactttgtacaaataagtggcaattttcttcctaaaatacataagggtggaagggaaatgtgtataaactgaaagattctctcctatggtaaatctcctcttgtttgtggaaagtaaaaagacagcaacccacttagactcttgtgggaagatgtcagcagaagtgagtctgagtcctccgctgaacttcaccttgacaaatatttctgaaactggtttttggttggggaggaggaggaagtaagtatatgagtaaatatctcttggcaaaagcattttagtggaaagagaaaggagctatgaaatatacctccctgctttaatttgtcacttctttttgtttaaaaaattcatgagtgttcgtaggctgaaagtaactgaaaatcatagatcacaaccttttttccaagcagtggctcacaacctgagaatgttcagatccctaacagtggataaactatgttgggtgcaggcttcaggatttccttaggttttcaaaggcaccactgatacaaaaaaggtcaagactcacactcttgtgacttgttccacaatttttggctaggggttaagatcagagggtggatgaggtcggctccacaatcattttggttgtgggaaagggttatgaggagattaagattcagaaaagttggcttatcatttaaggagcacagttcatagggtctgaggagttttagcaggtgtgtggtaacctgcaatgttttcgtaggtgtgtggtaacctgcaatgaaggagttatatgtgtgtgcatgtatgtattcatacattaatgtattaaggtaacatctttgtattcagattaatcccttcataaattaatacatgaaacaatgcagtgatgacaagtgttctaaaaactatagaggacttgtttatgaaattagggctcatactgaaggtcaggagaagggctgccattcatcagtcagcattgatatggagagggaaaggagattaccctattacaagtcatactgggtggaggagatttaattactcagatgctcttatgctcctcaaaggtcctagtgcacctctttagacagtttcccacacaagcctcagcccatctcatctggttttgttctgaaccccaaggttcagtcaggtgcgctgtcccatcacaggaaaagaaaccttgagctgattgcagactgtctctaggttgtcatccattaattaatgaataaattaaacaaggcttttccactctatcatcttgtcacctgaagaacatttattttcagggtgattgctaaactccacagtacaaagtatgtaatagatattacgtttttatttactactatgtatgtaaatgaaagaaagaaaagggaaggacagggagagggaggaagagaagcaaggaagaaaaaccaagggaggagggaattcttgatagtctctgtctttcacggttttcctgctcagcttattcatccaagttcccactcagcccccagcagaccagagagtcaaacccaacccagtgggcctgggcaggtgccgtgccatcccctccaccttctccgtgcggcctctcccttggctgtcctctgaatgtgcctgtgcccccaaatcctcccttcaatgacatcaacaaatttaaaaaatccacaccaaatctgtcacctgtcaaattaaatgcctgaatagtcaccagcctggcagttgtacaaacatccagaccttgaatcccaatttgagtttaaactgcaaaaagacacaaagagaggctggggactgaataagatgaaaggccagctcagatcttcagggaaagctattgtcttgatttttcagccttgatgagcctcatggaggtaataaaaccatgaataacattctccctcatgtgctcacaacaacaatatgactactaatagtgaggctaataaaaaggacatattgccttcaaatgccatcctttgcctctcattgtccctaatagccttggggccctgggctagcagtcatcttctcctacagatctctatctgtaaactaggtgggttggcaggagaattagtcctcttcagtcctaagattctataattccatgacagggagctcaaaaagtttgagtaattatagaagtccttcctgcagctagatatggcagtttcatgtagtagttactgtcacaggtttttcagtgatactccctgagttgaactcctagttggaccatgtgttggctgtgtctccaactcctaacctatcagttagggataatacgagcattactaggtaaggattggatattaaccatgttgtatatttatttatttattatactttaagttctgggatacatgtgtagaacgtgcagatttgttacataggtatacatgtgccatggtggtttgctgcacccatcaacccatcatctaggttttaagccccacatgcattaggtatttgtcctaatgctctcctccccttgccccccacccccaacaggctccagtgtgtgatgtttacctctctgtgtccatgtattctcattgttcaattcccacttatgagtgagaacatgtggtgtttggctttctgttcctgtgttagtttgctgagaatgatggtttccagtttcatccatgtccctgcaaaggacatgaattcactcttttttatgactgcatagaattccatggcacatatgtgccacatgaccacgctgtactcttcaaaggggatgaaactgagaccctgcaaggataactatctttttccaagttcccaagcaggtttgggagtaggacgtggtctgggaagggaggtaggctgactgccccaggccccacctcctgctaacattttattttctctgactcccactgataaaatcctatacttctaacaaagaaatgtcatctgaaattttacaatggagcacaggaaattgccaggtcactaaggtgaattatgggcacatttccatgtggtgggaaagatgacaggagaaaggacaaacctggggaatgaaactctgccatgtacacatgttctaacctgtattttggcttctagtggttgagacctcattagctatgtgtttaaccattcatgtctaactattcaaatttaaaaatctgtttcaatataaaaatataaaaagtcaccccaaatctcccagtgatatgtgcaccacggtagggaacacaggtttcgtgcattcatagacacacggaacctcatgcaggtacccaattatgctgtgcccttccccatctccatgcctttaaacttgtcacagttcctgcctggagtgcttttccccttaccattcacctggattttgaaaaatcgtcctttaacccatttctaggaggcttctgagattcttctacatgtctactctgatgtggttggagagtcctttaatgggtgctgctgatggctatcgctgatgtagtgtttacccactaccaggcactctgttaggcactttacatatattgtctcaaataatagtcctcataggaaggtgacgaaaggaagctcaagttgtgtgactaatatgcccaaggccatgggctgcaacctttttatctgtatccctcagtgcctggcatggtgttatttttcccaaatgcacatttgtgtgaggctcagcactggataaatggggaaagaatgaatgtctgaactagtgtggattaggaggaaggtgagcaaagatgttgcactgcaagtggtagatgctctccaggccagctgcaggactgcagatactgacctggggttgaggagcaattgtatgtagtttggagaatagggccctcatcttgaggctgggagcataaaggaaagagggatccatggagtaagaggtcccttcaggggagtcattagcaaaagagaatacttatttgaaaattaaatgtcttcacttcttttccaggaggctccatgacctgtttttggcaagctacaatgggggtgcagctttcaaggagtcatttcagcaatttagtccttgctccagggctaactccccctcccctgcccaatgtggtgggagggctctgctaagatgtagagcagttattaaggccttaagataaaggcagtttttcatggggtctgtttttttcccagtgacctcctgaggcagcagactccacaggcttactgcagggctatacaaaaaggtattttatgtccttagccttataaatcaattttaattgtaacaacagaaacatcagcagcaaaatggagccaaatgggcgggggcctttttctgcgctttttaaccatctcagattaaatgctgaattgtattttggggtctgagttttgtcatgcaaacgaagaaaaacaacttgctttccaatttccacatgcatatatagaatgaattgttgagacggagaatatattttgccatctcagtgcttctagaaaagataaggggctcttgtaaaaagttctacaatttgtcagctggcagcttattaaatacccaaaacaaatgtttatatagcatgagaaggccactgtcaaggtcgggaggttccagaatggactgattctgctttattcataactgtttgaaaaatctcttgttcttttctttcccccaaaaaacaaatgcaactattctgttttctttgccttaggaaaaaaaacaggcaaggagccagcccttgtgtacaggcctctaataataaacccgcaagcatggctagttgttcagcagtcatgagcaaccctacaataacagagtctcacaacatggaggctttggcttcagcaaaaccttcattaaggggtggcagagcagaggagggtcacccagtcatgaaaacaagctctgactcacatgccctaggagcaaatgaaattgggcaggagtctgaagagaagatggaatctcctccgtgctctaggaggtgcgttataaagccataggtcttgttaataagagggaccccaattcaatccaatgaccatttatttaggtgcatactaagtacaatgtatgttgggtgacacagaagacagacaaggaactgaccgtgccccccaaggatattagaatctgaaagggagatagggtagacaggtacttaagtaactgcagtgccatgtagaataataagggttataagtaatagcaaatgcaaagaagggagaggcaacaagaacaaattaaatattctcattcctttgtctttagaccagtaactttatttgagagctttgtttaactaattaattaattcaatcgctgtatgctaactggagaggttagaggactcacagaagtcactagctgcttagaggttaggggcacagtgcctaaggccccgccctgtacagggctttgctatcatccctgcctctagagaagagatttgccctctccaagatctacatggccagttaaggtgggattacagacaaaaccctcctgatactgtctcctgtctccttgcatctccctccttcccttccccactcaatctccagaatcttttctcacatccagttaacttgagatggtctgaattttggcaaacgaggttgtcctggggctctgggggtctaggtgtgaaaaagttatctctctgtgatgacatgtcattcgcctcagcttgtttcatggctcgaaatagatgtctctcattcttaatgatggcccaatttggtttgggaaaggcagcgtgttgagtcactgaccactcagggcactggagcagcaaagtgaaggatgatggggagggggagtgctgtcatccccttgctcacactggactaagagcatatagttcacatcttctgtaagcttggaaagttatcatttgaaagttgttgctctagagtgccttgacaatctaacaatacaaaataaatcttctattcacacctctccagcaagccaggatcccaggaatatgcagcaacagcggaaatcagtgataagctccctgttatgttgtcaaaacttacagcagcttcacactgccctgattaccatatattagctttctgcagacacacaaggacttgctgggaggcctttcttctggtcagcactttaaaaatattttatgtaaacccccaagtccctttggatccttccagaatctcggatttccacatgtttccaagctctaacatgctcctctcgttaggttaagtagcttgcaaacaccccgtaaatgggagtatggaaccgcaaggaaagacaataaggccagagatcatctctgtgctcaggccctacacctgagcatccctagcattttagaggctgcttgcagccagaggtctttacattgaagagggaaattgcttcccaaggaaaggcgcagaaatggcttataaaatgggcatctgtttggaggagtaatgggaagagatgaagacctcatggactactgagtctgaaacaccaaatcgatcagggaggccgagcaacagagagcagtttccagctgtggttgcagttctgactgaaaccctgagaatatgatggctgttctggaggttgtcttaagcccctcaagcccgggctctctccctgacagctgtgggtgtgtgtgtgcacactggagtgtgtgcagggaggaggtggtacgttaatgagccttgcagccggtctgacaaaccccatctgcttcgttctcttggccacccaagctgtctgccttccctggctacacccatgggcacctggtggccctgctgagggccaaataggagtgttgacatccccttctaagctcccgcagcagccaggctcttaagcagccagctagcaactccatgtgttgttaccccacctgacagttcacaattctgtctttcctcctgctgagaattcttctgttttccaggaggtgtccctagtacccttcccacccgctttcatcctctttcttcagagagaactttgacccagaaccgagtgactgttatggagctacgaggtccttgtctgaattctccgtgtggttgctggcctgtaagctccaagagggtagggggctgtgtctgaattttggttaattgctgcatccctagaaccctgaaaagtgtctagcacatagagtattctcatagctgttgacaaactggacagatacatgagtaatgaataggaacctgtgcattggacggggacggtgccagctacagctgacccttccctcacagcatgcaacgttagcaatgaacttcttttttttctttttcttttttgagatggagttttgctcttgtcacccaggctggtgtggaatggcatgatctcagctcattgcaacctctgcctcctaggttcaagagattactctgcttcagcctcccaagtagcggggattaccggcgcctgctaccatgcccagctaatttttgtacctttagtagagatggggttgcactatattggccaggctagtctcaaactcctgaactcgggtgatccacccgccttggcctcataaagtgctgggattacaggtgtgagccactgtgcctggccagcaatgaacttctaagagaaatcagatcaagccctcaaacattaatttacagtcaagagacaatctctgaattcagccctccccgtcccccagcactggtattgacatactgcagaccttctattgttggtggcaaatatgagcaggttaaggcacttttcgggattagagaatcttcaaactcaatatgcataagaacaatttatcctgatgaccagatataatagattctgttcattaaggaaactgcttgccatttgctactatttaacccattctttctattgtgatcataagaagaagaaggccaaaggatcattaatttccttactttggaactttggggtccttaggatagcgctgtgtatatggcaggcactcattactattgttttgtagatgtggctggtgataataatgagaaggactgggggaaaacgaagtatgctctccaggctaaccgttggtggtttaggcagacggaactcctctcaggatttattcagattcagtgacagcacttcttgaactctgacaccactccacaattaatattgtccactgaacagaatggtgaaccctgagcatctttcccatgaaaggcaagacagatgcacacgagtcagttctgccactccagtactccgcacggtgtctggcacacagtaggcacttcacaaatgctaacaacaatttgacaactagattgcaagctgtagatttcagatgcaaggcaatggttagtaactagattttcttagtccgccctgactttgggcctttgtccatacagcaccacactgggcgtcagggtccttttgttgggatgagtggctctgtcactctttcactgagaccaaggctcaggcaatcaagcaatgcatttcaatcaacttctacaatgatccaatttctgggtctggctctgtttctctatttcccagttacttgcccaagaacatggctccatctaaaggaagtggcctacgggaatctgcgcacctctgctgtgaccgggaagctgggctctcattggaggttgttgggctgcagttcacggcccaggtgagaccacactgcagaacataatgtgcagatcaaggcaatgatgcctgtttctccatttcattagccacagctcactatgtgtcaagtcttgttttctccagtttagactcagaaactgacttccatcattgaaatagggctcgtgtctccttgtagtaactgcaaggctttagggaggtagaaaaaatttagtgaaaataattcagcaactcgtttgagctgaaaataacttgattcaaggactgtgccttcagatacttgggaggcatgaagatgaaggcatttgcagtcttgttttcctttgtgactggggcattaataaggctttgggattcacttcaaaatcattaaaaacatgttcactagtccaaagcacctctcccacctgtgtatgaaacaaatgaattggtgggaccttggatcctcgtagtttgctgctcctggggtagtccctcactaagctccttatcacacatttgcactgccaagatgatatttttggttaaaaagttataaatattctggaccaaaatattaccttgagattttgtccacctgacatccacttcattgagtgggaattctgcccaaagaattactgaagaatgaattcccctgtttatttagagcttgatatcttcataaccattttgactaacattaaccatttagtcattaggacccaggagcacagataattggtattgaggttcacatatgtggtgaatttcaagcaaagaggtctcaaatatgaataagtgaatagtgcccttaaagcttcttattcagaatctacaaagtgatgaaacaaaggcaaaaaaaaaaaaggtgggatccccgaaactagaaaaaccctagaagaaaatctaggcaataccattcagaacataggcacatgcaagggtttcatgatgaaaacgccaaaagcaattgcaacaaaagcaaaaattgacaaatggggtctaattaaactcaagagcttctgtacagcgaaagaaactatcatcagagtaaacagacaacctgcagaatgggagaaaatttttgcagtctattcaactgacaaaggtctaatatccagagtctacaaggaacttaaatttacaagaaaaaaaaacccggttaaaaagttggcaaaggacatgaacagacacttctcaaaagaagacatacatgtggccaacaaatatatgaaaaaaagcttaacatcactgatcattagataaatgcaaataaaaaccacaatgacataccatctcatgccaggcagaatggctttttttttaaaattaaaaagtcaaaaagcaacagatgctggcgaggttatggagaaaaaggaatgcttttacactgttggtgggagtgtaaattagttcaaccattgtgtaaattagttcaaccattgtggtctcaaagacctacagtcagaaacaccatttgacccagcaatcccattactggatatatacccaaaggaatataaatcattgtattataaagatacatgcactacatatgttcattgcagcattattcacaatagcaaagacatggaatctacctaaatgcccatcaatgatagactggataaagaaaatgtgatacatatacaccatggaatactatgcagccataaaaaggaatgagatcatgtcctttgcagggacatggatggagctggaagccattatcctcagtaaactaacacaggaacagaaaaccaaacactgcatgttctcacttctaagtaggagctgaacagtgagaacacgtggacacagggaggggaacaacacacactgggacctgatgggggtgtgggttgggggagggagagcactaggaagaatagctaatggatgctgggcttaatacctgggtgatggtggtgggttcatcggtgcagcgaaccaccatggcacacgtatctatgtaacaaacctgcacatcctgcccatgtaccccagaacttaaaagttgagagaaaagaagaaagtaaaagaaataaaaaggtggattcctttaggtcaccttcttgcagttgtaccctaaatttagaggattcatcattgacatgcagaacacctaaacctgttgatccattcttttgggtgtaaagctttaaaaaaaagaaagtctcttacggtgttggcttatttaaaaacagatgacaaaagacacctggcttgcagttttgtctttattctccaggaccatgaggagcaattagcttttacaagttcatttccataacaacctttagcacacgatatttctggattgagttaaggatgggggcatcaagagatgacttggctctactcaagattccacgtggaaggaaggggcaagcctagtgaatgagtcacaccctgattctgttcttagctctcacttctcccactgtgtgacctgaggcacacaactgacttctctaaaccctcatcttatttctctgtaacacggggaaggatagccgctattttgtgaggttgtggaggggatgaatgggacaaattttgaaagcacacagtatctggcatgtagtagcatttcataaatgtgagctattataattttatttatttatttttttgaggcggagtctccctctgtcgcccaggctggagtgcagtggcgcgatctcggctcactgcaagctccgcctcccacgttcacgccattctcctgcctcagcctcccgagtagctgggactacaggcagccgccaccacgcccggctaattttttgtatgtttttagtagagacggggtttcactgtgttagtcaggacggtctcgatctcctgacctcgtgatctgcccacctcggcctcccaaagtgctgggattacaggcatgagctgctgtgcccggccgagctattatttttatcatgaggtatattccttgttctcttttccctttgaggcagctcttgttgactcttaataagcaaaaaccacacgacgacagttttaactggcttacgtaaagttcttacagatccagagctgagttcatccactacagatgaagaggaattagtgtgtcttttgaatattaatgaataaataacctctttccttgttatttatttgtattcaaaatgccattgctagttctagtgataattattgaattttcaacatttatagaaaaacagcatatactgtataaagataattgccgtattggagtcttaagaaagagttagttttgtataaatatggaatgccagtaattatcactagtgctacatgttaaaattagaaagtaggtaaataacaaggacagtatgtattctttataattcaaatgcatgtcagctcaattatcctacaattgcatagacaataggtgaactgtttttctcctttaaggggaagacttctttccgagtttacgtttcctgaagttgagtgaagattccatggtttgacaagccaatagtatgataatgggcaatattatttaggagtgggctgatggcaggtttgatctctctgtgcttggattcactgcctcaattctgaattatgttacaactgcttagaattttaaagttagagacccgctgtggagaaataaagtcctggctatgtttccattttataatctctcaggctgaattttgaggccagacctgagtacaaatctgtaacccaggaatctcccacgtgctcacaaagttccaaggatactatttaatctcctccttttcaccaaccccatctgcaccccagcagggaggtcagtggctacatgaaagcaaaatctaaggctcttctttgcgccaaagcctggtctccatgttgttacagaccaaagccactctgaaagccgcaggaggctgaccacaatcaataatcgttcaggaaacaaacgcagggaagagaaataagtgacttattgaaaaggcacccggaaatggcattagcacagcactgcttctaatcatagactcagcacctcagaggaacagctgagcagagccttgttaaacaaatgtagatatcatgggtgtttaaaggaaacacgttactttagggaaggaagaacctgttgcattaaaaatagagctaaggtaaagagcatgtacttgtaggcttgcagggagaaaaataacaaatgaggaaagccaacactattaaaattaataggaaagatagaaaaattaagcagctggaccatggataaacagcaaaaaagccaagtgtataaaacagctcatctaagaccagaggaggcagaggggataaacagctcaccctgttgaggatgtttacttttgcatctgtcaactgaaaaggaaggaaatgaggatttgcctgagtcagaatgagtttccaaggaaagaggatgcagtgtaccacagaaaatggtggtgatgatgacagccagtcaacagaagctgatggtgacttagctggcatgctggccatgggatgcgagtgactgagggcttcagcttcctcattgtgggggacagaaggggatggtttagcaatatcctcaggcttctaccttcccatttctcccaccaatcaggcattagcatccccagtcctctggtgtcctatggttggaacccctgctcggtactccctgtcccatgcccagaaggggatgccttgctttctcatccttccagcctatgtggctgcaaaatgacacttgtaaaatgacatgcagaagagcaatgagaccaatgccagatcccagaggggtcagggagctccaccgagcttccctaacttgttcacatcctgtcacgctagctaatgatagcatttgtagggcagctggaataaacatgtgatggacccatatctagaggtgactctggcactctggctgtcccaaccccaccctgatctgaaggctgagggggtcattatgtggacccactacaacccacgggtgggaagctctagatcttggcaccccgtcctcttggctctggctgagccactcagctcttgaatcagaggcttcagcaggaggagaggctcaaatgagcccaagctgattaaggaagtggccatgctccacagaaggacagatcaatcttgattagagtattaggaacgtttcgaggatgcctcgacttagcagacaactggcatggtggctgtatcaggggggcaagagcatctgtcaaagatcaggttgtaaggtgagtctaagtgtctagggccatggacactgcacagccaggacagaagccagctgcgtgccagacgaagtgttttcacagctggggaaaggaaaggcacagattataggacagctgtttgcaattgcttctggcccatcaataaggcaaacagtgacttaggaatgggaagagtgaagaaagtaagtgattttagggaggcagtgtggcagaatagaagaggctcaataggctttcacataatgcagaaggaacttgaatcctgcctctgccatttactagttgtgtggctttaggcaccttccgtaacctctctgagcctatttcctcactacttatgataacatctcttttacggagttgttgcatatattaaataaaaacatgtctatacctagaatactatagagtttcaataaaatattaaccattcctctttactatgtatgctgtttaaagcagaaattgtgtagtagtagtagtagtagtagtgtgtgtgtgtgtgtgtgtgtgtgtgtgtgttgggaagagggaacattagacttatctgaaagtttagaaaatactacagaaagacacatccttattgattgacagatattctcctgcaaacactctgtcttctccccattgtgtagactctggaaagttattgtaattgttgatttcaggtcagcctctactctacctgcagcttggtctctggttttcaaattctgtagaaatttttacagctgtttgacttccttagacatgagacatgtactagatggcaatagcaggggacgtatcccctacactcctgtcctggtccaatgcctaacccatggggaacactcaatacatttatttgaactgaaatgaacctggttggtgggcgaggccgctaggggtagaggcagttggggaggaaggtggcagccatgtgcatgttggagatatgtgagtagctttaggtatctggaccccaaccagcccagtgaagagggtagagatgcaagacttgtagatatgacatcagagggtggcaaataatctgggtccctagcatgctgggcagcctgaggcgacggtccggtcagccaggctcagccaagcccctgagagcatctcgcaggaggtaccgttctgtccccagctgagaggcactaaggctttcccagcagaggttcagccctaccagagccgctcaggggaatgtgcagaaggaggacaagggaagcaactacctgacatcactctgccctgcttgtcaagacaaaacaacatgaatattaatttctcaggcataataaggtgtggaggagcaggagtgggcagggccattgtgtgggaggctgctccttcctgccatttgtcaccggcaggagtgatagatggttcttccaggcagcttcccaattagatggatacagccaccccaattaagagcacgttggccatctgcttcgcaggtacgatggcattaggtgctttgggcggggctcaggccagactttgcaagacactagaggaggcaggaacgctcacatacacatcggtgagcagaggccacaggcatcactgaggccaatgcctaggcctgtcaagaggattgtacctgcagataatctgccaatgtacttatagccttttgccagactcactaccaataactaacaattatctgtaagacagtggctcttgattggtgagcatcagaattatccagggagagtgtttaagaataccactctcccgacgcaccccaaacattcagagttggactttccacacttgatcagggtccaggacacctgggttccacttgattacggctaattaggttatttatttaatgaacagctcattaagatagtcatctgaaatttgaagtgctttcaacaactttcattcattctctcattcattcatgtaagatttttagagcacctaacagatgctaggcactattctaagtcctgggggtacaccaatgaacagagcagaaaaatccccctgccccattcattttgttcatgtgaatactttcttggtgagagtgatttcagctagcacatagtttagagagaatgctgcagagggaggcagatagctgagtttcagggttaacccggagttgcagagttgcgaggcctgctcctgaactttctgaatgaagctttgtagcaagcctttaaaaaaaaagtaaccaagaaggtctgaagataaagcaagccaaccttttcctgcaggaaaagatacacgcatagaagatctgtgcagctagagctaatggcagcttccatgatgatcccaagtggaataactatataaggtgtggattctgacccagaggagtttataatctatcctggggaaatgaataagacccaagaacagagaagaatacaaacacacgataagaggtaaaaaattttgttgaaggagggagcagaaaaacttaaagcagctggggcagacttcatagcaggcaagttgtagggtgttgattcaggcctggaaggatggatgggagggtctggacaggtgggagatgtggtgggagataggacaaggcacaagcagagtctcagcgggcacagcagcaggctggaggcaggacacagaggccagagctggagttgaggccaaacagccctgggtttgaatcctccttttgtcactcactggccgttatagctgtggagaggatacttatcccccttttccaggtgtggaaactatgggtaagagacattgacagctaccttgagttttcgtgaggactaaaggttttatatctcaaggacctggcgtgcccccaaggtgctggatgggtgtgtttcgagcttactaggtctgagataccacgggcacacaaaatgtttttaaagaactccaaaacattccctctttatctctcttgggactgcaaaaggttgatgcactggaatgatttgtggcttcactatgaatggagtccccttatcgcagagttcattatcagaaggctttagtggatatgagaaatgttgtttcttcaattctcagggacagataagcaagcaatctcagaggggttttcctagacaaggcttctctcccttttgttagggctgaagaagctggcagggggacaccccccagcagtgcttctcaccactgtaaagctgatagaatattagattttcatgggtcaacggataaacacagtatatatatatatatatatatatgtaacttccaaccaacatcccttcctttggaaagggcttacctggccatttttggatattcttgctttttaacctgggaccttgtagttttcaggagaagtggcatttgatatgtgtgacctgggcaaaaattatttaactattagggtccccagctccctcatttataaaaggggagacatcattattcccatcttacagggtgaggtaggcagaataatgtaccccctcctaagacatccatgaatgtgtgaatgtgaatgtgttatgttacatggcaaatgggaattaagttgcagatgaaattgaggttgctaatcagctgaaattgagatgaggagagtatcctgggccatctcggtggcccaatgtaatcacaggagtccttataagtggaggagagggacagcagagttcaggtcagaatgacgcagggtgcaaaagatcccaccagccctagttggtttggaagatggagttaggggacatatgccaaggaatccaggcagcctctggaaggtggaaaaggcatggaagcaaattctccctagagtttccagaaggaacacagccctgcagacacattgatttaattccagtgaaatgcattttggacttccgacctccagaactgtgaagatagttaattagtgttgttgtgagtcaccccatttgtggtgagttgttacagcaacaatgggaagcaaatgcagagttaatgagagaatgacatattacaatgctttcttgatctgtaaccttgggcaagccccttgatgtctctgtccctcagctttcataagtataatatgggaatgataagaatggctatcttatggaattgcctagtacacatgaagtgttggaatgctgagacatagtaagggccctggaagtgttggctaacggtattactattatataattactattatataaagcacatagactggccatgtagtatgttctcaaacataactatgcttattatttgttgtatgggaaggagaaggagccttggtgagtgctctagaacttctaatttcagtagctctgcttacaatgtaggcacatatcacaaatttcaaggggccctgcccttttaggctttgcccagttcctgttttaataggaatttatgtttccttaagaaaggtgatctgaccctggggactttttgcaactcatatagtattgaggttttcctttcactgttgtacaacaaactaccccaaaacttagtggctttaaataaccactattatagctcataattcatgggttagaaattcaggcagggcttggttgagtggctcttctgctccatgtggcatccactaaagtcattcagagttactcagctggtctgagcaggagggaggatgaggaagctgatgtctgggttgggctggccggaagagccagggtctggccagtgttgttctctctccacggcctctccaagtggcttgcttggacttcttcagaacggggcttctagtaagtttccagagactcacacctgcaccaggaaactcacacagtgttatatccactgtatactataggtcaaagcagtcaggtataccatatggattcaatgggatccaatgaccccacctcttaaagggaggaatgtcgaggaatttgtgagtatctccaatccaccactcatctttaatactcgctggagtatttaatactcactggagagaactcagggagtgagaaacagatgagatgtgagagactaaacggtccatctgaggcaactcagcaaatccagagtccatgggcctgcctcacactaaccattctggattctactaacattgattatctaccatttagaaggactggtgctaggtactttcatatacttgatgtcttttgctgctttgaaatgaaagcattatacttcagctaagggataaaccaaagcctggaggacaagtgggggtgcaattgaaagttgctcatctaacctccagggcctttgcttttcattacaggctcatataacctggtctttatgcctccattttttctgactctaggcaggcagaatggcctcagcaggaatgcagctatgttagacatctgtgtcctgggagaccctggggcactttgaatcctggtcagaatggaccctaaatgagctcatgtttctaaagtgctctgagctcctcagagagcagaatccatttaactccagagcctggatggtctcattggtgggtccctgcagtgggggacatggtttgtcactgctagcaccaggctgggaccttggataaatagggagaaatcagtctccaggcttctctatctgccatcttttcagccacaataaattaatcttcagaaagatagaaaacaacaaaagaagggagaggggaaaagaaacaacgacctatctgacaagtctgaaaggaaaacaagctttctgctgctacagtgccccaggtgaagtagggggctcaagctggcaggtgggtctgaaggagcagacgaggcaccctggtgctaagcacactccgggaggccggggcaggtgggcagggaccaggtgaagagccagggggtatcttgctggagctacctgtagattgttctggatttgttagcatctctcaaaataagatcaacttgatgctgattaaagctgaaacaccccacaagcctagcatgctgagtgtctgactctagggcccctgaacaaattgttttcccttttcatgatgatctttgtgaactctttggttcagcgtggctcgcccatggggacagggctggaaatggaagcacaggtttcctcttggcacctagctgtcagaactgtccccaggcatcccagcaggagggagacaaacaagcattctcatccggcaagctgatgtctgcatatgcaaatggactgaaggaccctcagccttgaatcctattcagaaacagtctacagagtgcctacctgtgccaggtgcattcacagaaatgatttcatttcatacaacagctctgtgaagcagctaggtattatttacctaagatttgttataaggacgctcaagttcagggagggtaaacaactcacccaacgtcacacatctagctgtggctgagacaggtctcaatcgatccagaaagtttatttaaggatgcatgcccaggaagtaggtctgtgcctttttccaaagatgattttgagggcttcaatatttaatggggaaagggacgatgttaggaaaagaggaagaaatttttaaaaggtgtgggtaaatcagagacaaatggttgcattattttgagtctttgatcagcctttcactgaatacacaattatatgtgagagagggtagaagaataaccatttatgccttggtctggctcagtaaatctgcatttttacctgagaggaagcaatcagatatgcatttgtctcaggtgagcagaaggatgacttagagttctgtcttttgtcccgcacctgtgaagacaagctattgatttacactgtcggaggtaaaattcaacagaaccattttagggtaaagatcttgaggcccacaaggaatttcctctcctagtggacaaattgtgagggacgtatgtagcctttttaatctttgtagttatcttatttaggaataaaatgggagacaatttgactgatgcagttcccagtttgaattttccctttggcttagtgatttgggggtcctgagatttattttcctttcatagtgatttccaatgataaatatgggctcctgacccagtctagggtactttccaccaaccagtagctacaggtaatgtggctgtatgtagaccaatcaaaacgaagcgcttgggcataaaatgcctcttgaaattatgcttcatgtctgtgcacttgacctaggacaggaattttaaactttgacagcctggtgacgctatgacccccttctcagaataatgttttaaaatatgaatataaaacaaaatacctaggattacaaaagccagttattacattgaaatacaattataaaaatattaaaaaacaaatttgtggtatggtaatgtgccttcttctttattaatacagtgaataatgagatctagcaaaggtttaataatgactgtaatttcaagtagtgatgagcataaataacattttgagatttctgcaaaaacattaacatgatctgaatatacctgagattttaaatggtgataaaaatcacaggctactgctgttaccactgggtttgttgtctatacttacaaggaaagggaatactacattcctgttagaagttactgaaaataaaatgcgatctttttccaccatccaggttcattggtccctttgattcccttgggtcaagcactttatgtatttttacacatttaatccccacagcaacccagtgaggtaggtacttccactatcctcgtttcacagataaaaaaactggggcacagagggattaagtaacttgcccaaggtcacacaaggccgccgagttgatacgttaatcaggttgtccttttctctccaaggggggattctgcaaccctcttgaggaataatcatatcaaggagaatcttccttttggatttttcccagttgggttcagccttttctagtcactccccttcctgcagaatttgtcgagtgccggtccttcctctcagcctggttagctcctagtcactcatcagatgccccctttccaaagaaggcttgaatagttccccaccccattacgcttgcccccagctcttggatgtcttccccatggtatttgtgaaacctctgtctgtgtggtcattaagttaacacctgcttttcttgctagatagtgcacacatgggacagaattctgccttgttttgatgatctctatatccctaacacctaactgtctgtccggaaaaatttagatgctcggtaactgcttgcagattgaatgaatggagaataaatgaattactagtcacagatgtaaaactgatttcctcatcatgattactgacttccttgatttcccatatgaccatgcagccaatcatcagctattttttttattgctgtttattaagtgggtccctttgtctctctggccttcagagcatcattctttctctcctgtgaaccttctccaattttttaaaacattatttctgctttcgacttcctctcggcctgctttgatcttccacgttctgcgtggaagttatttctgctttgaactttcacggctaagaagttttgggaaatacgtgttggaggtgttgggaggtatgactccacacagaagctggctctccttcaaagttctgtgttctggtctgcagcaaggtagaagcctatggggtttcaacctgacagcaccatttctactcacctctaagaatgtagctgtgagacaggattcaaatgtttagactggcaacaaatgagtatctatcacgatgcttaaagtgctctcccccaaaacaaatgttgtcattaggacatttaatttctgactctagagtctctcctgcagagggaagactttcttcctcagcttctttgctgcagtgttgaaaatgaggcagagtagcagaggtcatccccctcccttttcaggctgctgggattatggtgggcagagggctttccttgttctgcttttggggtgctccccacccaagctgcctttaattttgtctgtattttcctgttttactgcttggtatttggataagctatagagaggaacaaaatgacattcacccctcagagcccccaaatgttaagaatcaatatggaagtcttcccagattcagattttttttttttcttgagatggagtctcgctctgttgcccaggctggagtgcagtggcacgatcttggttcactgcaatctctgcctcccatgttcaagtgagtcttctgcttcagcctcccgagtagctggggctacaggtgcatgccaccacacccaactaatttttgcatttttagtagagatggggtttcaccatattggccaggctggtctggaactcctgacctcgtgattcatccacctcagcctcccaaagaactgggattacaagcatgagccactgcacctggctgattcagagattttattacatttttggggggcattttagattaccttagagaatgataatattgcctcttctaggggtgagaaaaacagtaatgcactttcgaggatattcatttgaaccagttttgaaaataagtctaaaggatttctaaaaccatataatgtatggctgcaccattacataggtgggcatatcccaaagtgactgccttaaagtcgataacaatcatttgggtatgtaagtttaggtgtgtcatttactttgacttgcacctgagtaagtgaaaggggttccaggtatgggaaggagatcttcaaatgacaggcagcagagaggggcaattttcttcctgtttttatctgaactactctgaaagaggagagggcactgccttgtcatctgattgccactggataatgttccgataaatgacacaatggtaagagcattgggttttggaattagaatgacttggatccaatcttagtggatttgtgaccttgggagcaatgtgacttatcttttctgacacagtttctcatctgtaaaatggggataatatgacttacctcaaagattattatgaccattaagtaaaataaagtatgtgaagcatttagtaaagtgcatgacatatggtaaatatttgctaaatgccagtacttttaaaaagaggtaattcatccgattcttcatcacccatgctgtttattactcagtttactgagtgctttaacaagcagggtcccagttaatcccaacgcccaccccctagagggcacattcttttccctattctgagctgagaagccatgctggcaaggtgatgcgacctgcttgaggtggcccaggtagtggcagggaggagaggtctgaaaggcaggtctcctggcctcatctggggtgactttccctacatcaagccttagtctctcctacaaagtcatcttggaagtcactgaataaggggatctggactttttagaatgtggcagtataaaataatatggaattctaaaaatgagtgtggttgtctaatgtgattggtaaacagcaggaccaggggagtggggggcaagacaggtgtcaacgcagcagacatgaagggtgcactctgctgggtacagatctgccctcactggacccgagaatggtgcttccttaggtctgcatccctgtcctagtcttgcacgtaggctctgcagtcacgcttaagaatgcctgatcaatggcagcttctggaaagactgcacaacctttaaaagtgccagctttgaaatgcatccccatctaggtgtcttagttctaagagtttttatttatttaatttttatgtttttaagatcagagcttagccagactgagcagttgggttcccctgaaagtggtggtggtagattgggaggtgatcccaggaagcagatctgaaggagaggggacagtgagatgggaaaccaggagaagccagcaggagagacagtattgaggccactgctgtgattcctctggacctctgaagaggtctacagaatgcctcccaaatttgtccctgaaggacaggaggctggagagcttgtctgcctgcaagtgttccctgagcagtaacttctggatacctggggaatatttgcatgaaggctgaggggacatccatggtgctggcgaaggctccaaggtgggaaggagcaagatggaaacaggaggaggagagcctgagctcctgcggagtgtccatcccagttcaggctaaaaatcagtggtggatcaacaggatctgtcacgggtgctaatggcaaagccaagagggtttttctgcatctcataaaaggtaaagggtaaaagttacaagacaaggaaatagatgtgaaaaagaatcaatttgcgggtacaccattcatgaatcaataacttttgctaatcaatcctagttggttaaaaagatctttttgaccaagattcacccactagattccataggcattaagaatccagctcagaggtagagtaagctgcctgtgtgatttcaaggacctcgtgtggtcttgtgccccaaactaccttcttacctgccctggagttacttaaaatccttgtcttacagatggaccctttgcattgggaaacctacttcccaatgctcatgtgttcatttacattgtcattcatcaagaaatagttagtgagaacctactgggtgccagggaccaagcatagggactatagtgtggtcaaaataggaagaggagaggtaagaatgggtatgtttgaagagcttacagtatacataggaaacaaggaaatacacatgtgaaaacctttatcattaaaaggcaaactctgattaaatgctaagagagtgtaacagagtcagacaagtgcgacgggaatgtagagggaggttttcagaagactggatttgccaagaaaggctgttgggagggagtgagttttgtcctgagcctggaaagatgtgcatagtctttccacagttatttctctaaccacacaagcaatctgcctcttttgtttttcttccagactaaacctttcaaggtacaaaaataaatccaagagtatggcattaatagccatgttatgatcttaaacctttggttgccttgcaaaagaaaaaaaacccatccccttactgctggaaatcacatcgctggcttacctggaagttgttcatgaatgaacaacccttgctaatcactctggtcaatatttatcataggtacattttacaagatgaattctgtcaccagtgttggcagcttctcaccaagtcccaccagcagctgcaaatattcattaataatattttgtttgggttcccacttgccactttccatcctcctgcttcataagtatgaacagcatcattaccaagtggcgcccacagaatggaacacaaaggcaacttggaaattttaatgaaaacagatgttgagaaatgccattatcccatgcacgctacaataaatagcattaacatttctaagtgacaggcctctgaattggactgcaaggagctcacatttacaattaaatgagggacttatccttttgcatccctggattctacaggtggctcggtgacagtcatctcttagtgtttcgattttagagcggctgttaagagccagctaagcagggattggacaggcaggcacttaggaaggtgttcgtgccagacgcattcattgtctaactgcctggatgcaaaactaacttagcatagcagctgaatgtgaaagctcttgaaatgatttcttctcaaatagtgcactccctgtgccaaggaggggtatcattgtttatgtcactaatgactacatcctgggcctccatgcattttgtaacccctgttcctttattagagcaatcagaaaaaagatcacataattaccaagatgttgctttatgggcaaggggtacggccacatatgccttcattgatgtgaataataccaccctgggcattactatcacccagatttcacagatgctaaacccccagcatagcagttaggagcatggactgtggatcataggagattggggttgaagcctggcactgctacttattagctcttggttctcaagcaaattgtttattttgtatgggcctcactgtctgcacctataaaacagggacagtgatatttactttcaggatgttgggtaagtatcaaatacccggcatgatgctcactgatagctgttggcttaggctcaattttgaggtcactattatcccacctattcactggtgtgagatcaccttcaccaaggtaatgttccatgaggacggtgatggccagagaaatgttggactgaatcagggcacagctttcttggaggctatgctcaatatttattgtcaatctctctgcctctctctgtctctctttctctctcttaagtcagtctctctgtctctctctatctctctctctttctctctctctctctctttacccaaccacttttcttttgaatagccatcccagacatcaggtaaaccttgccctgactgaaagcattctttgaaccactttcttcaagcaaataggtacatttaattctaagaggaccaagacaccttagaagcaatacatggaaacctccttaattgactcagcaattgcagaatgagtccctgagtgacttttaccccaaatttagaagttggaaaggggtcacttacaacagaaaatatgtattttctagtttttttttgaagtatacttggcctatagtatttcctgaggggatcctaatgcctttctattaaagcatgaacccgaagttgtaaatttagagaaacaatttgaggtgagggtttgacataacagatggccaagggactaatgacaagatcatactcttggctgagcatttggaatgtctcattatttgtaaaacattgtttagaaattgccttcctggcatagaactggttgacacacagatattaatgcatctaaccctctaaactgtacagataatgtgcttcttaagtctttatatttaattggctttatactacttaaatattggaaactgaaaaattcaatgttatttccttatcaagtatttctgcctttacacttttaagatgaggaaaatgagccacatgtcccagattccacaacaagagggagtccaaatgggacaatagggtcaagttattctcacagttgacagcacataaggatgatcctaggtgcacacactgtgtgaacagacattcctccctttggctcagtgctgggttaaacgtgcacactgagcgtctactagtgtaaggccaaggggtcaatgcatgtttgctttgaaagtgaatcgctcacaatgattacacgccagggagataaatgtgatggaggaaataaacaaacatgtgaaagttataatagctttaaaataaacctgttcctagaaggagacccctggaaatgcttgtacataaaggcaacctcctccctttcccagagctgagactatcgtgaggaaagcttgaagcgggactgtatttgaagacagcaggttccttgcatgttcaaaaccactcagagctagtgctctgtatctcattatggcagagccagatcgcgagataagcttgtgctgccacaatattactgttgcaaatgtgtggtcctgaagggtcttctttggaagggctctgctctcagaaatggccttggacttgcacgctgggaatgttttcatgagcggacatagattttgaaagggtcagtgtggctcaggaggcagcaactggagaaatagaaaacctactcctttttggtctggacgcctttcttgtgcttcgattcttcaaggatctaacagtgtttgtttcgtgtttctgtttggtgtgcagacggcatattccctttaacatggatttgttcgagtagacttcactatggtgcacagatcaagctatgttaaaataacgttaaaggtctgcactgaagcaatctgaagcagagaattccgcgtttcaggctgccacaccacctttaaatcaacggaatgtgtccgtgtgcggctgtccatagactcttctcactgctgttatcctcataataggatcattcaggttctcttatctggtctcctagatgcttgtctccaactatttcaaacagaagtgatttgttacccagcaccaccctacttcctgcaagaggcacaaggatgaagcaagcttgctctaatggggacccagttttccctgtcctcagttaagtattttatttacagagctaatgagcccttagaagcatgaaataggcacacccacacattacaaaaaggcacacacaagtgcaagttaaaataatttatagtagactggattcactggtggctctgagaccagtttgcccactgcaggtctgcgcagccagatgcaaccctgttgacagagatgaatttgatcacctccacctgcacaccttttgctgtattagccaagtgtgtgtttctttatccactcatctgtggctcccacttaactggcaccctttgaatatcagcagccctccctttggagagccagggaatgggagtcacaaaagtgtttcctcatgctgaaacatgaaaattggaatttctttatgaagacagttggtgatgtgctaatatgtacaatgaatgtatggcctcacacctttagcccccgagtgctgcatgtctccaggtaggcagacaggctgcagacacacacagctccctgctgctgttcaacaaatgctgatttcaaatcacacattgcccatcttcctgagggtcacatttctctttgctcattgtttttgcaggtctgattaagtcctatattcctgaaaatgaggttcagcctatatctgactccagatttatgagggagaattaacaccctgctgcttcctaaagctttattcccttgcaagtctacgttttgtttcagcctttggagttgaccaccttttcttgcaacttctgttgctctcagcgtccctgtctccaaatgcattgacccaaatgtaccagtgcttgggagaaagtttgtcttctattcatttaagattctttttctactttataattatgtaccaggaatagcctaaatatcaccaaaatgtaacctactgcaatacataaagaaatttaagttgcagtttgaggttcgcctctagttcctggaggcactttttagtgctttctgatcccagcacattatctctgttttgcaagctgggaggtgaggttgtcataggtcatttggcccagaatttgggtgggcctttgatttctttccagggcttactttccacacaactgcagccaccagaatgagtcagagctaggctgaaactattaatcggtatcgtggttaacatcttatccaatttgggcctaagagaaaagcctgactcacagataaaatgtggaagttatttgccttttcagaagccccaagaatcctttctatcagactggctcccggcaggaaagagaaaaaactgatgacattggcgatcatctcatctgctcactattgaggaaaaattagaaatcagatcactcaagagcactgtgaatgccgtgacaaaaaattattttgagatgcgattggtttgaaattctgacgtctaagagtcttgccctatctgatttgtaaagaagagaattctcagaacaggagtctcagcaacatccttgaaggccttcctcaccggcgcacctcatgctggactgcatagaatggcactgccaaagcactctcatctgtgcagctggccctgcggccctggcctgtgccaccattccagacacacaaggaatgcaccacagctggcacataattagaagctcacagcaaacaaatcattgcttttttgtcagtgttcctcctactgaccatgctcagagcgtggcagctccacccacgtgccaacaaacacaggacaacaaacagatatagggggaaacaacccaggtgcctccagttgtgtgttttgcagtggtttccctgccacttccctactttccagaacataattttgtttgaaattttctgtttctaccatcgtggagtttcccagtgaaaggcctgtgattaatcctcagtgagttgaattctcctgaagacttatatttaataatgacaccccatgcagaaaacaattcaaaacaaagaagagctgctttaggctctatacctcccagggcttgggaataattgtctcctataaacatcactgacatgcccaagaaggtatgtggcacttgctcaggtttaagaaggttctttgaccccttgtggatgctaaggtatagccaaggaataaataggctggtagaaactttaacaatgagtgatgtcctgaacttgaatgtaggaaaagaattacattaaaacaaaccataagtcagccagaaaagaaaagcagagcagccagaaagattgaagctccttgcaaatccaaagatggacttccctatcaaattttaaacaaacacaactaaaatttatgaaatgcccactacgtgtttgatcctatatgtgctgagtattggaggcagaatgagaattttgatgtggtccctagccccaaggaatttataatatcatcagtgtgaacagaggcatggacaaagtgctatgggggctcagagggggacacagattctacatgaaggagtgtacctaggagatgggtattgaagtgtggtgttgtaaagaatataatcccctaaagaggtctggcttttgccagtacctttgctagtgtctctagtgccttcctttgcctaggggatttggttcacacttggatagtctagtaatgcgatttagggtgggggctttggctctcgaggcaccagtgcactagagactgagatcaaccatatgggcaatcaatcaatcaagcttgcctctgtagtggggccccagtaacaactctgaacacggaggttcaggtaagctgccccgtctttgacgatacttggtatgaattgttacacattgataccaggaaagtaacatgtcctgactccaggggaagaagatggacaaagctctgcattctgtacttctccagatgctttcctgtgttcttcttcctgtagcttattttaatcatttccccacaataaaccttaacggtgcaaacaatagttttcagtcagttctgtgagtacttctcaaaaattatgaaacctgacagtggcttggggacccttttgcccttgcagttgatgtcagaagtaatgtggtctcttgagagacctattcattctgatggttcagttggcataactcacacaaagatgccacaggaaaactactcaatctgatacctttaaggttcctccctgatataaatcctgactccaatgaagccttgataaacagcctttgtgcccttaccaggattctaaagtatatgataagggtctgagccaagccaatatacggaagatgaacagagtgcctgaacttaaactaaacagttcaaaacatctttactgtattgacaatctggttaaaggtgcctacctgggactcctagaggataaagttctttttctttatcttatttaccaaatgaaacaatgtggtagcaagaaagccaactttctgttgtgcatatgacttgtggagagaagagaaaatgttgagaattttttccttaactcctcattgcagaatgagtcaataaaagagttatcatctcctagtgcacaaggtggacgttatccagggggatgaagcatgcaagtgttgcatggtgagatttgacatagggctgcatcctccaggaagctttccctgaacctggtggtcatggaagcctcacagatgttcgcatgacatcctgtgcctgactctgctgtagctcttcttacagaacaacaaacttatttgtgtgctgccttctaacagaacctgagacccctaatggttgggtcagtgtggtccttgctttggtattttcagtccctcagacatttatgggcctgacccatagaagatatttgttaagtatttttttggggggcggggggttgaatgaatgaactaacaaacagcttcagagtagcgtggtttagaggaaagaatagaacttttggattaaaaagccagttgggttcaaatccaagcttggtctttaacaagtgtgtggccttgggtaaatgataacttcatctaaaatccagtttattcaactgtgaaataggtttaataaaaccagccttagaaccctgagggagacaatacatgtaagaacacttgctctgtgtctgacagctagtaaatgttcaatacaaattaatctcctttctttttccttgagtacaaagaagaaaattatcaaatatagctgagataatatttcaaaactctgaattcaaaactatgaacttgttagataaggacatgtctagactcagagtggaagagaaacctggtgaattggtgggtaggagtctctatcatggaattacttccacaataattacgagggaatcggatcttgtctaggacacaggtccagatttaaaagaactcctcttcccacctcttccaatcctcgctacatccaggaacttactctgctgtgaaagtgtcacagcaacacagggaataatgactccatctcctctgaactgaagcataggtaggctaactaaaagtaattttacaaaagatgtcagtggtctggcaacggtacctcagtgacaaactattgtgattaaaggtgattttgtcaaagcataacactacctctcacaatggaagctttgtttatttcacatgggacagcaacttgctatccatttctagcagctcgcagtctatgtccaggcatacatcctatctctctacactcctaaagccccaaagaactgccatttacagaaataggtctaggatataatctgtagttaaatgcatagttgatttatcattatcttgggttatttggaattcacgttatttatattactaatcctgtccccagacctgtaagtcattgcccatcatccctctaacaaataataataacaaaaaatctccctcaacattatatttggacatcatctgtctgaaaggtaataagatacagcaactacaatgattgaaatgaagggaaaggattgttaatataatagaggtttctactgggcatgctttaaatcaatgtgcagaagcaatttgaacgacccatcctgtcatcatgtttaaaatacattgatttctctctttctttttcccccttgtggtttttatctcttaggttatttttccccttcctgtgaatttggatagcgagccaaaggaaaagaaacttcaacaagaagactggctcaaatcactctagggccagactgcaccttctataacatttctaataaatcatggggaaaaagaaatctctgccatagtggcacatttgacaaattgaaattaaattttgccaactctggagaaaccaagataacctgctttgatatttcttccctgttaatagttaatgggtaagaggggacatttgaggtttctgttttttaaagcgcctccctctgatcaagtgtgattctcaaaaccctgagtccatattcagcatggagtatgagttcaagggctaacaataaatatggatatttttgcatatagatgtatatgtatttttttcctttaattctgaaattattatctcagacagtggtaaatggaattttttgctagcagtgaattttcagtgttatcagctgtcaggttggaaaaatgtatggcagtaataaaggggggaaatatatgatccataaataaagaaaaacgggacttgtttggcatgataaagttttaatgcctctaggtagcaaagtctccaaacaaattcccttcctttaaatcttatgctcacttcagattgtgtctctcacattcctgctcccaggcctgtaaacagtgctgtggctggagagacctgcataccaaggaagaagaggtactgcatgggctgcctccaagggaggacttggcttttcttcttctgtacgggtcagggtgaagagtatgtcaagcctctagccagcgatgagccatgaaaaagtttttcacagaaacagcgtccatggagagcgcctttgtgcctgtatttctagaaatttccatatgctgctgaaaaacaatgatcaagatcatcaacatgtattgatcatgtacaacagaccatagtcaaggttgggtgcagcaatactggggtgaaggcacctgccttcagagagctcattgtcttttgggggaggaagataagacaccctatgaggctgctgaaatagcctagaatagtgtttacatgcaacacgtggatgaagattattagttgaataaatgaatataaatgtaaggttggcattaattaactgggaatggaaagggcattgaaaagttgtgttttgttttgttggggggctggaggaaaaggggttggatgtgtatcaatgcaggaaatgactcctgatcagggaggagaggaggaaatgccgcattggttccagaaagctgttcttcaacatcactttatattacatacattttgtttttaatgactggtttgccttgggtaaaaagacaatgatgagtcagcatattacaggcaaacaatcgaggccattgtgtgaaggtctttgctgtggtggaagtgtgttatctccctgaaacatccaggcgggttcctctgctgtcactgtacaatttgcatgcttcggtaatgttttatgtattacgctacttatacgctaaaatgtacatgcacgctcctgcaaatttaggtaaattatgaataaattaaatcttatctaaataaacaagtgtctttttgaaccaaaatgcaagctgtcatgaatatttaagtggacaaggatgaatcctcttcctgctgcacttcgtacagagtgcattctatactcttgattgcaggaaggaaagtgtacacagctagagaaacataatcgacttctcactagggacatgaacgttgagaaatctggcctggcagagcgatacattaaaaaataagattcattatggaaattaagttatatgggtgtctcctgaccctggtaatctctgccttttcacactatattggagatgcagagtttgagcacagagttattattttgatctttcttttagtggaaagaggcatctcatgcatatttcaactctagaacctaaggaaatccggactagttgcttgttggtttatatatgatttctgtaggaagctcatgagcataaggattggctcattgaaaatcaaagatttcaagaacattcagcgcccagggtcaagtttaaggatctcagttaatgttttcaggccacatctccttagtcttattttccattactcataggatctgagaatctgagttgaaagggcagttggggatggagttagaaaataatcaacagggaagttttataaacttcctccaaaaggccacgctttcccacctacacatattagtcccccttcatccaaggtttcacgctccgatttcagttctctcacaactgtggactgaaaatatatgtgggaaattctaggaacaaaaaattcctaagttttaaatcgcatgccattctgggtagcgtgataaaatcttgtgcagaacagctccatcctgctcagaccttgaatcatccctctgtgcaatttctccaggctgtctatgctatttgcctgtaagtcactcagtagccctctgggttttcaggttgaatttcacagtatcacagtgactgtgatcaagtaacttttattttacctaataatggctccaaagagcaagattagtgatgctggcaatttggagatgccaaaaagaagctgtaaagtgctttctataagtgaaaaagtgaaagttctcaaatgaggaaggaaaaaattatacactcaggttgctaacatctatagtaagaatgaatcttctatttgtgaaactgtcaacagcatattgttattgttctattatgtgattgttgttaatctcttactgtgcctcatttataaattaagttttatcgtaggtatgtatggataggaaagaacatagtgtatatagggtttgggactatctgtggtttcaggcatcccctgggggttgtgaaacatatcccctgcagataaaggggtctactgtcctcttgcatattctgttccttctgtctagagggccctcatcctgtttgtctggaacaactacagctttcttgcttcaagacttgggtcttctccttcatggagccttgtctgagctccctaggcagagcgaggcgtgttaacctagttggaagccccaggagggcaaggcttatgtctgcttcttctccacatatccccagcagccagcacaatgccaggcatgtagaaggcgttcaaaaataaatccctcctaaaaaaagactctcctgtggtgtctgagcttattgaataaatccctctatggcaccataagattgctgtaattcattattcgtttacaggttagtctggcccaatggatggctgtgccctcaaaggcagaggtccatcttattgatcttgtatccccaggaccaagttccataagtatttgacaaatgtttgtttattgaaagaaagttatatccattacattgcaattaattgcagcaacaaacctgagacttattagctcctgtgcaccctacagcgtcatcttcatcatagtcagtgtctaggcatccgctttcattgttgttggcagtggtcttctgaatctcaacaggccccgaaggtcttagtcatgctcacctacccaatagttggttttttcctacttaaatcctccaggaaaagacaaaggcttcatacatcgtcaaggtggaccacggggttgaaataaggaagcacaatagcagtcctagggggtaaccttgcttcccgtttttttctccagctctggatcagccctgggcaggccctgcaccaggtgaggatggggtagggtgaggagtggatgcgtgtccactgagctttgcagcagagaagaggcacggcagaggagagaagagagcgctttcagaggaggtggtgaggagggaaggggagccgctgagcctgcctgtgagtggttgctgttcggagggccagctctgtcaggagctctatctggactctgcactcaggacaacagacagagacagcacattgatatcaggtccagtctgtccctttccacatggatgcccctgctcaatcggccatgtatgaacttctaagcaatttctatgagctcattttagaatgtaactctctttgccatgaaaaaaacctcccttcatatcaagtctaaatctctcagggttctgtaatgtaaatcctcttctatctactctgttctcagtggagagggctgacacctggccccttccttctcaccataagcatatatccactgcaagaccatgaccatattggggttcatcctcttctttttcagactaagtcccccaatatccttcatccaccttcacttgggacctcatcctaggaacacagtgctcatgtgggacagatggtcttgtctttgcagagcttcagggtcagacctggcttggcctacacgtgttggtttataaaatgaaactgaagacctcattcccactgcaggtgatatggaggtgatggagcaacaattaggggctgtaatgggccagttaatgttattggtaatgaggacacatttactcacagaaagtggactgccacctgccaaatggccaatgtccctttgagccctgtcatagacagaacactgggccgaccatgagtttgactcaatatcatatcctttcagtcagactgagagctggcctctccatcggagagaatatgggtcaagttcagaaggaccaagcatcacagatttttttttttctttctgtaaatgcagggcctttacttggtgctgtgaggaacttgtgagttctgagttcatctgatccctggactccctgcctaactgaacacaatccaaagtcaaactgaggggctggctcacatttctatataacagtgtcctcgttctcacctgccctttaggacaatatcctgcattatcagagcagcaagtgatgacacagagcagctctctgggaggaagatacggtctctgagcaagacaaaaacaagaaaaaaacactaatggaaaacccactgatgcagttcaaactgtgtccccatcagtatgaaaggcaagtttgcagggctggagacaggctttgatcttgcctcgaagtcaaaggcaatctggaagatctccaagtgtaaaggtgcatgagaaatgcttccagtgagtgagatttcatgggaggttggagtgggtgagctcactcactctgccgtatatcctactggggagaaactccattcccaaagtcctgctttcaattgtgatctgcccagtctcgtcccacagagacttccagcctagtcagctatgcaatcaaaccaaagcatgcctaagcgataactggagtcccgacggctagtgagtgggaccgtcagaggtgtttgaaccagagcaactccatcctgaataggggctgggtaaaataaggctaacttatttagccttaaaataattttcccagtaagttaatcacagaatgagataggaggtcagcacaagatacaggtcatggagactttgctgataaaacagcttacagtaaaaaagctggctaaaacccaccaaaatcaagatggcaacaagaatgacctctggtcatcctcactgctacactcccacccgtgccatgacagtttacaaatgccatggcaacatcagaaagttaccctacctgggctcaaaaggggaggcatgaataatccccttgtttagcatattgtcaagaaataatcataaaaatgggcaaccagcagccctcagaactgctgtctatggagtagccattcttttgttcctttactttcttaataaacttgctttcactttatgctctggactcgccctgaattctttcttgtacgagatccaagaaccctcttttggagtctggatggggacccctttccagtaacatcttcctggtaacccaggtgggacaatagtgaggaaacccccaatccaaaggctaactttgggtaagtggtgggggtccggtaacatctttctggtgaccacagaagagacaatactgagaaaaccccgacccaaatgctaactttgggtaagtggtggggtccggtgacatctttctggtgaccacagaagggacaatactaaggaaaccccagacccaaaggctaaccttgggtaagcagtgtggtgtggtaacatctttctggcaaaccatggaagggacgatactgaggagacctccaacccaaaggaaatagactgcagcactgattggcagattttgggtaggtggtggggtacccagataaaggatgggattgggttaggggcccaacttagggcagttggagtctctcctaagacagaaaccattaaaggctcctctccataaaaggcaaggacacttgaccgaacttgagtttgaggcccaacttaggaaggttagagtccttcctaagatttagggaattagaggcctctcttggtaaagtctctctcagctaagaatgggtttggcactataggatgttaactgctattctctttggattattttacttggcactctttgctgaaggctatgggtgacagagttaagcatgtataggatcttgggacatggggagctttttcctccctaaaaaagggaaacttgagagccaacaggtctgctggaagagatccttttgctaccaacaagcagccacctgaaattgtcagtgttgttgcaatggtgggtcttactctggcctctctgagctctctgccttccccaccctgctgtgcacaatgcttttttctctttctctttttgatcttttctgttactcagggcaaccatcttggccagcgaccacaagttgaaactcctggtcagagggtggattaacgatgatggggcccaactgggggcaagtttgggccttacaagtttgatattgagtactaagcagagtgccagtgtctatgttttgtcacatgtattttgctctggaaaaatggaaaaagataactttctcttatgttgcagcttggcacccagggctatggtgcagtgagctgggtcactagggctgctcagggaaagggaacccagaagcctggcatgctggcaaaagggtaagaacttcttaccaatcagacttctgggctctctctctttgtgcaaactggttgaatgaatggtaaaaatcactgtttatctcctctgttcaaagtttttattaatgagaaaaagaattcgtgaggctaatcttaagctgcagggaatctggtatgctctgtgtgtcttttttgtactgttttgtcataaagaggggtaccttaggatagaatgagggcctaggaccccaaaaacctgctgttcaagatggcccggaaaactggtcagccatgtccttagaagcttgatcttgttaccatgtggccgtcctttctcttttcagaatggcagcctgggttcatggctcaattcccagcttagagaatgggttattcttggcttaatatctgtttgacctttaccatttgtttattctcttcccttctatgaattaccttaaattttcctttttctgagcaaagaaatgttggctgtttggcatggctaaagttggataaaaaaagatttaaaggactttttaaaagagtgctatagttaaaagtcatcttaattaaaagcagatattcaggctccaacggcctgtagttccttgggaaaaacagaggaggtaccacagaccttgtttggggggaaaaaacacacaaaaaaaacacaaaaaacctctgttttcctcatggaacctcaggaattaaaagtggatcaattcctctcaaaatctaaggttctcttctgttttgcattgtgttatctgatggttttaacttttggggatatcagaaattactttgcattatgagagagctttggtgtgtagtaactaggtaggaaacgtacttttgggaatgggctgattccctttttgggattcaggatctggtgtaaaaatgggtaccttaatttctggagatctgtattgccttccagttgtgcctgcttattaggccctagaaacttcatgctttaaagagaaacttaaaaactggcaaatgaaaaatcttacaactactggatcttcttccatctgtctgtgcatttatatgttatgtgtgtgatgtttatatatgaaagagctttaattaattcgtttaaaaataatagaagcttaaatcaaatattttaacagaaaaataaaaattatcatgccttttaggtcacatgacttcagtaatctttgggaaataaaaatcactttaaagattgttggtaaaataaagacatttggtcttctgtctggtgtcctaggctccacacctagtacataatgaaaatcccttacttaccacagttttcaccaaaagtaaaaattgctaagagttaacattgtgacacgtatttgagactactaaaaacaaaacaaaacaaaacagacaaacaaaaaaaaatttcacacgcaaggtgtataaagaaagtaaaatgcatttttggtaaaagattataagaagctgtgagaatatggatttcttacttaagtttggaggtttaaaggattgttttaagttagataagataaaactgaacagttgaacaaattgtgaaagatttgtaaaaaaattagtcttgtaaaaaaattgtgtatgtggacatattggctaaagttaagggggtattatacagtttttccataaattaaacatttgaataaaagcataatgagtttttcttagagtgaaaagaaaacctgcctataatctgctctttaacaaaattacaaagggttataaaaggtttatgaagatcttaccttatggtcaggcattacaattggatagatttatctataagcttttattaagaatagggtttaacagtaatagtataccaacggaagggtgaaatttggcttttttggtataaaaatcatacaggaagcattgtcaaaaatgaaatggtatttggctttctttgggctgtatttgtataaatatcttactggtatgtgttccaaaattatgtgtaactcctataattctgatagcacttggtgtagattatcagtaataataagaattgttacataaaatcattgtatgccacagaggtaaccacatttctttgttagtcatgtttttgactgtggctgccctaaacattttgtcatccacagacaattgttgtcttgttttaatcctcttcaaaaggtggcttataaaaaaagatggcttataatcaatataggaccttaacaggtgctcttaaatgcaagtttctgataactttggagattgtgacactagaatggaggaacaaactttcaggactcatggagagctgaaatgttcatgaacatcaagcagaataggagttaactgcatggactaaactaatagtaaactaatagaagtctgaagtaatcttttttaactttttgtttaaaacattgctaatcctttgctttgtttttcagagttaagaaaactcttctgttgagctatttacagcttgaagcaattgagtaaagtacactcctgtaaacagaatttggaacacatttgtttccctctacctgattgcttcagaatttggaagttactcgtgttcttaacttatggcaatatagttatttacataagtgtaataagaatctattttcttttgtaacaggacacaattggagaaactggttattttaccatgtctctgactgaaatggtgtgctttctttaaggaatcaaacttatagagccaataaaagccccttgggaaactggcctcataccttctctacacagtccctgtacagggttcctgacctgtggtaagtaaagaatgtcactttctgacatgtctaggagcccaggtcatcttgggacctcaacaggagagtaacttacccaactcataggtatttgagggtacaaacccaccgcagggcttggctttttaaaaagccttatctgagattacttatggaacagagtttcatcaaagccaattttaaaagcctatgtgaaataattattcttgctgcactttatacaaataatcaggccaagtaaaatcaagtaaatcagtctcaccatgatttgtctttagtgaaaatggaaaattggagagagaaaaattatgtttcaagaactatggtatacctgttattaaattccagtctcatcagttgtttgtttttttcctgcaatgtaggctgaccccgcttattcctgtaaaccaaccagtaatctcaggctgctactcagaagaaacaagaggtctgagtaatgtaaaaatctggattggatcaatattctaatcctggacatatattggaatcaactagcaactctatatcagcttggttcccaacagttgcccagttcatggaaagccttctaatttagtttacatgggataattttgcttattttgttatattgctgttggactctctgtgtaggaatgcagaataagcttactcaatgttttcttaaattgaatgcttatcactcttccagatatcaccttttgttggaactcaagagttataaatggcccttgacataccaaagctttctgactgagctcctctctaccctaaatacaagagaccttcatagtttggcaaaaatatcatcacctctattcagcatgaagaagttacagaagatggatcttcgttcctctacaacccttaggattaagagttctcttataaaagggagttgggaaatgtcagaggtgtttaaaacagagccactccatcttgaataggggctggataaaataaggctaagacctgtggggctgcattcccagtaagtgaaggcattcttaatcacagagtgagataggaggtcgacacaagaggcaggtcataaagaccttgttgataaaacagtttgtgttaaagaagccagccaaaacccactcaaaccaagatgtcgatgagagtgacctctggtcgtcctcactgctacactcccaccagtgccatgacagtttacgaatgccacggcaatgtcaggaagttaccctatacagtctcagaaggggaggcatgaataatccaccccttgtttagcacatcatcaagaaataaccataaaaatgggcaaccagcagcccttggggctgctctacctgtggaatagccattcttttatttctttactttcttagtaaacttgctttcactttactctatggacttgccctgaattctttcttatgtgagatccaagaaccctctctggattgaggcccctttccagtaacaggaccacacagtttgggaaaggaatggggtcccgatggccacctgctcaggtagaggctttctatttctcctgtccctgctgaccggaaatcagctgcagaaggagaaaggcttgggcaacgcagagatgtctagtcacagacatttgactaaagggcggtggggagaacgggcacttgatggtcatgatggggcactacagagaagggaaagagacagaaggtggagacggtgtgaaatgggcagcacccaggagtcacaggtgcggcttttccaatggatgcacctgttgaggatggaggtgcctggacgcacgttcaccatggcacaggcagcagtgaggtccatccattttcaggagactgacagaataccagcagcctgtctcagaactttacttaataaatcaaagctgacaactcccaaaatggtatgaaaacgctttttagtgtccatgaccggcatacattgtattcatttcactttctgaaataagagttgaaccataatcacaaacaatccattcttgtcaggtatcaacagtacatctttctttagccaccaaagcgggggtccctgtaatctggcactgcctgggcctggggtgaaggagtcagagtgaaacagcaaacatcgcggagacaacagctcccatctgcagagcactttggaatttccaaagatatttcacccacatgatctcttttgagcaccatgaccaccctatcagatggattttattaacttcccttttcacaagggcaaatgcaggtggagagggcatagctgacactctatgcacaccacagttgttgtggtgggcagccctgtgtagtgggagaggcttgccctcagacacctgccctcccagtgcttgcgagtgagctgctgggtgggctccctttgttggcagctctaggccttgagttggggtagaggcaaagctaacccagacctgtcctccaggcctgtcctcataggttctcccaactcctcctctatccaaactgctgcctcttttttaacactttgcttcagggtagggttccctgtgccttccacagggatcatgagctaatcataaaaaccactaagggtcaaggggcaagagtgagtggcagccatctttgctgccaacagaggaagactttaccaggaacttcaaaaggcagcgttccagccactgcttatccccaaaataaaaggaaggactcaactggttgaaatgtcagacttgggagcctcatctatgaggggcctcagctgtgcaggggacctgaggataatagattaggatcctggagtactctgcctgggagaaaccttcaactggttcactaggagatcccatatccacagccaggccaaagcagcaatcagaacaaaagactaacagttaccggacaggcccaagtcacacatacactgcaaaataaaccttaactccaatcaagtaagaggcagagcagcactagctgttgaaagttcagccaattaatatggtcagcccacctgggtctcactaggcactctctgaaggtgatagggccttgaactgtccctggtggggttgggtaggaaaagaattctgtataaagaaggctttgatctcagatcattctgccaatgtccaattacacttaggacccgactgccattgtgtgaatgtgtattgtgctttaaggtgacatagtgaatgaaagagccatattttggtagagtgtgtgggtcacttcacttagatgatgtgctggtggttcactggaaaatgtctgagaccagaggtcagagcatcacttgtacactactggtcctgaaaagcctattcagacatttggggtgcatatgtgactgagtccatgcagggaaggtacctctcttgattgctgctttctcagcgatatcaccttggtgctatatgtgcaaatatttacatgtaaatgaaaggatgtgatttattgttgaaattcctaaggggaatgccatgggaggcactctggagcaattatctactccccgactcttacgccacacagcgtgtttcagacagagagaacatctcgaatgtcctctctgcccggccctgggaaccacatcctgaacccccaccaagaccaaggtgtctttattcaggccaccttctctatcttccagtgtggttttctgtctttcctaaactgcaggatgcaaattgtggactcaggcttccagtgaaagcgattaagacatcctggcagggaggcaagctctttatttgcccttttttgatgggacagcataaagctggatcatttctctgagctccctggaggccatcaaagtctacatgggcagatggagcatataaacaagccgggcaactcactagctgctgtaaagcagaccgtggctcctctacctcgaggagagtagggcgggtggaagtcaggcacagaggcctttgcacctgcagcctccttgcctgaccctactggctttccatttgccactcttccatgagcacatgaattcagaaggttggggctataaccttttttttttttttttttttttgagacagagtctagcactgtctcccaggccggagtgcagtggtgcgatctcggctcactgcaacctctgcctcccgggttcaagcgattctcctgcctcagcctcccaagtagctgggaccacaggtgcgtgccaccacgcccagctaatgtttgtatttttagtagagatggggtttcacaatgttggccaggatggtctcgatctttcgacctcatgatccacccacctcagcctcccaaagcactgggattacaggcgtgagccaccagcgcccggccgatcatggctataatcttagctctactatttattacttatctagcctaggaccaatcatctaatctctcttaagcccatttgcataacaaaatgttattcataccagtttgcatggtaggaaaggaggaaactgactacttctgagtaccaactatgtgccatatatatagtatctggagaccgtaagtcctctgggaaggtcaaccagcattgtgactccaaagcttgagctatctctactttaatatgatgagagctgggagcatcatgatgaggtgagcaaagaaagctcttgagaagctccaaatccatatacaaatttaagacattacgtctgagctgaaaacatgtgttgtgcttttatcacagtaattttcaaaggagaaactgaggcatggggtcaaggcactgtactaaaggtcccccggcaaggcaatggcaggctcttaaccctgggatctttgctcttggcttcttgtccagctctggaaggcaggtggactccctgagcagaggctgcaccatcctcagctggatgggaaccaagacgccctcagggaatgtccagggagcagaagctctttctgtgtcatttgccgagttccttgggatgttatttctccggggaaacctgttattccttcctagagtcactaaaagctcacagcaggaacttcatgtaacttaagttttttgtgtcgtgcaagtttttttgtgttgttgctttttttttaaaatgggaaaaatacttcctttttccaaatgctatcaatttcaatcaaactgtgtatactgctgaaccaaaaaggctgtttaaatcgctgtgtgtgttttttcccttcagtgtctctcaatccttctactagcttctcgaagaattaagatttgatcttttcaaatgtaaattaagcaatttacaaaatatgtattttggcatataggaaacttggctttccaaacaaactggaattttatcgattctatgaactgccatggagttatcttgtggccataatttgaatctctaatatgagactgttttcatttataacaagaagtacattctgcttttatctaacttcaatctccatttctgcatttttaaatgggtaaaagaagtgatgtcagttttaatatgcttttcatgagtttagtttctcaaatgttatttttatcattttgtcaattttacttattactgaaacaatatttgatgccacaaaagaaattgaaataggaaaaacatccacccacagcttccccagcctaagacagctcttcatattcacccatgctctctccaagtttttgacaccctgcatatgcttttatggagttataacaattctgaaaaagtaattctcaaaataagtttcacataaacttaaaaaaaaaacaaaacaaaacttccttgacctcctttcaaggtctccggctcagttttgcataaaacttttctgcatgtttcattctaagtatatgacagggactttacatttcagagattaagaatacagttctcagtgtctagttaatgatattaatagtggggcagaacgtattaataaatacatggtgactgatcttcaaggttaattattcaaccctttgcatcaacaagtagtgcacatgaatcatctcatgggagtctcctcttacagcattcagggaaaagggttctccagtcttgattgtggatcttttttttttctttttagtaaaaacaaagctcctgttaacatatggcctaaactcttccagtaataagtttcttgtgtgtgtgtgtgtgtgtgtgtgtgtgtgtgtatgtggtgtgtggttttttgtttttctatttttctcttaatagttgatacttctttttaaaaattgtgttaaaatgcactaaaataaaatttatgatttaaactattttaatggtagagttcagtggcattaagtacattgtacattcatattattatgcagtatgaatatgccactaccacccatctccagaaagtctgtacccattaaatcctaactcctcatccccattacctccagcccctgacaaccaccttctactttgtctctatgaatttaactactccacggacatcatataagtagaaccatacaacatttgttcttctttgtctggcttatttaacttagcatgtattccaggttcatccatgttgtagcatgggccagaatttccttcctttttaaagctgaattatattctattgtaaatatagaccacattttgtttatccatttgtccattgatagatgatccggttgcttccaccattgactattgtgaataatgttgccatgaacacggatgtacgaacatctgtttcaatctctgttttcaattcctttgggtatatacctggaagtcgaatttctggttcatatggtaattctatgtttaattttttgaggaacctccatattgttttcaacagtggcagcaccattttcacattcttaccaacagtgcacaaagggtccaattcatcctctgcagtcatttcaatctctttctctctacttggaataactagccacagccctcgttatagtccttcacagatatagattcacccttgtctctaagtcgtggctgtggtacagatgtggagtccgaggcacagagctgttcagccccagcccgaaggcccagggcagggcagaggcaggagtcatcccagcggcagtctggctcaggagcctggaaacttcatcatcatcacggtgttagattggctgtcagagaaactgctcttagcccctcctgcaaccttattgatatggtttggatttgcatccccacccaaatctcacatcaaattgtaatcccctatgttgaaggagggccctagtgggaggtgattggatcatgtgggcagattcgcccttgcgttcttgcgatagtaagtgagttctcaggagatctggttgtttaaaagtggggaatgccggctcctgcgccttctctctcttcctccttctccagccatctaagacgtgcctactttccctttgccttctaccatgattttaactttcctgaggcctccccagccatgcttcctggacagcctgcagaattgtgagtcaacaaaacctcttttctttcataaattacccagtctcaggtggttctttatagcaatgtgagaatgaactaatacacttatttttcaaatttgctgttcttccactcagaactgcttcatgaaaagtagcattatcatatgtgtgagacattatcatgtgtgagactcagtgagaggtgaggctctggcagccagatggggcaggcttgcccatcagctccatcaccagcctttccagtcctgagagcttatcctcctttgcttccctggctgtgagtttgggtgaggtctaatgccagacttgacatgaccaacctatgactctaggagatggtctgtgcccttttccctcccaccaccatctctatgccctctgggctccttcatcagggtttctctggacctggtctaggctgtgggcaggcaggaggggacagggcctatggacccagcaggggctacatagggagatttggaggcaccaaaaggtgttcttgcccttgaatttcttgaaaaggacactggagagccccatcttccctctgcctgcagcctagtatttcccaaagttggttcctgggatgaaagtccctaaaatgcacctttcaaaaagggttccaatgctaagtaagtttggggaacactttgtggggtatgtgtctctgcagagccatatgcactttgatatggtaaaggctctggaaaattccacagtaatgaaacctgtggaattaagccacagtatccaccaagatcttcattaaaatacaaacacataaccaggatgggaactaatcaaagataacaatctgtctacctctcagctttgcttctgcattgaaatgttggaacggggaacaagtgaagacaagatggcctttaaattttttttctcacattatttaattaaactacttgatctttctaagtcttcatgttttaaagtatgatttaacgtaaatgtaacacttgctcatgatagaataatcagacaagtataaaattaaaatgaaaaataactcataatctcaacagccagaaataatcactattagcatattgagtattttctgataacatttttctaagtatatatatatatatatatatatatatatatatatatatatgtatatatacacacagacatatattttttttttctttgagaccgagtctcgctctgtcgcccagactggagtgcagtggcgccatctcggctcactgcaagctctgcctcctgggttcaggccattctcctgcctcagcctcctgagtagctgggactacaggcgcccgccaccatgcgcggctaattttttgtatttttagtagccaggatggtctcgatctcctgacctcatgatccactcacctcggcctcccaaagtgctgggattacaggagtgagccactgcgctgggcccatattttgtatttttatgaaatggtgagcatgccagggataacattttatattttgatttttttcttacctaacattatagcatgagcatccagtttaactgagtggaactgtctcctgaaggtttatgagaaagaaggcactcacatttacgtgcacctatgaggtgagagagcatctgcatttgaggccacattttattctcacatcaactttatggtagacatattgcctcctccatacactgaaggacatgaagcccagtggggtgagagggtggagagcacacgatcgatgctcctcccaaccctccaacatctcttctagagtcctgggtgcccagcccacccacctgtgtgccttgctccaatggaccccacctgtgactgtgtgctgtctgctgcccttgggccagcccaggtgcttcaccctcctgcctgccccaacttgcagagaacaggaattgcttggcagtttatttagccaatgattgctgtgggaggatgagtatttgcttagaaagtccaatacactctaagctatatgttacatcctagagcttcccagcaggatcaagctgagactgggactttacttaaaatcacacttctgtttggcatcatccctgtctctattctgcttccctttcttcttcctgtttctcttgggagcatctgcctaggaatccttgctcagggtctgcctctggggattgatctgagactggtatttccttcatggtcatatgtcttaaagcagaagcagcatttccaggacttgaacttaggtcttccagacctcagagtcaaccgtttttctatcacagacccttccttgcctgattccaaaggaatcagccaatgcgtgtgggagaaaagtcttcaggctgtgggggtggggtgggtgaggctgggccctctagctgcctgggatgtgaatggaaggaggactgcaggtggctgtgtgcagtgggaagctcatgaaggatgagaaacctaccgctatcctctgtatacacacaccttggggaaattcactgtgtcgtgcctcagccttgccccagacagccacagggctcagggcacaagctgcagatgaaagaagtaatgggcttaccactttaacatgctggcacccagccaggtccccacttaccgtgtgaactgcctcgccaaatgtgccaggagcctcctgtacgaaggccagagaaatgtgactgtgggctcatgctgggaagcaatttggtccatttcaaccatcatgtcatggcagcagaatacacaaatatagactagacttgtccaggggagcttttctctcattaaccttgaaggatgacgcacatcccgttgacggctgctctggagcctgtgactatgagaggccaggtttgatgaagcaataggacttaaacagcagacattagtgctgccaaatgcatttttcttcttaatacactaaagatccatcataaatactgagaagggtgtgtgtgggagggacagaaaggctgggatgatgtggcagggtgcatatgcttgccattgggtgctgtctgtcgtcagcaaaagagaataatctctcagttctcacctcctaagaagttagcaatctctctgtctctgtctctttttctcctctctctctctctctccacatgcacacacctccagtgtgagttctcctctgccattcacaaggcagactcatattttggctttgatctcataagaggtcagtagcagtgtctgtgatgtgtgtgtgtgtgtggttttctgtatgggttctgtgatcagaagaggggcagaaatgcttgtgatgaaagatgtgtaaacagttctgtgcagagacagctgataggcagtgtcttctgcaaatgatgctaagggaaagactgtcctcaaagccatctcagtcatagtgctatttatggctggagtggcagaacactcttcacctggatgtcaggttgctagaagggacagtggattttcctaggaaaaagattatttcaggaaagaagcatggtttaaacaaggctgaggttctgctcctggctgtggcatttaggagagaagtggcagccgctgagggatgaggactccagctatgtacagggttcctggtttcccacaaattgacttcatgtgctgctgaggcacaaacactctcttaaagaagttctgcaaagataactgttgacctttgctgagctaccttgcaggtagagccttataaaggagactttataatataccaaagagaaagaagccctgtccttggttccaaggatgggaagaggagaggaacacaggctatctgggggtgaaaagtggtaatgataatgaaagcaaatatggaatatattagcttctttaattctcacgatgggcccaagagggagcttctatcattattcccatttttactgaggaggaaactgacacatggcaacttattcaaggtcactgagcaacatttagcagagcttggattggaccaaggcaatctggttccaggggccacattttgaatcatggtgctatacaagccattttataaacaaagagcaactgaactggacaatggatagcagcctcaaaggacaggaggaagccaggccaataggaggaggaggaggggacccccaaactatatctgagctgcaaaagcttgttcataatctaatgagagaagccacacacataaacactcatggaaaaggcttataactctgacaaaaacatacataaattgaattgacattaaaggtaaaactacacctcaactggggaaggaacataggtgtggaaataagtttctccccaaggtttcttcctcttcttcttggaagagaaagtgacctccaaatgaaccaggtttgaggagaggaaggaggatgaaccgagagtccatgaggcagctagggttgcttgttatagcaccaaccttaacctgagtcttgctatttctgtttttggccatggcaacatatcactccttcctacctcaccctcctttctatctctacatatctcagttgaaaaccaatcttttcttttttggaattgtcttcatcatttacttcttttctgctctgatttacctttagagctgtattaactctgacgttctactattgtctgagaagcgtaatctgaaaggggacagacatttttgaccaatagattaagtagcaggaattcaggaagggagtaaggaggataaggagagaaagagggaggatgatattggaattaatttcaatacaacaaacaggtaacgagcatttgtgatgtgcccgttgctggtacttggtgctgggaatataaaagataagttctccaacaccacactgtgagctcccagagggtaggaactgacacttaaatgtgtaatgacatgacaatctgattaaatttaataaaggcgtgggcaatgggtctgggagcacagagaaggttgcctttatttatgtttcaggcagaaaagctgggaaagttatagaagtgatatttaagagcctcaggtgttgggaaggaatttgctgaatgaagaagggaggaagagcattccaggcagaaggaagagtttgagcaaaggaggagaagtgcatgaccttctcaagacgtagtgattgctctgggtgtggccaggcagcaggcggcgtggaggcagaggggccaggcagccaaaggccttggattagggctgaagagttgggacctaccctataaacaacgtatagttgttgaaggtttctagacagaagaatggcttggggggctgtgtgtttgagagacttcttcccaaccacagggtggagaatgggtggcaggccagtgaggaggctcctgccctggtccaaaggagagaggctgagactcttagaatgtccaaggagagggcagaggtacaaatgcaagatggcacccgtggacacattgaaagtttagtgatcctacacttgattcttctcgcagtttcagaaatactacctcctttgtaccactcttggtacgtgccacctcctatacaaagcctctcctggtgctaccagaggcaaacaaattctccctcctttgtgccctcctgctttatgtgtgtagcctttctctctgggttctctagatttattttaatttgtgtactcgttttgtttgttctcacatgggtagggaaaagggcaaagctctggatgtttgaaaacttgttttgtactaaggatattgttcttgattgctgcattgccctgggaaaattaatttacctctttgaaggcttggtgtcatcatttctgggaatgtaacatttaggctgcaggcaggaaaacagcacccatgcaggtgtctgcaagggagagtgaggcagcccagaggttagtaacagtaggcagccaatcccaggctagaggtacaaaggaaggaggtagtatttcctgaactcaggaatcaagaccacccagtgggaactgggaccacccagaagactcagctactctcttagaagtgatacggggcagagaaagagagatgcagtaccctacttctcccatcctctaccctctaaccccttgacagtgccttccgttggctgaacctacacggtagccagttggccaggaggtttgggaggtggagttcacagggaatagtggggaatggatctgagtgtgccaactggcaaatgaccaatataaaaaattcacaaaaagtctctggccctacttatttcacaggatatcagttagaatcaaatgaaatgatacatgtaaaagccctttgtaaattacagagagctatgcaaatgtacgctggtatattcacgttttatctggcagtcaaaaaaatctgcatttagctgttatgaattctctgctgacctggatctgaagtggagtgtggactgactgcttctcgagggatagtccttgaggtgtggacgtccaaaaggctgccagggatgtctgggggcacatggactgtaccgtgtgatacaaaaccttcctgcagaagataagcttctgggcacctgtctctaaacctttcccatcagaccagttgagtgcacatgagcatggctcgtaggcacctgggcatggaaaaggacctctccagctctgcccttcttggcagtgagcagttagcggccctgaggaatgaagccacagccgagtgaaggcgttccatgctgtccaggtgatggagggaggaaattgaaaagacattcaagagtttcctgagctgagctcttcccctagcatcatgctgttcatactacacatgttgttttgctcctgatgataaaggagatgctagggtaatagggctgacgcagttgaaccctgtagtctcttcagccccattaacccacatccacccaaatggattctcagccagtcccattaagacatcctgtcagaaccttcccacgtcatttgcagagtgaagtgaatatcaataaaattgtaacgagtaattatcccagcttcactgactcttactggaaatgaagccagccctctgctgtgggtattgacaaaaactccattcctcctgggagctgcttttcttccgctgggtaaatctgatccatctcagcagataccaggtgtgctagtttaacattcatgggcacatgggcagcaggtttggaaaggggactctagcccctgtcccttctgggcagtgagaagccctgatgaatgaagaggttcactgctctccacgctgcgtcaacagagcgagtgttgcaccaggaggcagggcacctggcttccccagtcactatcgactactcccaccgtccaccctaactccatcaggcctcattattccatctataccacaataggtcctttccagttctggcattctatgagctgagagacagaacagccacagagaaatcaatctgccagagagtgatgcatttgacagtgtagacactcgaggcccggtctacattgccaggcatttgagaagcagacagaatgggagctttgctggcagtttctcaccgtggctttctgaccacagagagcccaagcatcacacctgctctgtggtcatgacagccagcactgggataccagagctgtgagtgacaaggtgttaattcaaggcttagggagtgtgatggttagggactggcccaccctttcctgttctctgcctgctgtctgaaaggctgtcagcacctcctgctgatggctggctgctggtgacttgctgcctgcttcccccacatgaaagtgtggaacacagcacgaaggtgtttctgcagcacctgggctgctggcttggaacgtgctacctgtgggggaagactggaggactgctcagttgctgttctgtgctgggattccagcctcctcttcctggctgctcaggaaaagacagcacaggccaagctggggttccagaagtatgaatatgtggggaggtgggcatgggtgcatgtgagtgtgtgtttgagtgcgtgtgtgtgtttgagtgcgtgtgtgagtgcgtgagtgcgtgtgtgagcgcatgtgtgtgagtgcgtgtgtgagtgtgtgtgtttgagtgcgtgtgtgtgtgagtgcgtgtgtgagtgcgtgtgtgagtgtgagtgcgtgtgtgtttgagtgcgtgtgtgagtgcgtgtgagtgtgtgagtgcatgtgtgagtgtgtttgactgcgtgtgagtgtgtgtttgagtgcgtgtgtgtttgcgtgcgtgtgtgtgtgtttgagtgcgtgtgtgtgtgtttgagtgcgtgtgtgagtgtatgtgtgagtgagtgtgcgcctgtgtgtagcagtgtagtagcggaggaacaaagaggtacaaagaggaatggaatcagtgaagctcagatccttaaagtcactttaagttgggttttcaggggggattttacaggcttctggggaaccccaagtaggtggtattcctctgccctgcctccctcccgtgccaaagctcacacaacaaaggtaggctgcaggtcttgcctggctgccaaagctttcctagagccagggggccaggaacaagttctgtggggacccctgttacctggctacaccatgtgttaacccagtgctggccaggttggttcagatgacacaggtggtgaagtgggtactagtttcctccgctcctccccaaccgggcatcctccttaaagctgaacacttggctgaagagagggtctgaccagacaatttatattacaaagtatagagcaggatgcaacttataaaagcccttccttatctatttttcatgtgaagtggagaaggtggagttattattctcattttagggataaggaaactgaacccagcaatgaacttggagtgccaaagttcaaacccagtacctcactccatcccaggatctctgtctcttacatgaggggacagtggcttccaaaataattccaagggtgctgataaaggagcatctccgctcctttttcctccatgaaacttggagaaaggcaggtgtgggaccaggagggctgcacagcttgcagtatgcctgcctggccatggtgacatgtgacagccacatggtagaggtgagggtggcacagttctggaattcttattccctgggaaggtgcattgccccactcctgttagcagcaaatataagacttgggctatgtgtctgaactggtcttgggtagtctccatttcacagactccagtctgaattaagcatcaacctgcttgatctttttccataagaagtagtaaccaacattgaattgcactatgtgcttcacatgtattcatctctcactgtaaacccacacatttggtatagaattatccttgtttacagacgagaaaacaggaatagagggaaaataaattgccttgagtgcatgcctctaaagctgatggagctaggattcaaatccaggccacaagggctactttggatcctccctctccatcatgcatataccacaccatccttcccatgcagctcatccaccatcatctgctcacctgcctgttttcctactggccttaggtgtgaacagagtacatgtcctgttcatgattccatggccggatcaaagagctcctcctcactcctccctgcaagcacctgtgcatgaacccacccatacctggggcacttgttataaggctcagggaattatgtgacttgcctccaggaatcaaggcgcctccagcttggaccagtttcctggatcccaaggcctctttctcttctgcccctgggccacattgctaaatatatccctgtatgaacccatttaccatctgtagctaaaatgcctcttgactgttctgagccaagattagaagtctgtctaaacgtcaatgattatttcatcggctaaaagcaaattgaccaagctcaccctccctgcagactaagaaggctctcagtctatttgtagctcagtctgatgtgcaagaggcggctgctctgagttgaggctgcctgctgctttctgtaccaatagggtttgctgagcgggtcattgatgtgtttagtctgggattagtagatactttggtataagtcagcagactcgggttatcgaagcaacaatgccccggtgcttgcacaccctgcagggccaccacagcagaatcccatgggggtggggagctcaggtgggcaagtccctcatggaggtctgcacaccttgttcagcagtggacatcctgatgctcacaaggaagagtttgaactgaacatggtctttgagaaacgtgcagagatgtgaccaattgtacaggaccctgagggatcgacgaagtctctgtttctgtctattttgaatttaaggaatgagagcagggacttgggtggaagaaaaatgcacaaagaagtacagaagttttcctttccaaaaaacttcagcagaatttttttttaaaagtgagagctagagaaaaatacttatatatgtttcagaacatgttttttctttctttttttttaattttaactttgtttttccttgtgatcccaagcttctcacctccaccgagtttccggctgcctcctctgcgctgaataatacagtagccagcccagtagacacagcccattgctgggcaggaggctcccaatacacagggaagggattgttcatttcatacatcatttaaagcctgctgcagtgatttaccggtgtcagcctgtctttggagcacagaaggagaagaaagagaaatatgtatgcttccattgtgtatctggacctggatcttagagagtgatgggggagggaggccgactgggttttcttccttatctaaacactgcggagaagccaaagattaccccacagttaggaagaaagaggataggaaagtggttgatgtcttgcagggagatgctgcttccctttccacctggcctggccaggcagggagggctgccttcctacagcctgtgtatagtctcctcattcccaggtcctctcacttagatccatcctgcacccctgtaagaattatcttctcaaaaccatgctgataccatgctactaaggacgtaacaccttttccccaggcaaatggaatcgctccttgccagtgacagtgaaataggaggggggccgggaagtgcaggaagaaggatggggtccctggggggggctccaccctctggcctgtgcccacgggcctaagtgaggacaagccactcctgttttcacgcccaaaggttgcattttccgagaccactctggcctgccaccctcctcactgcccccccacacacactgaccagcctataaaaaccccgagaccctagcagggaggaatacaccagcagaaggacacagtggcagacgctggcaggccatcaacggcaggacgagaatgacgcagacgcgaggagaatttatttggtcagaggagagtctgaccactgcgtggcctgactccagggaagaccaccttcccattccattccccttgtggcctccgcatccaccttgccgagaactacctccactcaataaaaccttgcactcatcctccaagcccacatgggatctgatttttccagtacactaaggcaagaacccaggatacagaaagccctctgtccttgcgataaggcagagggtctaattgagctggttaacacaagctgccaacggacagctaaactgaaagagcacactgtaacacacgcccactggggcttcaggagctgtaaacactcaaccctacatgctgccttggggttggagcccaaaaaacgttccccacaatctgcctgtctgcctgctccccccaggggtttgagcagcggggcatctatgcagcgagccacactcctatcacacagcctgccatggggataaaggaaattctcccgtttcaatagcaggtcttcaggacctgtgctgggactctcctctcattacctgcactccaatgggtccaggtgcctcgaggttctacacacggcctgccttagccatcaggcttcccattcggctgttctccagcttggaatgctgtttctcctctctcccacttccaaaactctttcaaggaccaacctaacacccactccatctgttactctttctgtaactcagccagccctttctgataagtcacttccccaaacttccatagcacttcaagtcagcaatgactgggattagataacagataatactagtattagttaataacattaatacatttcaccgaatgattaccgagtgccatgccccatcaggatgtgctggtaatatttccaggtgaaagaaatgaaggcacagcctctcttggatacttatttaaagctacattcagctaggatgtaagttggccagaatctgaacccagactttctgccttttttatgagcctttaaccacaatttttactgccgctcagtccagtatgacttctaaggtaattgatttttaggtttgagtttagttctgcaataaaactgtggactccccacggatgccatgcatgtcttatatatctgtatcccctacagcacctaacctcagagctagacatgcaataggcattcaatataaacttgatcattcattgattggccagacagctccctgacttgagcacttctctctcttcccattatggaaatgtctgagtaatacagctctcaaggaagactgggggtggggggtgggtgtgaagcgggggtgggagagcatagccagtttgtctttaggagagtctcgtattggactacttcaaaattaaccagtcagatgtctattaagcatgtgctatggcataccacacacatggaggatgagagagaaggaaaaacattcctgttacgaaggtggcaatgctcagattggaagaagctgcaccagtgcggtccagcagggcagcccttgactgagggcttggctgtgtggggcagagtgtggataagggcgttagaggaccccgtagatcgatgtgggtcgtcagcaaggctggagagggctcaggagaaagtgtggctggtggggctttgagggagggccacgtcgccctaggtggagagcaaaggagggctgggagaaggaaattgcccctgattcacagccttccctctttggtgactgtaatggtggggctgggattcatttagccttttctcccactcctgatgactactaagctctgatgcttgctcagtctttcttacaggttggttaggagggtaaagtgtaggagtgtcatatactataagcccggattctatccacatgtaggggccgatcattatttgttattgtctctgatgctgttagtgccctttcttatcctctcagcagcattcaactctactggcagtctgcttggggctgctataaccgaataccatacactgagtggctgacaaacaacagagatttacttctcacacttctggaggctgggaagtccaagaccaaggcactggcagattaggtgtctggggagggcctggtttcctgcttcatagacagctgccttctggctgtatcctcacttgctggaggggcaagagagctccctgaggtttcttttataaaagcactaatcccattcataaagcctccacccttgtgacctaatcatttcccaaagccccaagtcctaatactcctaatctcatcaccttggagactaggtttcaacatatgaattttgaggggacataaacattcagtccattgtatctacatagaaaaagctgtttgtggtgaacatgggtgaccctctgcctgagggctttttttttttttttttttctcctagcaggacatggcagaatccctgggtagttaatgcctcaaatgcagccctcagccaatgacagagggaggtgggggaatgaacacccggcttccttgccccttggtggggatgatgctgagggctattctgtacaggatgagacctggctgccatactcatgacttgctggataaggaaccgttgctgcctaccttcactccctgtcttcctgcccactctcctgcagtgtctccagggatcacctctgacatgagttactggcactggaattgcagggtctatttctgggcgactgaaagtaggacatggtagtctttaataattgaagagatatgcatatttggtgaatagataaattcctctaattgtacaaatgggttcagctcaagtctagtaaaccaggtggacccatttccagtgtctagacccagccctgtcatgttgtccatgttcacagggagctggctgcatccgcctcagggtgctctcatcatagtgttcaacttacacacccctgacctcaccccactcccaactaggattgtaaagtcctggaaaacaggggccttgccacactgagtctttactgtaagaccctcgcacagaataagtgttcgctgaatcactttctaattggatccagttaagcagaagaaaactcccctctgtgcaaaggcaaagctatttccagtgcctttctctggcttccaaagtgatgaaattcagttcccaaggccacagtggttcactagaaccttgtaatgggttcattatttatcctgttgtaccacccctgagtgacctttcaaatggtctcacaaatgtcctttccacaattcatttcaaatgcccctaaacagtcctctaatcttgagtaaagttcattgggcccatgtacagctggcacttcctttgaatcaggggcccatgagcactgtgattaatgaccaggagtgagtgtgggcgagtgtggggcacagggtcgtatgtcctggggcagggctccctgttcacggtctaaagccacatcctgtctgccccaggctcatattctgccagggaccacactgaacaccctcctcaagatgccagggctgcctgtgccatgtactgcaagacagctgggattgtcatggacatcaatatgaaaggcagtgcaggagccaggctggattccaatgctgtggctggctggaggtcccatccagtcaagtggctcgccacttaggtctgaaccaaagagctaaacaggagctggagagctctccctgaagcttccatccctggcctttagagaccgaagtctcctgaaaggcaggtccttgcaagaggtaaaaggctcagtagaatgcagcttcctggcccggctcccatagtggcccctcctggctccaccataccctcaccatgccaggcttggcaggccccaaactggacagacagaagctccctccaacctcgtttccaattccactcatggccgccatctatttgcacagctcatctgggaaggcagcagtgataatgtgagcaggagtccaagaggtcacgaggcatacccagctcctgccattacagaggaggacagctacccagagcacactgcccctccccacttccagtgtagttcctgcactgcccctccccacttccagtgtagatctgggcccctgtacatgtggcaagacctggaagtgggttccctgcacagaaattttctgcctaccttacagaaagactggaccaaaactgttctacatggccacaacaggcttggatctcattgctccagagaagcaggtctgcccatgccctggaagctggctcagtttgggctctggagccaggagcagacatcaagagcatccacggagcctcttttgatgaaaggagcagatgatgcgaaatacagtccaaatggactcttcggaatcagttcatccctcaaacagcggtgtactgccactcaaagcatgccgaggacactgccgtctgctctgacacctgagtttgagttgtgtgtcctttggaaggaagaataagcaaaaataagtgactccccctcaccgctcataaagaacttctaagtctgagtggggagggacatgcaggaccacctttgagagaaaatcaagaaggaggccctcagcacaaatggcaggcatgctgggttgtttaggtcctgtttcatgctacattatgctgtgtgactttgggtaagtcacttaccctctctgaatcttcaaaggcttcatatttgcacaaaactcttccacacttcacagagtttgaaaaaccacaagaaagaaaggaagaaaaacttttatccaagagcaggtatgaggcttctgaataaagctgaaagtagtcattctcctggactctttcaggagagctgagttaccttgtagatctactatgagaaaacctggattattgaggggcaaaggggctttttggtcatttgcagtagcctctcccttgaagaagcaggaatcacccttgtggcatttgtttgagcatcttcatgataatgggcagaaaggagcttgtctttcttgggtcaggagcagggaggtgaggagtgatcagaggagacctgagtctggcactgaaaccagctatactttcatccaacacatttcatcaggtcctgaacactgaagacaccagtgaacaaagaaacccccagtgcctgtcttcatggggcttacatctgtaggacaccctgccatcagagagtggaagaggaggtgtgactggagtgactcaggatatcctcctgtttcaccacagttccctggactttgtacttaatgcagacagtggctatgaggtaggaaatcagcagagcttgttttcccagcagtggtcacaacctgggttgtcaccttgctgattggagcaggatctggtagaaacaaggtgcagtgaacaagctggccaaaaccagcagacagtgatgaaagtgacctctagttgtccttactgctcattaacataaaaagatacttctagtagtgtcatgacactttacaaatgccacatcaatatgccatggcaatgacctgaaaattaccttgtatggttccagaaactccctgccccttttctagaaagatctaagtaaccacctcttaatttgcatgtaaataaagggggtataaacacagttgtcagcagcccatatgctgctattctgggcatgggcacggggcttatggggtagccctgctcagcaaggagcggctcccctgctgctgctgtatgctgccacttcaataaagttgcaaactgatttctttcaccatcatctccccattggattatttcctgggtgaagccaagaaccctcccggactaagccccaatttgggggctcacttcacctgcatcatttacatcaaacagcccctctaagggaccttaggccttgttatctttgaaaaaatgctccagagtgtctatcttttctttctctgtctccctcctatcccaccccatcctgggcttgttttcatctttgtcagtgtgggtactttcctgctctgtgctgccagaatggtgctgaatatgaatgagaaagtaaattagatactgatcagctctccatttccatagtgtgttgaataataccccatgacaactggggtttgaaaggtagcccagctctgggagcaggcctcctgggcatctaagtgacggccactgttcaccagctgtgccgagttactacacagcctggaggtcaagtccttctcccataatcacttggatggaaaattaaagcagcctgctccctcaatggttatacattctggcacagaaattaacaaattcccccagaatccataacagatacatctttgttcagccaaagaactttgatataaattgtagctttttaggacggctctgtcaaaagtgtaatatatcatggaatagtgaatacaagttcaaaagtacatataataatataattaagatagcttgacaagaatgtattttaaaagtataaaatacctgcaggtataatagcttcataaagtctgtcagatttacttctgctgtgaagaaatttaaaatgttttactttaatgtgatgcaaatgaaggctgaggtatgcatataacacagtccttaaaaaataggtagagggaaaagaataaaagtcagattcaggccaaacaagacattcaactttgcgggtgactggataatagatcaagcaaacagattggggagcgatgccgggctgtttgtagaaaacaccaatttcacatttccctcctttgctggctgcaggaaagtatgtgtttttattcaaaattaatgattccctttgtgcatttttctttttgctcacaagagtcaagcataattcttgtttaaagcaaaagcaatttttatataattactagctcatgaaaaattatttttcaatgtattaaaagctgaggagaagagtgggcgagtcataccctgcacacacatgtccggaacacctcaggtccacaaagaagagctgcctccaggtgaacaggagtccaggcatctgtccagcctcatccatacactgagcaacagtatccctcacttggctgactgggtgcttggacaaaaatgctttttcaggcaaagaagcagtaactgcctacctcgtgtacaagaacaccaacgtatggaattacaagattaatgcaatcagcagggccacatattggggcacccagaccaccttccacttctaactctcctgctaaaaacttttttttccaagaattctatctccccagcctggtggtttgcaccgtcaagacaaacccagtaatgtccacatctttgcacctccccttcctgtgcagatctgatgtactaaggtgatgcaaaggcacctatccccaaccgttacttaaatgaaaccttctggcctgatagcatttgccaagccttcattgctttctcattttctccttccccattggcattagatcgaaaggtctctgagttagctagctacctggtctcaggaactctcctaaacttccccagccttggtcatggtttacagtagagtcaaaagtcccttcccttgagacatggcagaaaattctgatatttcagctctccaaccatgcttatgagggtaggtgcttgccaaagcaaaaaagttaaagaatggagtggggagagccttgcaacaagaggcatctcttattcagggtaaaaattagaagcttgaatcatgaaacagtgtagtttaaaaatcagcactgccggtgcctgtgctgctgatgactgcactcggaagaattttcaaagtaaatgtacttttcaccattatctcactcatttgcattctgctccatttggattctgaaactcaactggacgctttattttcagggtaggtctgcatgatggcaaacaaacagtttgggaaggaattagccatatgggcctgggcattattttcttaatgtgggaactgggtcaaccctctacaaaatgtttcctcaaatacttaaactggcacactttccttttgagaggggaggtttttagaattaagcatcccagttggctgtgcgtggaatggtggctgcatagattccagcccccagaggctcatgaaacatcaaaggtgaagcaacgtcagacacagcctggtctggcctcctcattttctgactaagacatacaggcctagagaggtggagacctgggcaagatcatatagccaaggaccgagtccatgtcatgctcccctgtgtctcactgccctaaatcgggagaggtctgtgtctgccccttccttttcctccctatgtctaagaacactcgctgtcctgtagggggctcctcatctccatgtctgggccccaatccattaccccaatcctgtgtgattttagaggtggcaagtgtatatcaatcaatcaatcaatcaaccaaccagtcaaccaatcaaccaatatagtcttcagcacaccctccatatatgaccttgtgtccaaagcgtaggccattggctcattttctccttgtcctttctctgttcttcagaaccagggacaaaatgaaaaaaaacactgaagagaccccccagaaaccactcttctcccctagtgaaaaacgagagacataatgtggggaatgacactgtcaggggtgtcacaagtgaaggataacaatatatgaaacagagcttttaagggtaacccattatttttgtaatttgtttaaacaaaactgagtgactctttaaactctaattcacatcttggaaatgcaatgcagctatctcttgtttctctctctggagtcgtggcaataattttaatgccagcagaaggcattagacattagaggtgagcaaggcagaggagtctggcttttatcagataattaagatgctaccaaagtcaaacctttatcaacattagactaaaaataaactccttccatccagtgggctttctagcaagcattcaaagtgacagtgctctggataaggttttgcttttaaaaattgttcattgtttttcgacttttattggcaatccattctcattatgcccaatgcatttgtcttcataatatgtacttcacaattacaatatcaaagagtttgtatctacataataaaaatgatctatagaatagtacagggaaaacataataacacagtgtgattgttaatgaaatgaatactttgagggaaaacatggcatcccttgagagaacttgttcctatatcatgagatgctagaaacaggcaaaggctgggaggtgaaaccgaaattgaatctcgggttccctggaggtagggagtgcagcatggcactgcttggctttggtgatgggaggggcacaggaggggtattggaggtgacctattgttggaaataatgacttcaaagggcagccgtcttctactagctcttcagaactttctggccccaatactactagctcaacagacaactgaaatgaagctcaggtcttttctctcaagaataagcattggcaagttcttttcatggaccaagatttgctgcggctgacctgcagaggtgctgttcaggaagaaacagatctgctggaggcaacgatctctagactcagtttctcagcctgaaggcacggactacagaaagggaaaatgtggagaagcagatagcaatgtggtaaaaagatgcttggtgcccatctggataatttcatcctacagcacacccagggagaaagaagccacatagctggcaagtggggacacactgtgctatccctgctcactgttgcacctgatacacctatcctagtgcttggcttacagtacatactcataaatatgctttttttttttttttttgagatggagtcttgctctgtcacccaggctggagtgcagcggtgcgaccttggcccactgcaacctccacctccagggttcaagcaattgtcctgcctcagccttccaagtagctgggattacaggcacctgccaccatgcccagctaatttttttgtatttttagtagagatggggtttcaccatgttggccaggctggttttgaactcatgacctgatctgcccgcctcagcctcccgaagtgctaggattacaggcgtgagccaccgtgcctggccataaatatgtttttaatgaatacaaaaagaatgtcttctttatggagccaaaattttcacaattgataacccttacagtagattgcagaaacctataagacagactatcactgaactcataaaaaaagagttatattactgggcacccaggaaaaggaacaacagataaggaagaggtgcaagctgctgaggtctgcataagaataaaggttggttgtggcgcttggccaaagcagggctggggacctcttgcagggcgacgaggagatctgacagatgttccaaatgagaaagaggaggacaagcagacgttcagctctgttaagagaccattgattgaggagcactgttatgcctcttagttgacagccagtggcacgaatccactggtgagaagagttctcttctccagccagccaagagctgcattacatctggaactgggctcagatagcaaaagagcgttctatatatacatgcattttcaaaatattgtggcttctgtacattcaagttaaatgtaagtcaggttgggcagggtttggtcagtaacggggcagaggaagtagatcatttggtctctgaaacccaagcagtctgtagtgaaagtctgcaatcctgcaatggaaagaatctctttcctccactcactcacttccctccccaacttcccatccacacctatatggacacaaggtctacctccaaaaatgaaattcattatatttagagctaaaataattccagaatcaattgacgtagatgaaagcatttttgacttggcttatttgaaaaattatcccgttttatcaattttatttggctagcataactggtgcatgtgcaagtataattttgaacagggagagaacttagttgaattgtaactaaaataattctgggcacaggatggtgtataaaaatacaggcatgacaggaacaatgtaacagagaaagtgacatacagtagtatgtaataacagaagtatcttgaacctatcatccacatgttttttgtgcctgaaaaagcagaatattattataataggtgcaaaaacagttgcagcgtgttaaggctggaactcccccctagagacatagtccaagcttctcacttcaccaatgatgggacctagaatcaaagatatggaggtgactcgtccaaggtcttagaagtgggatgaaaacctggacaccctaggcttctaactcagtgtttttcaattctaccctatggcctttcattcacagagagataggcaggtaggtacgttgatggaagacagataaatacttattctccaggtagtgtcagcttttagacaaaattattctgtcttcagattgaacatcccataagcacatcaaaaactccctgtaggacatttaaactttactgcagagttaaaaactgtggagagttaaaagtcccctgcagctattaaaatagtgtgtagtgagaacagttgtattacaggtgactaatggggtctcaccacctcccacccccattagatatatatactgttgcatttctaagcaagatgtccagtatttttactcctgggggagggagcaattgctgactactatttttttcaaaactgcactaaaactttcttttgtaagaaaaacgagagaaaaaaatcaatagagcatgaaaggacatgaaaagtgcattttaacccatatataatttttttctaacagtgcgattttttaaagctctctacaaaaaataaaagtcaatgtgattctcaaagaaaaaaatgcaacacaaccctgaattcaggagcaaaagaaaaaaaaaacaagaataatgaagatctaaagatttgacctagtaatttgaggcacagatgaaaaatggtgtaagctctggccacctctgggattggcaggtcaaaggggtacattaaatgtgatgggaaacacattctgtttttggatagttcagcatatatccatattaaagcttttaagcctcccaactcagtgaaattactccgagaaaccaagtgtccccttgtggacctggccacacttctattttcgtcctcaaagagaaatggtgtggccaagaatgtgagacatccctaacagggctcaggtgaaaaggaaaggggaaaaaagagtgcaggttaaatgcaatattaaagacgatctctctcctaatcagtgtatctttcttccttacagctaagcaatctttgtcaattacagggcattactctgcaggccaaccggcaattacaatggcatctttcttcccatcactgacagcaaagggaggaaatagtctgagtccagctaaatgtaaagagggaaactggagctcatcacggaggtaatgtacagggaacctataaccaggatgcagatgctatatgcagctgttatgcaaagaagctcttgctctcagagctgatgtgtttatttagactagtgctgaggctgagttaatgccagtttccagaaaggattaatatacactaacgtggaattactgaaccgtcacacacatctggaaatgtatgtttcaactctttcttttttgtggcagccagctgtaccggagaagcagctgatgaggttgcagttgctcctgggccccagctgatttgatgtcatgccgttaagataactataggtccttctgatcaacaccatggtcctttctcccctctgatcctttcaccactcctctttattttggtctcacagtgagtttcttaccttcattttcaagtccaggctataatctcttccatttctcccatttctctcacctccaagccactttccatgtagccatgaggcctctcaaaagaatggagagatagccttgatatttgtggttcagtcatttaacctttgcacatttctgagtgggtcatctgagagaattatcctttggccaagagaccacttagaggaatggtaaaggacatctcaaggagctcaactggtcttatgaccctgaaccttctgtctccagagacaaacaacatcatgcccctcactgagtggttagcctgcttttgtgctcccatttcagaacagaccattcccccaccaccccgccgccatctcagttattcaagaaggaagccatggtatgtactgggaagtcttgtgcctatggaaattccttgagatagaaaagctaaaggcatgaggtattgtgaaagcaatttggctgccctacttctctctttcctttctctgtgcctgtcctttcttggatgaatggattagccaatacagatgtgcgaattatccttaagtatcctggaaaggctttgcctatttgaccttgggtgcggctgtaagtgtttgctcatcagtaattacaaagagcctggaatctagaagtaccttcccaatatcaaccacaaaagcaatttctagttgaagattctgctggggactcttcgacaactgttttctttgacccactcaccccaccttttgcttcttagacatccaactgttcagaaggatcccactgagagaacatcagtcaaatcgtcccttcgtctctggttccaaagtaccctgcaatcatttgtgccttcctccaaaatacctctttcactgccacatcagaagagctctttaaacgctaacaagaaccaatattttagattctactgctaggcatttcagctcaagtcactttattgtaaaattagatgtcattgtgaaaagcatggatataaatataagagcaaaaggcccttttcttaatgcagaaaccaaggtaacaatatcctatttttccttgttgtcaaaagttgtggtttttttttttttttgatagctcagccaatataatgcactgcatgtttacacttagcattaaataactattatgcaaaagtactccacagtaaaatctaagtatatttatggaaagctaaattatattgccaagtttattttagaccaaagaagcccctgggaagggatattgtgtattttaaagagtaaatgtaaactattaaatagaaagaggctttgtggaatgtaacacattctacctaggtaaatcacagagcaattacacagtaaacttttctttgatgaagcactgaagtgatgacatgtaattacttttccaatgctgtaccgtgtgtttatcaaaatgttaatgcaaacataataacaggctgtatgtttgtgctgagaatgtcagagccatccagctgtcaatcacatctgaaaataaaatcgcaaataagcaggcagcttgataacaggagtgacagccaatagtcactctgctgacaagtactttgctcccctccaccaatcacagtgtcactgtaacgtacctaataggaggaatatatcttttaggagctggaatgaaaccaagtggcataaatcggctgaactttgcatgcgactccccctccccctctctgttaatggggcttctttttggggccagcagaccccattccctctccccacgttccttcagatcagtgcccttgttaaaggctgcagagcccacaaacgggctggcattgtgaaaactcaattcagaccaggtctcccagccaactggcctggtttaatcagtcagcgtcaagccctgcggtactttccttggtcatggtcaccaacataggaagtcccagcctagatctgtcgcagccactggctgagctagtttttcttaaagctcttaatgcaattaaaaaaatcattttaatattttttgagacagagtctcactctgtcacccaagctggagtgcagtggtgcaatcttggcttactgcaacctctgccttgtaggttcaagcagttctcaggcctcagcattctgagtagctgtgattacaggtacccaccaccatactcggctaatttttgtatttttagtagagatggggtttcaccatgttggccaggctgatctcgaactcttggcctcaagtgatctgccttcctcagcctccctaagtgctgggattatagatgtgagccactgagcccggccaatgcaactttaaaaaaccgaaacaacaggtgtctgattttaaaggacaagtgccaaaactgctagggaatcagaatgaactaattagtgcttgcagggatacaaggcccatttgagagccttcctggggtgcatgtatgtaggggtgtgcgtatatatgggtgtgtgtgtaggggggatcaagccctaaataggcccctgattggtcaggtcttttcccatgatcatttccttgtactctggaacatctaggaaatgagcagttcagtcctggaaactttgttcaccctgactcctgccctcttgactttctctgagaacacttttcactgaaggatcctttcaaatgtatctaaaaattgccaaccacttgttaaagtgtaagcaggtgcatacatctccttctcctttagattaatgattgcagatattctttccagtatggggcacattttagaattttaccttgctgtgtgcagcagggcagaagaatgggcctacatccattgctgaacctcctctttctatccttattgttacaaaattcacctccttggttaactgaactagcaacacaaatcatccctacctatttgcattttgctgttacaaaatatagagatggtttgtccaccctgtcccatgcaattgtgaccaggagaaacgctctggctcctggtacaaagagatagtctggaggcatcccagtagaacgcagaatgcagggaggaattacgtccctcaatcctctggtctgcagtaatcttatttccattatttttcatgctttctggtgctgccaacaaatgttgcaaaggcaagagccgatctttgacattctcgactgcctaaagtgcagcaaagagctgctttaatcccccttttgtgcctgcaatgactagaagaaaatttttgatcccatgcttggactgactaatggtgcattttgagtggcagccttccacttctgcagaaactgtaaaactcaaccaaacctggaaacatttgaagtttctgggttcaagaaccatgggttcagagaccctcacctccatgaatatgacttgttggacattcaatgactgtgcagtagagacaacaggggtgagtgtttagatagacccagtagctctgcctgctgagcccctctgccagtactctaacttcaatggatgtgcatgattcttccgttgtagcaaatatcattgtagtaaaaagtaatacatctcctcgtttaagtgacagcaggtagggtttgttactttaattcactttgcctttctcttctgaaaattaattgagtcagatactgaatctggagcctaactccttggcagctgagcaggagacaggaggatcatcatctgctatagagagttcttgagaagccaggaatagttaagaggaaattgaggcaacttggaaaggcaaagcaggtcaccagaagtggtaggagagagatcttcaagcagcacagcagttaaagaactttatagcctcttcccaacaaatgctcattgtcgcacttcctgtcacctctctctcctgcatccctctctatctatgttccaggcacacgggactttgcattacttccaaaggtcatggtcaccgtcacaatttccatgaccttactcatgctggcaactctgcttgaaacgtccttaactcatcttctccacctggaaaaaatccaaacctttgatgaagtttgggtaaagtcactttctgcagtggagaatgctccaggaagaatgtattgttcttacgtcagcactcccataaaacctctattttagcatttacttccttacacatagactttttccattcccacttcacactgtgaggatctcctggacaagcattagtctcagaacttatgtttggaactcttacacaggctggattttctaaaagctactaaaaaaatgcttgtttgaaattaaagatccaatgttagaaagtatgttatattaaaaaatggccatcctatattacccagaatcaaaattggaatggagaggtggagacataggttttgaatcgatacaaagaactttctgatcactggagcagttcaacaatggaagcttctcaaagacatgagccccctgttcctgcaggtattaaagtggagggtgactggccacccggggagattgacaagtgattgcaatgatccttatgatgcttttcaatcttaacactctatgaggcattgggcctacatggataagtaaacaaaattgttcaagtctattaattagaaaaagttctctagtaccgtggttctcagtgtgtataagattcacttgcagagcttgttaagaagcctgggtccacccgcagaaattctgttcagtaacatggaggtggtcactgagaatctgcattttaaacaatccctccagatgactctgctggaagcagctctaggattgtcattggagaagcatggttctagagtgtgccaatcgatgggcctccctaagccctctgttatttaacacatctttactcatgttgacataaagtcagcccaacctgcaggtatgtcccaatacatgtgcattaaaaagtttatactctgggctcaaagttcaagcacagagagaattgcaaatctacaaagcgtgaccgccaggatgaggggctatccctgggaaaatagctaggagaggtctgaggaaggctgactgggttcatgacagacacaccacaaggggaggcaaggtctcacctctctaaagtcaaagacaacatagcacgccacggggtaaaatagcaaatgcataagcaagcaaggatcgtgacccaggaaactaattaatcgattcatcaaatgacaggttttgaggcatcttctagagaaatgagataaggagatttgccaagattgtggaagttctcagaagcaatgatgtcatctctcggtggaggctaatgaagtggaaaagcatagcaaccatctttcagtacagagctgcagtggtgagtagatatcagaaatgcaaccaatggttgcttggcaatggaatggcttccaattagacagtcaacacatgacagagtctgcagaattaaacttcatttggagttgaaaacttaatgttgagtgaaaaggcaataggttaagagatttgtgtattgtattttaaacataaagactcttccacaaatccaagttaatagagaaggcccttggattcagattggacagtggtaggaaatagggttatttcaaagaccttgcatatgggagaggaatatgatgcccacagatggccatgggtactatattctttattcttggacaacgacttacttttccattttttacatttcagctttgagaaagatcccagatgcagggctgtgtgaagtcaagatgtttcaagtgtaactggatcccaaaatgggaacacagtgggaagcataaaatatcccagtatggtgccatcttctacagtgtccatgttggcttcatgaacaccccagagaaagaaagacagcaacatgaaaacatagagtatgttctcaaaatggacacttggagaaattttcaggcgtatgtttatcaaatgcatttggtttcttaggaaagacaggtttagtacagataatcctggaatcccagcatccctaagatctatttaattttcgtttgcattgtttgtgaatacaatgatcatatcaatcatcattgtcaacctcatcatcgttatcatcatcaaagttattctctgagaaataactgagaaaaagccagaaatgctgaatctgccttatttttttctagcaggtaattctttcatggttactgggcatcccttcttttctgaataagagagtatcacttagctgaaggacagagcagagggcagcaggctggctcccgagctaccttaggttgtatgcctcaggcatgccccactgtgctgtctaattctagggtactttgggctttgaaagaggtttcacttttctatttggcaacaaatgtttcatctaaaaaagtgtgaggctcacagataagcatgattttaccactgtctacattaactgattatgggatattgaacctaatcagtaaagataagaaatatgactaagaaacagttttctttcttcccacatttaatgcgttcctcactttaattttgcattctcatctgctcttctctagctcaatgtcttgactcttttccactcttttctctttgctgtgctttgatactccctgcccacatgacattcctgttagtcctagtgaagaggctaagtggttttgacccacgaatacttacagatggtgctgcaaacccagctctgaggatgcaaagggtgcagaaatgtctcaatgttgggagatagccctgaagtgtacaaatcctaagtatagctccctgcatgatgataatggactcactaatatctattttcagcagccccacactgcctcttcggaatctctcctgagggctaagtgcatggatatttcattgactggcttcatttgtactgcctcagccccactgtatctcctaccagcgctaataaaaaaatatggctcattagacaagaagtgggctcactacttcttgtctgggttaactttgttcaccaaagataaacttcatttttaaactgaaggtcttctgcctgaaaacacagccatgttttgtgctacattccaaaacaggtgttggataattcagtaattagtatgcacatctaacttcatgcagcctctgttgatctctcaattatagttagctgggtcctctgaagttttctgtagttaattagagcattattgaacagttgggatggagagccaagctctgcaatcagttgacagcttggtcccatgaactaagcattgggctggtccttgactggggaatgacagtcttcagggtgacccagtgccagaatgggttagattgtcttttgaataacagctggagggaggcctcttttatgagctgagaataatggtcacattccttattctgccccactcttgacaggaaaattcacattccaatggtgatcagtttcagaaatgtctcctcaggggaaaaaggaaactttcaacattcaagaaaaaaggataattgttctgagcaggctccagaaagtcaaaacctaaggtgaacacgtgagttagtgctcagtctccctatctcatatggtttcaccttgactcccctcccagaagaattcaggaaaagcacagggggacagcaggaaggtgcatgaagggacccacatgagatgcactgcacaccaaattctagaaggcaatttggaaatgattgcttctgaataattgaggtatcatgtcatctgcaacatccgagtctgactgtccaaagctcctgataattgcccaggttccattttgaatgcagcccgtgagtattagagcaagcatgcattcatcactttaagaccaaaagacaagcatgtcttgtcagtggaacggaggggagatgctttggggactggaggctaagaagcaagaagcattactgattatggtcatggtcagcgtgctttccaaggagaattctccccgctgcccaaatttagcttctgtgctgttctttttccaaatttatgaagtcagaagggtcactgctctctcctcagcaagttgtgaggcatgttgttctgtaacccacccctcactgcagggatctgggctggcttactgagtaggttttcatttcccagcctctcctctctcccacccccaccaaccaagggtccccaatgtggccaagaatgtaaagacagcagaatgacacacatggctgaaataatgtttagatttaactaaatgttggaaatagaattggtacagtgaaaagaaggctgcctttggcaggatctcatctctactcaaccgctgagtaaccaatgtaagtattacttttctccatcatattagaaaaatgaagataggcgtaaccttcagaatcagttaaacataggtgaggtcacctgtctccctggggatggaatgagacagcacagcacaggagagagggggtgggaacaggggtcagaaggtagaagcttgattcctatctctcctctttgctcagtgagtggtcttgggcaaatcttgtattaatgtggacatcaattcctttaaccataaacaggaatcaataggacctatgctatacacccacagtatcaaggggaggactgaaagtaaaaactactgtgtgagagtactttggaatctgcaaagagtgatataaacaaacatacagcacatactggagtgaggcaggtgtgtgatcaagtgggctgaattgattgccaggaagcttgggagaaaattctgagagtttgggacactagacagcagccacaaaggctgacatcagacaatttacaattcagagctctctggggcctagaggagtctttgaagtgagggagctcagttcagctcttctacctcaatcccactctgctgtgctgtgaatttaaagggcccgtgccagattctcaccagggcccgtgccagattcttaccaggctgcctacaaatcagggaagagcataggagggcgcaacaaaagttctaggacttctgtcttgatcaccaccccacactgctctttccttcattaatcattatttataaaggctagaccagaggccctgaatcaggcactagactttgccaagtcccacttatcttagaatgtgttgctaagaccctcacgaggccctcccattccaagatgtatcatttcaggattccatggttcccaatcagaagttcattaaaaagatagtaattagaccaggtgacgccgctcgaggtttactaagtgtccttcagctcaattcaataaacattgcagactgaccgtgggcaagacaacagaccaggccctagagcagtagcactgacccatttcattgtcgacagtgattaaaggagatgaaacccatttgtgagtttatgaatgtatacacacctggattgctggtgctgttgttttctcatgttgatgttcctaacactcctatggggtgggcagggaaggccttatcattcccattttacagagtaatccacagtccacggagattaagatcccatacttagataaatggtggagccaagacttacccaaggggtgtgcctgtgttgtaacagatttactgaagtatgattgcacacaataaataacgtcgttaaagtagtatacaaggtgaggggttctgccgtgtgtacactcatgaaaccatcaccacgatcaggactgcaaacacgtccatcacccccaccaaagttttctcttccccttagtgacccctccctttttccctccccctctttattctccccctgcccctcaagtacccagggatctgctttttgtcttgaaagactagtttgcctttttaaaaaatacttcatataaataaaatcacataatatgaaccttttggctggcttctttcacttggcataattacattgacattcgtcatcattactgcgtgatcagtagtccattcctttctactgctgaggaatatcccattgtgtggaggcaccatgatttgttttggtttgatgtccaatgattttttaaaaattgttcttcttggaaaaaaaaaggagaagaaaaaaagtcaattccctcttctcctcccagaactctaaatgattaccactcaagtcttgtttctcaaatatttcctggttaaatggacaaatatattacaggccacatcagggcttctatgcacagcttcgggaagaatcagtttcagtacgttttattggaacctgcacattgagacgacagcttctttgcttgtagacaaggagaactcacaaaggcataaacaatagagaactttggaaaaattatgagagcaatttaagagtggataattagatatcttttgcagggtgttagggaaattaaattagctttttttaaaaatcaaggtttgtgggaatcacttcataaaaaatatctccgtgactgattatttttctaacattcttcgcctttcttccttgcatatccaaggaagtggcacttttagcccttagctgtggcagccaatcatagcctctaattgcattcactgcataaattgtcagtgtcatgaataataaaattagtttaaataaacccccagccacaatcacaaataactatctggtggaggatcttgtgtcctttcattctagggggatgggtcagtgcaatctctgtagttaaattcttgagttaaaatgaagataaaattattggggaggtggggatagagctgaggggtgaaagtgggaggagaatggtttctggctcccggcaggttcatgaaagagaaagggtcttcttcctgagcagccttccgagagtgcctcatacctaagacagtcagccctgaccagcaacaatagccgagaaagggcttgtactggccatgccagagtctagagggaagagcttggggctcagagactgagcagtcctgcgtgctcctgtggtggcctaatgtgacctattatccagcaactcccatctatttctgaaaactccacgtgctggtctggcactctaattgtccaatctgctgctcaattttcaacaggatctcatcaagcactttgccatttaatggtgaccaaatccctccagttttctgctccctggctgtggacagaaggcacctggaggggtgctgtgggagtcccgtggctgcacatcctggcaaaaggagttcatttcgatggccaagcagcttctatcagcttttctctttctttacaggccctgcccaaatactctgccttctgtagactctactgaagccactagggtgagtgagagagtagacgactgcaaacatgagcgtcccccagtcccagcaccacagcggcctgcctgtgcccagcgctgccccagcatcctcccaaccactgtcctcagcattgtttcaataggagtcacatgattttccaaaacacaatcccttctttcaacctgagcctcagctccctgatatgttaattcccaggctgattccagtgctgttggtcccccgcttggttcattacatttctgagcccactctgctgcctttatttaatgaggtttattgtttgtgcttagtaattttcaaaggcccatcaccctctttgagtttgcccttagatcttcagcctgccaaagaggtgggcttttgaagctacctttattaattcagtacctagcttctgcatttaatggcacatgggtttgaagtgtacataagccacagtggaaacatctgagaagcgtcccaagatactgcaaattataaagggtgattaggaaatagcatggctctctatcttctcatgccttagaactttattccttatatcaaaaagatcctgggatatcaaaatatcactgtctgactctgataatgacttcccagagtttcagacattggtggaaaaaagatataattttaattatcagcagctccacttaaaaaaatcttcagctattgtaaagggcaaggagctggaaggaaaggcagaagaggaggcaagaggtgagcccatgtcctactaaatgcctgcaaagtggctgtctttgagagcgctccacagtccctgccatggatggattccttggaaagagatgcacagggtgctccgactgttagtctgtcctgctatcactatcactgtcagggagcaaacggcagaagccagtctcagggaagccagtggcctgacagttaaggcaaatgcacagacttcagaaatcacaccaaagcagcttggcttctaagatgcagccctgaccggctgactcaaaggaagttggctggcaggttctgcgatccctggagatgggcagggctggggtcagactccggtgacagcagcagtggacacaatccaggacttcccagtgaggtctgtcttttctttgaaagggacagaggagtgtggtccttgggacatctagcccagggaaagaaatcttgcccaagaatacatatgaatatctgcaaaaacaaagttggggtttgatatctttcaggaagcctaggaattctaggccactgccagcattgggaatggttggctcccttccccttccttccatgcccagctggagacagaatgctggactctgggtgcctgaattctgatcctggctctatcagtgtctctgtgcaccagagagaggccacttagcctcccttggcctcaatggcttcttggtgatcttccaataatttttagcagtagaagctttcctttcctaattgaaattttacagggaacaatatttaaaatagctaagaggggctgccatgcctgagggtggtccctgcctgctctgttttcttcatccccttcgtaccctcctgctcagcagaagctgagggactccaggggaccccagccctcctcaggacccaccgtggaagcagaactcccaactgtctttctcactgcttgtggtttgtaagttttatgactcgattttaatctgtaccatttaggatatgctcaggaggggccctgggagaggcacaagtggcagcttttttttcttgaaaaatcagctattatttatccttaaggaagaaaaaaagcaaccctgagaaaatgattttcttttcacagccttattacaaatgctgagcacagctagaagtaaggcctggctctgtgcacgtgtgtgtgcatgtgcacgtgtgtatgtattatgtgtgtgtgtttccggtgggcaggtgtggctggaggcatgaccccttttctctggttgatttcatctccagtagccaagtagaaactacagcatgacctgacttctatgcccccagcactatggccatgacagcctccagataggagaagggtctggcttcattgacatttccacggtagtgcatacagccctcgagacctactcaagagaggacaaaagagaggctcgggtagagcttatctagtggatgaacctgctcctagacacagagcactgcctggcatccctgctgcagaatcgggctaggatagggctgagtattctaattgcctgtgggataggatttcactatatccctgcacagctgttttcatgctgtggttggattttgacgctgtcgtaatttcccccgttgtttgatattctcgcatttacattaaagaagtacaggagaagaacagtgttcttgggagaagatttcagcatttaggattcatacaaataaatgcatggactgcccacgcttccctcacatccgtcaaacaactcagttaaaaacaccttttcaaaaggctcttctataattttacttcttttaaaaatagtgatggggttatgtctgatgccccggaacgtccgtcatgcattgattttatccagttcagtgccaggcagcaattagcaaaggtaacactaattaggttttacaatgtaatatgtgtccttctaaacttaagtcatagcattttaagcttctaatgattgcaaggtcattttgctattcttcataatagcagggatgctaatgagtgcatttggtatgcgtggggatgcccctgtttcctcctggggcttatcagcatttactggggacactttacttaatttgttgccgagctcatgacctaaacggaaacattgaaccggccacctgaaggtctagaagttttagactgtggaatcagcgctgtggaaggcccggctacccgggttaccgtgagctgatcatttgttttcctctggacttagaagctccgcatccaccctgtccaatctccttagctggccaatctccctctcccacgtctgaatgcacttaaatttgctccttcctgctaagaaaaatgttatcctattaaacgatgcgtgttataaataccttaacattcatagtttcatgttttaatcttgctgctagcatattctgggcatgcttactggaatcagttttctatttcttagattgtaagttctcaggaggcagattaaaaactcataagatggtctctgtaaaatgtctttcccagagccgcgtgtgacttggtatttcatgtgggttttagatgtggctgtagataatgagatggcgggtatgacagtgttgagattcaagcagcttcagcaggctctcccccagtgcagctggaaaacatgacaaaatacatttccactgttgacacgtccacctcgtcctgttggggtggccccccagggtggtgtgggtttgagagacattgttggggctcagacttcctgccttcctcttaaggaaaaataaggaagtgatgaattgaggggaatacacgcaaagtagagaaagctagggttgtcttaatttcatttatttgctgggtaagtttctactcacttgaagctatagtccaggcattgtgttaggtgtaggggtgtcgtggtgagcaagacaggtatcatccctgcctccagagcttacagcccaggctggggagtccacagtaggcagcaaatgctttgagtgattcttatttcaaatcgtgttaagtgctgggcatggtgcctcatgcttatgaccctaacagtttgggaggccaaggtgggcagatcccttgagcccaggagttcgagaccagcctgggcaacataatgagacctcatctcaaaaaaaaaaaaaaaaaaaaaaaaaaaaggaaaagaaagaaagaaagaaagaaagaaagaagctaggtatggtgtcacatacacctgtagtctcagctactcaggaggctgaggtgaaatccctggagcccaaggggtcaaggcttcagtgagccatgattatgccactgaactccagcctgggcaacagagagagaccctgtctcaaaatcaatcaattgatcaatcgtgttaagtataataaagaggctccagatgctatgaaggaatagtgggcctgatctattcagtggggatcaggagattcctaaaggaagtgatacttctgctgagctctgagggatgaccagaaatgactagacacacagtggagggaaagccattctaggcagagagaggcatgtaggagggtcctgagataagatcattcacagtgtattccatcctctctggggattttcaaggggagcactctgcaagagtcacaggattagcctaggaaagaccgggctttaaaacaaggagctcccaggcacagagattcttggttctcaaatgttgcagcctgtgacgattcctagtgcttcaggatggctgcttccccacacggagcttccttcttgtgaaagcaagaagaaggccgggtgcagtggctcacacctgtaaccccagcactttgggaggctgagatgggaggatcacttgaggtcaggagttcaagaccagcctgggcaacatggtgaaaccccgtctctactaaaaatacaaaaattagccaggcatggtggagggcaccagtaatcccaggtacttgggaggctgaggcaggagaattgcttgaacccgggaggcggagattccaccactgtacactgcagcctcagcaacagagtgagacactgtctcttaaaaaaaaaaaaaaaaaaaggaaaaaagaaagaaggaaagggagaaggaaagcagagagggcatgagggaagagatgaaaggaagaaaggaacttccaaagcaatgctctgggacaagcctttgggattctcctgccatccttttaagggaactgaaggccagaacctgagagggagacattagttctaggtcttagacccagcaagggtaaccagacagggttactactgttctggttactgaaggctcccgtgcatggagtgttgcattccccagcctctggagctggtgggggttggagcttcacagggtcacctccctaacttcccctttactgctgtcctgagcctggttcagaactcattctgtcaggaaccccagtgaccacatgacccagctgcccccagtaggtggctgcctcagaccctaggcaataaacactccttgcagcactcacttaatgtgacataaagagaagaaactgcagcggtgttgtcactagagcgaatggcaaattctcatagctagataatgcagaaataaagtgcatttgtaatagacaacaaaaggattatcccccattcatttcaaagcaccttcatcccactcagggattacatttctcttacttatcttgcaagtagttttttctattcttgtttatccctgaagagcacatgtatagcttatagcaaataaaaagctggacctgttaaaggcaaggccttcattagtcagagagaagtcattctccaggactctgtgagttctctaatccactgctaggcagtaggatacctaagaaactaaccctataccatccaagacagaactctgctagtctgcaaggatgaacatggtccatgagaaatagcagcatctcccagaaaacctgagcaggtcaggggcttctctgactcctctccacatttgaccttggtctctgagatgctctttgtggctctcctgtatgcctgttgagatgcccatgccctttccagagctacagacaggcatgctgtcatcagacttccaatctttactctgaatgagaaaaacatcaaaatctgagaagcaggagagctaagggtatcctagtgaatggaatgatgatgcaaatatcctagaaagctgtgtagagaacgtggggcctgtccatgggcttcagtgcccaccatgcagtgcatgggagaccgagggaatggctgggactttaattcttttgagggccgttgctcttctcagacacccaggggaggggttccatggccacagcaagctctctggcagcctctgacctgtggagattcattctcaccacgtgttccaactctagaactatgtaactgctcagatcttacccaagcgcgtgttctcctctttcatagcttccattcttacccccattcacatatcatcatgtgcttcacacgcagtggggatcttaacaggcattgccatttcttttgcttgatatttctggctcctttcttttgttactctaagactttgcagaatcaaaagattctaagaagaggccagggaaagagcagaccatccaagtaccaaaaatccctagtaggcagccttctcctctctcttccctgctcttcctcttatccaagttattaaaatacgaaagatcatctcacgaatacgggctacaaacaactccacaactaaagcaaacccttctggtcaccctgggtcagaggagcacaggtggtcccatggggaagggcagcaatttggccccaggacaccaggttggtggcagaacctgctgagtgttttcccaggctggcggggaatctcatgaggaggagatcagtcctggaatgtccaggactgaggggacagtcatgagggggagatgacacagtttaggacaggcttccctttaaggtatttaactttatagaaaatggaaagccttccccaagcgttctcttattttggggaaaaaaaatgaatgtgcaattcaactgtaccccagaacagtccatcatgaacttggacctttgtcactcacctgtcaaccccatctaacaccacccccaaaaggagtagaacaggaaaccagctcccacagagggttaaaggcacagcatcctcctgtttgtatatagcagaccattagggtatttttatttctcttctctccatgttgcacaataccacatcaaaaatacatttgcagcaaagcttattttctgaagatagataatttggttaaatcttttccactttgatttcatctccagtttcggacgagcagcagtacaacatgcagcagcaaaagcccattttattctcatgaaaaagaatttaatgaccctctgatataaaattgatcctctgataagatggcacttgtgggttactttgacagaaatgttaaactaagtaagtctgcacatatccactgatgtatggcacctcgagttgctgctgggactgcagaggacacatcattctgcctctgcttgggaagggggagtgggtgggagcttggactgtccacactggtctagcactattgtgtcactgaattcctacagaatcttagcagtcattgtgtggcctggagctcacatgggttgggaagtttggacaactgtcttgtagaatcaaacattttatttcaggcattcccaggtggtgtttgccctggttccagtctctgatgccacagtcgcctatctcgtggacaggtggaagtaaagagttaggatcaaagctgttagtaacaaggacaatgaaacactactttatgccaattaggttagcaagaattagaaaactgaaggataccaaggactggggaacaggtggggaaactggaactgctctgaaccagtgttgagaatataaactggtcggatattttagaatattcctggcagtacttaatgaaattgtgcatgcatatatcctaaggcacataagtaagtattgtgtggtggtatgaatgctggattctcacacagtgggaaattagaagaaacctggagatgcaacaaaacagaatggataatgaaattttgtgaatgcagcaattagaaacaatgaagtgggcagatacctaacaatacgaacaattcctaaaagcagcgttagttgaaagcagaaacagaattatatctgtagcacaatgtcctttaggtaaattaaaatcatgcatataggtaacaccctgtactttacatatattttggaagacctttatcaaacatagaatagttacctgggggtaaaggaagggaaatggaagtgaggaccagagacgaagatggaaaatataaaaaaagagagttcttagatgggttatgatgtgtcataagctgagaaatatgactaactcaagtctttgcagcttatattcaatttaaaaaatagcacataacttagaacatggaataaatgccaacttaagtggtgattttgatggctacaatccaggccccctttcccaactgtcctccaaacctcctttatcctcttgaacaatcagagggggatgctgtaagatgagacttaaaagccgcaggggagtttggggggggtctctcgcattcctgaggtccctttgactataggtaataaaggttaacagaaggtggaaggctggttagagagtcaattacaaactaactgactcacaaggatgggaaaaaacccaggagatgcactacgatcttgtaaaagggagatttcctatatatatatatatgtttctcatttggggagtgcattgactttttgacttgggtataatgatcacctggagaggctgatcaaaacaggagcctgcctgaatgctttatagcctttcactccttgtagacatgaagatagctaagaaaaagtaaatggaggtcatcaaagtcatttgcacttgtaaaatgtgacccagcaactattaaacacaaaatctctgataatagccgtaaaagaaaagaagtgtcacctatcctaactgacaaaggaaaggaaggagggaggtgaaagtcagatgcagaacaccgattaacttcctcttctgagaattaaaatggtgaccacttttctccttccatctaaccaatttgaaacaaagacaaggaaggcaaagcttcctcaaatctggatcaccactcaacctttgaaaggctattccattgtcaccaattggcatatctgatcgggcaaatcaaggactgaggtttggaaacagatatagcaaaaggtgctatcaagtgaaagggctgagcaggaaggttgattaagtccaggctgagtaggaaggttggttagctagggctagtgaagcagctgcccctgaagttctgtaacaactgggtacaccatgtagtttacaagtaatcctcaaacctggtcaaaaatgttgtcattgaggcctagtggttgagtttttagaacagaaaaaagtagcaagtggagactctggaagagctcctagacacagaacatcttcttagagctttcctagtgctcaaatcttctacaaagccaaaaccgctctttagttaagcaaatttgggatgaggggaagtaacaaatagtcatattaattgcatggcagtggttgttttgtaaaaggaatagctagctggtgggtcacttcctctgctctccaaatcaattgttttgcacaatggagacacactccttgggtcaggaaactaaatgtgagtgtatctgttcccatgtgtgtaaatatacagctctcatgtgcctaatttatagcaagtcacctactactagaacatcggcccttcagttttggatcacttgaattattcaaaccaaagacgccttcaccaccaatgatcagaggaaaagtgattcagatggggtttagaactactcagagtcttccttgagtgcaagcagttccggcttgtgagaaattcagagaagtctagaaatagaaataacaaacacaaaaaagaaagcctgcatgtttattgataacaacctgataggaatgcatattccttctccaattccctttccttctgcaaagagttaaacaaaaaagtaattaaacaataatttctttgtgagtgctggacttctgaggcctgttttctctgttggaaaaaaaatagatttaagataatggccctattctcctcagaataaattaagctcagagataaagaattccattactaatgcctttcagcaaagcccaggcatcttttaaagtcaaactttaaagtataatatgccgtgatcttgttaaaatctttcctgtaatgatatttaagtgatgggcaagggtatcaatggttcaggcaaagtattgattgtatatcttcagggctgttgagctctttcagagtattctgtttgagggaatgcattgtacttatttaaagacattttcaaaacagttgcaagttaactcaagtaactgattttttgtatgtaaaactgtaggaaaaaagggaaagttggaaggggaggatagaaagataggaacctgaaggatactcaagttataaatcaatgacaaagaccaacagtaagtggatcacgaggtcaggagttcgagaccagcctgacaaacatggtgaaacttcacctctactaaaaatacaaaaattaactgtgcatggtggcgcacacctgtaaccccagctactcaggagggtgagacaggagaatcgcttgaacctgggaggcagaggttgcagtgagctgagatcgcaccattgcatttcagcctgggtaacagagcgagattccgtctcaaaaaaaaaaaaaaaaaaagactctgggatattcctataaccagcacagcacatagaacctgcttcaagttaacgattcttttaggtgcttagctctcaccattttcttttctgttgaagtattgacaaatgactcatcttcacccttgtggtaagaagtagtcccttcttccttggggagcagggggtttcttggagaggagatagttagttgctagtctggaaaatctgcagagtctcagcaaatccagctccattctctccggaagagaatgtgaagagtcagagggagcacaggaacaattcagtgagcaacgatggaggatactgtctgcagaaagcatgggtgatggcttgggactatggtggtcctgctggcaacctcttggtggtgctgaaagcacctgaaccattatcctatttaagtcacaacttggatgtctaaagccatcatatatgatgtccacatacagatgatgaccccttgaacatgggtttgcaattcccattcatctcccctacatgactgtatgtgttttaagggcagagtttgaaaatcatcccttcctcacttgataacctgaataatattcatggctctggagagcaaaatccttcaaaaactggttttcctccttgaaacaaagaaacaaccagtgagttttcctggaactaatgccatcctagagttcgcagctaaagtgacaccagttgtttgccaggtggcttcgggcacaccccaactgcagcatggaatgtctcaagggtcatagggctgggccctgcctctccactcttctcttatgcaggagaatgactaacaccccctaggtgttagttggattctgcactcggattctgcaaagactatcctggctcctgggcatcaactttcagttggaaggagctatggaggcttgttccagtggtctcatcatcctggaacatgcacagggctttggggctacttggcctgatagctcgtccaccaaaaggtgctgtcattgatgctggcaaggaaatacccactgtgggaagggctgtagatatcctacaaaagaaatccagttcctggtgaggtggcacacactttcgtgtctttgttatagaggaagaggatcccattgcttaacatttctggcttacatttattccaattctttggattgaattaatctatttgaaatatgtgcatgcacacacctatatgcacatatttatgggatatatagttgctcgtgactttaaaatgtatatttcttatgaaactaggttaaagttttatagaacagaatgtgaaagaatgctctcataagtatatccccctaatgcagtgaatttgtttaacaaacatttgtttggttcttgctatgtgtcaggcaaggcgccaatccctgtggatacagagaagtgtgcgtcaaagtccctctcctccagagtccacaatctattgaggcagatgaatgagaaaacctacaaagtatgttaggaagcagacaggatgctgggcaaacactgggacacagctcctttccaatattctggatggaaaaacctagttcttacagggctatagtcatggaagagatgcaattttgtattctgttttcctcctacttgtgttttaatcacatttccttctgaggctacatggttgcaccctcatctctcagaaagacttttctttaaataaacagagatccagatagcaaaatgctaccatccaatgtctttgcctatatttatttcattacttcatctgaataatactttttttaaaaaaaaggaagcccagcgtcctatgaccttgtgaaagaagcaaaaaatagcatcatttactcagcagcatattgtacctttgcctattgttttcttacttgtctaattatttaaaaaagaatagctgtggtaaagcactctctcaggcacaaatatgcttctgatttaagaaattattatagaaaaatgctggaagccttgtagtcatctttgctatatttagagggaaaataacgtccctctgcaattaccatttggtatgaagtttaggcactcacatttttcttttcttttttttttaaactaattttttcctctttttctctgggttaacaatgcagggatcatagttgcacaattattaaaaagaggccacttaaattcaactctccatggatacagtgtctgtggcaatgtttaattagagattaaaattgaggaattgaataattgaggttgctaatgaatttgaaaactcagcaaagcaaggagagctgagcgtttttccgacttagcttttctttctctaacccttttctcatttcctactattatcacatttctggccttgactgctgagtttattactacccataaccctggcctaagtggaaacaaaaaagctgtagcctctttgctgagctcctggagacatttggtctattggatttatgacatgttcagaagcttgcagttgcaggaggctgacaatgatgaaaatgagatatgttgggccaccaacgctttctgtaatcaccttaataggtcaacataacaatggatgttgctggtggaaaaaataagaagacggtcctaaatcaaaggcaatttaatatattagaagttctattgctaccccctctagggagactggattatttgggtaccttgcttggtaggcttgcattagcttcaggtgcccaacaatgaaagtaatcccttggttcaccctggaacagaaccagttctttacaaggtgaccctataatagctatccccttggtagatagcacatctcaactctggcctggaggtaattctcaagcagggatttctgcactgggaggaggccagattacaagaccctgaaggtcctttccaactctaaattgctatgattttatgaagatggcatagaaaaaactgcctcactctaagagaaccataccctttgaagcctctttttaacacacaggtaaagttttcaggactatttttatcatttggacaccgaacttcagatgagatattccaagtttcatttagcacaacatatagatggtttaaatctacattcaaggtaaatgtctgtattttatggcccgaagcccccaaactcatgattatttgctattttgccattgctagttaaattgggtcttgatgtttactgcatctctgactgcaataagactgatcactagtggggatagtgcaactgataaaaggaacctgctccaaagcaatgttaacatagcagatatttggtcagaaaatcttttatgaattagaagtcattcctaataacatttccttaaaacttcttagccacacttcttagctcagctgctgatggcttcctactaatgactttaaatacatgtttttgacatcaggaaaagaaataatctgtcttacaaggctgttcttacttataccaagaacaatctgtctcctgctacagtttagcacagctatagcttgggggtagggggtcaaaggaggaagtatgcataatgtacatatttaatcttgtctcgtctatttttatcctatgttcactcaatatttgtagcattctctttgcgtctgtaagcatcaatgctattcctcagagacattaagatcccagagaagagaaactgtaaaaatgttctttgatggtatctaggacaactccaagtatagctaagtatataataaataactgactatccatgatggggatgatgatgatgatgatgatgatgatacagaaatagtgtgtaaaaaaattcatcttcagatgggtatttgtggcaatgcttcagaggggagagacatttcaagagactgggtcattccctggtttggcaaaaagggcgacatgatggttggtgtctatgaagacagctgtgtgtcatcaacagaaggttctcataccacacagctcagcttgcagaggaggaacggggcttgattccatggcttccctacttgaaggcagggcttggcttacttccaataagtcaccttccatggcaaggggagggtgggtgatattttttagtgaaggagatgcttccggggggagctgcaagctgaggggctgcaccaggaatacaggattcctgggagttgatgggaaacttctaaccttcaactgccttcttttctcatttacacaacgctatcctggggtaaagagccctaaataattgcaatgcatcaacttggcagagggctacacattaggtaggtccttccataatgtctttctcattaagagtctaagcccataaggcaatttgtggcatttactgttcatcgctcaggggtcagagggtggggagagggatctttcattttgggccttatcgaacctgtcccgcttgtgacccacaagagcattgcaagcctcatcctgcacagtggcttggtgtgtgattcggtgtgctaaatggcatgtctccattctccaatctgtctggccatgaacccttaacagaacaccagagacctatgtgagatggaattgttgtgtaccgccacagcctgacaacacagagccctatctgccgctgccagttcgggcggatgcctaacgagcacactggggagagcctccagtggggacatgactccccaaagcacttcaggggttcctttgtccgcacccagccatgcaaaattcctggtgcagcacagctaagtgaggatgcacggaggagatgaaacaggctgacaggcagagccattctgtttggggtttgtctacaaaattgtcagttcaggtctccaggtcaaaaatcattttatctgctgaagcagatgctttgtagaacaaaatgccaggccgacttcaaggccgggaggtgtgcagagccccaggctccaatcacactgcagcaggagcacactccagcccatcctgcccctctctgaattccctcactcagagataggctctcttttctctctgtacactccagctccctggaagactttctgacagctccctttctgcgggctgactgctcaagaagcaagatgttcaaagacatggctcccagtctcggaaatccaaacctcacgccttgtgtgactgatgagccacttttcgttgtttgctttcttaaaaataagcattaaaaggtagggaggtattgggagaactggaatgatcagtcttatcaaaagagggaaactgaggcttaaggaacggaagtattagcagcaaggttactcccaaagagacatgttacagcccctaccagatggcaagaaccttgaaccttatttgattgctgcctctgcccagtaactttaatctccctccagcagagaagtggatagggacccccctgccatgaaaaacagcgttgttttttgtttttgtttttgcttcagatctcctttcctttcactgttttttttagcatgtatgggaacattatattcaccaaaaatcaggactagcattaaacccagaagatgtgaactgcacgcattataaggcaaattagatcctgaaagtctgcactgcactcggatccccagcacctcctctgtagcccacagtgcaaggctgcctgtggcttcttcctgggacgtctgctctgcctcctgaaaggatggctttgcctttctgaggtccatgaagggaagtcagagtggcttggctgagccctacattttctttttctgtgtaattccatttgataaagaaaaagcatttagaaaggttcattgtttagatattgaaagacaggagggaagcagacctaggaaggaatccttagtttccttttgttgtacaaggacactgctctcatgcatgtcaacccattcctcatggggcccaccacaccataaatgaatcaggcaataaaggatcccagtggtaccattgtcagaatatctaaattttgaattaaagacttggttaagatatgaaactacctaccttccatttggaaatgtcccttgaactctttccctagacccccactgattggataaggtgagtgaacccgagctccaggtgcctcccaagtccactgtgaagatgccctgaacacgatgtggaacctaggcgagggaggggtctgcattttatcagatcatgatctgtgtcaaatatagttatgagtattttcatcaaagaatatcatagtttccccagcactttgtgaaggctgcgatagagaggaaattgaaaggcagggtcatttccaatggcacacaacacagtgacctcagacaacacagtgagctataagaaaaagatggcttgcagacgccaggccaggcaaagagactttttgctggagggacaggttgagaagcataagagaacttcggcaaccacattctttttaaagtattggagctcttctaccatttgctcaaaaagcgttctgagtaccaactatggcaaggtttggagctaaagtctagagctataaagatcaatgcatcttttcccctagtctaatgggatagacaggccttgaggacaggaaatgagactgaagtgacgagatggacacgaagtcagcaggatcgggcccctgctgccctgcaacctcatctcctcccattctcccctctggctcattttgccccaaccacactgaacttttgagttcccccatcaagtccaggccctttcctcctgagggtcttggcatctgctcaccctctgcctggaatgctcttcccctgggatctgcgtggcttgctcctcactttcttcagatctttactcatacatcaccttttcaacaaaggctttcttgaccacctgtgatgtcacaccgccacccaaaagacaccccccaaattcttccctgctttcttttcctccatagcccttatcagtacctaacatataaatctgttatgtatgttgtttatgatcctgccccctcccgtcagaatgcaagtcctatgaaggcaaatatctgttttgtttactgccgtattttcagtgcctaggcacataatagacccttgataaatatttattaaataaataaatctaggtggatattccaatcggttgctttgacattcatggatgccaagactaagagatttttatgatcattttgtccagccaagactaagagatctttatgatcatttcgtccaaccaaagcaaggactccgaagcaggactgcttgtgttcaaaactggcctccatctctgaccagctgtgtgactttgggcaagtcactttaacctctctgtgctctggttttctcatatgcaatgtggggacaataatagtgacttcttcacagggttgttgtaaaggttaattgtaattattatataaaatacctagaacagggcagggcatagggtaaacgttctagaaacactggctattactattggtattatcaagaaaactgaaagtcacaaaaggtaagtgatttgctcaaaatcacaaattcattcatttaacaagtattaaagggcttcccatacaccagaaactggggattccacagtagattaaatataatagtttctgcttttatggggcctatagtctaggtaggaagataaatgtcgaacaaagactcaggcaaatatatgcagtcatccctcgttattcaaggaggattggttcctggatcctcttgggtatcacaatctgcggacgctcgagtctctgatataaagtagtgtagtatttgcatataacctaagcacatacactttaaatatctaattacttataatacataataaaaatatatgctatgtaaacagttacttaaatttgttatattatttaaagttgttatgttaaatttgtgttattttttattgttgatttgtatttttcaaatattgtctattcacttggttgaatcatctctgaaggtgcagaacccaggcgacacagggggccaactgtaattgcaatctgaatgaccaccatgaagacataggtcaccatgaacatgaagtgtgggagacctaatttctcttctcaggcagggaaggaatggggtcggagagggaggagttcatgggaggtgtggcactaaaacccaggctccggcctgggactctttacattataagtgtgtggccctgggatcaactgtggacttcttcactagcctgagagttcctcaaggcaagagagcaaggacgcattgcactcatccttgcatatctgtagctccacctcaggcacggtgcccagctcccagcatacccacagagtgagagccatgcctattccttcagcacgtgctaagcgccgactctcagggcatggctctgaggatgagagagtgctctgagttgagatacaccgcccacaatacaccccgtgggtaattaacaaccgagaaagggctctgctgaatggagtcgcaacagcacctgtctctggtgtcctccaccctttcagcaggccaggagtctcttgggaagcctaccaaagaagggagaaatgtcctttgctctccataaccctaggggaggcaggatcttgacctcagagatgaccttttgccatcattgtctcagctttcatgaaaacagttgtgcatgaggctgaagcaccgccattataaaaaacttggttaaaatatggattaatccctgggagggtgttatgcaagattcagatatatggtctgtgatatggatatgatatttttttattgcaataataagtttctcaactcctaatggaccctgtattaactgaagatgacagggagcgagggatggaaagcgggcaatttgttaaggttgcagagcagcagttccagggttgtaaaagataaaacatttcagagtcattaaaatcagcctaaattgtctatctgaactcaaagcaacaaacccaacttggccctgagtccatcaccagctatttttttctttacagtgttttgattctcttggactatacacacagctcaatcttctactcccagaaggtccagggctttgaaaagactaatctcaggacttcctggaggaggtggactttgagtgctcaagcagtggaagggaggcagcctttgatggatacacatacctttataaaaaggctttcagatgcaggaagaggcagccaaggtacagtgggctggctggagagaagggatcactgggggtggtcttaaggcctttttggggttggggcctagtgggtagaaaagatcttgaagcttctgattaggactttgtagttgtctgtatgagccaagaggagcataacaaggatttgaggacaaaggtcagactcatgagttagtgggtatttccagtgaagaggctggctactatttgctaagagcttactaaggtccaggctccgtgttgagggattttcataaactaactcactaaattcttacaagaatcccacgaggtaaataatagtgtatacgcatcatatggatgaggaaatcgggcaagtttctccacccctttaggactccacatcacataaccaataaggcagctggactagggttcaaaccccaacaaactaacctacatgaatgtgttagctggaagatgtccctctttattctgatataatgcagtaaactcccatgtgtcaggctccattcacctgctaggggaaacatctctgatggcagggactgccaggtatccttgctctcagatgatgtcagcagcaggaaggcccagcagtgatgctggactagacccctgggcttagcagtgagcaagactgaaagacagatgttctcattgccgggggaaggaaaggtgggctttataacaccctctgcacctgccctgggccacagggactctttctgcattttatcctctgtggaggagaaagtcaccatgaacagaaagggttggcacagaagagagcaggagggaagcaagaagcagccccaaggttcaagggatgacacagagagaaagagagggtggtgctggtgatgacaatgatgactgcatatttctagacatggcccctccaagtaggagacatgggcagaaaggagaccagcaaataaaaagcagccaccatgctgagactcttctttgaaaatggcattgttgtcaaacttagaaaacagtttcccaccctgaataaaacactgacatttgtctaattaaaaaaacctaatggagattctgcagacagagggaagccgccagtgcatctgctggtgaagtctccatatggcccaatccaatgtgtactctgctgcagagacagagcaggactctagaatcgaagctgcccagccattaaatcaccttcacggcctcactggccacggaccaacagggcaggaaagctcagcccagatttctgctgtgcccctcctctctccccgcagcagtaatgatctgacctgtggaccacccctcaggaagtgttagtggcaggaggtgataaggaagagaaggacagtcaggaaggactttcctcttctgggccccagcagatggtgggatgtgtccataagaacggcatccgggcacggtggctcacgcctgtaatcccagcactttgggaggctgaggtgggcggatgacgaggtcaggagatcgagaccatcctggctaacacggtgaaaccctgtctctactaaaaatccaaaaaattagccgggcgcggtggcgggtgcctgtagtcccagctactcgggaggctgaggcaggagaatggggtgaacccgggaggcagagcttgcagtgagccgagatggcaccactgcactccagcctgggcgacagagcgagactctgtctcaaaaaaaaaaaaaaaaaaaaagaacggcaactgggatgactcagtagagactgggaaggaagccctgcagagaagctgccagcccacatactcatggagagccccaaatcgtccttcagacccctggcagtctggaagcctagatgtcgtgaatcaagcctctggcaaggacagcgcagtgaccaaccctcttttcagaaggacaaagtggaatgaaagcacaagccatcaatagcatggtcatctccctggagatgtgcagatacccttcaccttcaagcaggctaaaccggccgagagtggctctgaggacctgcaggtgctgcccacatgtgccctgggctggtcctccctcagctccctctcctgtcttcacctccctgggccatgtctctcaccttttgtggtaattcttcacttctctccacactaattacccctttccatctcacattcctccagctggttcagcacttccgatggctccagtcctaagcacccctcacagtaggcatcaaccaagaacatatcacactcacctacaaaacaagcaacccaccatgagctgtgagatggaaataactcatcttatctattcatctggaatacgatcctgatgaacaggagaagggagaagaacttcaccttccttcaagaggccatgctgggtagcaatggggctcctgcccctgctgttcatcatgtttctggggtctttgtttcaaatgtgaggcacaacagagcatcctgctgtatcagcctaattaccagcctctccttccattcctgctggcatggcaggtgaagtatagcgaagaggaacttggcgtgataatggaacctagtgatgaaatttcttggccactactggccattcatgatcataattaccaatgacgctttatcgtgatgacagaggagggcatgcagagtggtgacacctggggtgcacccatcagtctaagtagtcaagagaggaaatgccttaaggaaccacgagatcccttgaagagactcagctgagcacacgtagttaccagaagtggctgttaggcaagtgaaatgtagaatgttcctctgaccttaactacccaaagattagaacgctgctgttctgtaacacctggagctgaggctggacagttgagcacacatcatccatctttcagtgtcctttctccatgagatagttagggtcaatagtgattgcaggtgacacaaggttttccaaatatggttggggaaggcagtcactcctcaaaatccatttcatttctcttccatagtggcagtattatttagggaaatgagcagctcactggatgagtccattgttctcagggctatttaacctcctcatcactattcagttcagaatggggctagtgaccttttttagactaatgaaatgcaagggaggattgctgaagggtgtctgaccaattatctcactcttaagagagaggatggaaagccacacagtttctccgactgactgtaaacgcagagtgtcttgcccagcttgcagctggcagctatctgatggccatgaaggaggctggcctgggaaaaacgcagtccatgaagaggaaggagctaagacaaagacagaaaaagagacccattgccttcatcaagcggtacctaactctgaccttctggttatgctagtcaacaaaattgcttattgctttagtcaattggagtcagtttctcttatcagaagcccaaagaatgccttccataagaaaaagtgcctcctctcaagtctgcttggaaagagactaccatataagagctgagtgaagaagctttgaagaggcctggcagagtagagtgcaggtggagtctggggaccgcatagcagaggaggggtctgtgtggctgacacctcatcagtgtgcttcagaggaagctcattgctaggcagcacatctgtccatactcatgaacaataggtcaccctttccacctcaaggacaacaagtcagcagcattacggtagactatattttgtttccaactatttgcaggtcagcatcgactcttgcttggctttgtgactttctttggccaatggaatatgagtgaatgtgatgccacatgtgagcaggtgtttgaatgcaagcgtctgatttggcttggccaattcctgccctctgtcatgaggaaggaatgtctcggataggtgctatgcctgtggccagggccctaaaaggaaagggcacgtggagtagggccacagctgacccacagcccacttgtgacatgaaagagggagaaacaaacatttcctgggctaggttactgggattctaacatagaagtatatacaaagcaatactctattcccaggactctatgaagtgatttggaagataaagaatgatgagacatggtttccattctcagagaatttataaacacagcaagcaccagaaagaattacagagagtgcagaatcctggaataccttgcccatacagattgtgaggacactagagttcagaggaaaggaatatactggctgggatggcctacaagaatgggagaatgggtgagtgacagatgacattggatagagttaacagcagacaggtgtcacagcctgagctgaagatttgcagctcaccttgtcagctgatctcatgaaaggagggacattgagaatgcctgggtagcatacgccactttttcttctgtctgccggaggcaaagatgctgagactttcactttcatgtttgaatgaaaatatcttagtgtacaaattatcactttacaattaattatgcagagcaagtaacacacatgagacctcaatattatgacagcttggaaatttactgttttcgaacttaacatgcaacaagtcttgccaaatgtacgttgaaaagtagcacaagattagacaattaacattttaatgttgtatattcacagcacatctgtgggtcagtgtaaacaccacaaacaacttggcagatgatgtcaagtggacacccccctaagactctgaccttaaaaaccaacgctctttaattaggcctttccttccccttctggctttgggagaagagactgttatgaaaaaagacatgattacaccatattggagttcaccaggcatctcaaatactttgggtttgataaaaaacagcagatttcattgctggaatcttcccttcagaatctgtaagcaccatgtggatatcaaggggaatttcatcagtatgtttctgattcctttacacttacatcattaaaagatttttgagggtttttgaagtccaataactctcctgagccattcttcccccactcccagcatatttttcatttcttttcattaaaattaggaaattgaatttcagctctgtattttttttttaaagctcgctgcttgtaaataatggtggctaaggattaaatccccaattctaaacattcgtcctgagatccatcaagctgatgaagatttgtgtatcctcatcgggcccagatctcagacaggagagacgtggtcaactgtgatttgagagatgaattcaggcatcataggcttcctttgcctctctgtagaatccagttttgtccaagcgagacagtatcattgactcacatgaagagtggaactgtagtgttggaagctgaatgagcactaaagtaccactcatctaactctcctgccctcatcaggccaaggctcagctttgtattttcaaaatctctttgtaagttctctcctggtagctgataactgttttagtcacattgtagtcaacccattctttgttatttctgacataaagtgatcttacctttaggtaagagcatttcacattctcttattctcttaacagatctgaacctagtcttgaaatgggtcacataaccatttgcaaatgtaaaaaaaattcttcacaaaggttccagtctgtatataggcttcatgacagcagggcctcatctgctctcttcgtgcaacctcccccagccacagaacagtctccagcacatagtagatgatgcataatatttgttgaatgaaggagtgaataaaattctaatcatatgtaaaacatatacagcctttcacagtgcttccacacctagtgattaatagcgttctaatgataccctgaatgagtagcaaaggtagggtgatccttagattatttataaagcagatgagcccagatatggaataacttaagatcttatggctggtcagtggtaaaactggagtaggtttcagatcacctgagtctcagaatgtgctgttttcatatagaccagtgcttctgaaggttgagttaggcatatatcagagtcacccaaaggatttattaaaacacaaattgctgagccccatcctcaaagtgtcacttctgtaggccaagggtgggccgccagaatctgcatttttaacacgtacccaggtgatgtcagtactgccggccctgggaccacactgtgaggacaactcagaaaggccatagtttacgaactgcaaaatgaaggaatatgagggagagagaaagacacttcttaacatcctccgagactatgtttagggtatcaaactcaactgatcggtacagaaagccaggctgtgtgatttaactgcagaagtctttgctatcccttaaaaagcaaacaaacaaaaaacctgctaatgtagatcacgggacaggaagttccaacctggggatattctaacttagaatgaaggttagctggagtctttctaagtatgaatttaggtttcgaaaagagattttggagctggataaagcattagttacatggtccaaacttctcacatatgcacctgcagaaagaaaggggttagaagggtgatgtgcctagtccagtgtcccagactctcttcatgcctgattcttcagctgtaaggcataatcaaaaggggacaggatgtcccccagcttggttctcctacgactgtttctgcggggacagttggtcaccctatacatgtaaattcttttaacttgtacaccaatgttcattgcagcagtattcataataaccaaaaagtagaagtcacccacgtgtctaacagatgaatgcaaacacaaaatatgatatagtcacacaatggaatatcattcagccataaaaaggaataacattctgatacacagtatgttaaagattcaccttgaaaatattatgctaaatcaaatgaaccagacacagaaggatatatattgtacgattccacttatatgaagtattcagaataggcaaattcataaaaataaaaaatagattaaaggttatcaggactgagacggaaggaagtgggagttattgcttaatgggtacagaatttctgtttacagtgatgaaaaagttctggaaataaatagtggtgatggttgcacaacattgtcaatatagttaatgccactaaaccgtatacttaaaagtggttaaaatgtcaaatttcatgttgtatatattttaccacaataaaaaaattaaaaaaaaacaaggaaaaacctgcaaacaacaaaaatctttccaaaccacgtagcacctccacacctatcctgcctctcttagagcactgctcagttgtaggctgtgtggggagtgagtaatgatcacctggtgcaatctggtttctagtatgagttgcttccactcatactagaaaccatatatgtataccacatactagaaaccatatactagaaaccactcacactagaaaccaatagtgaggtggttgccactatttccattggcaaccaatacttttctgccactccactcattgtctaaccttaggcatggactttagaattgaggtggcgtttctgaagaacgagatggtaaaaacagtggcatttctgttccctcctccaccccagttgcacgctttggtaattgttgaactcgatttcacttggtgtgtgatgacacatcttacagtgatggagcagaatttagatgctgtgactcatctctccaagctgggtttccataagactccacactgatctctggcatgtttactgctgcctgggaaactggttttgtgcattctcagaaatacgagattggcccataatgatatgcatgcctctcagagggaagacagagactcacggtatggcagttgaaggacacacgacttgagggagatggatgttactgaggcaaaagaaatgttcattgcctactcgctcatcatggtgcttccctcccatgtgtgtgtccatttgggcctcagcaacatccccagatgctgggcagatccagtgaattgcaagtaagcaaataaacatgatttaatagtagatgagaagactttgccacaccatggtacctccccctgcatttattttggcaatttggtgccgaatatttacgacagtgctttagaccatccaggtagttttagcgtaaggagtgaagtctttgtaaactaagctgcttgttcctctgacagggtgataagcaagcttgtggtggagggcagttaccggattttaattaactagctgaattattacgtttttgcataaacattcttcaccatcatccactcatgacataggttaggtacatttacacagagaactaaaatgatacattctctgcctcctaggagtttataatctaagaaagggattgcaaatacatagaaaggctattccattcttcatctctgtgacatggcagacattactaatcaaggatagttccccttttcaaaatcttttcctgcattggatgccaggcagccattgtaatcaattgcagggtgtgcaaggccttcctgatgtctgcatgttataaagaatggggagctagctgccaagacattcctatgacaccagatggggaatgtattgttacatgtattttaacaatgtaacaatattgcatagacccaaggaaatatgattttataacgtcatatgttataacatcatatgttataagatatgtattgttacatcatattatattattatttgtattatatatatgtatatatgtattattatgtgtattaatactatattatatataatatgatgtattgctacagacccaaggagatatgattttttaacatcaacttaggttttcatacctttcaagtgataaatacatgcataatttgtagaattaaggcatagtgcttttgtgggtttcgataagcctgacttctcagtgtggatgctcccatgttgtggatgagattgagcgctgtggtaggtgcagccatcactaatgtctttgcccctaagacaggagcaagctgggccccttggttaaacactgattacagccacatactctcctcacttcctcctttctgtagttccagttgagtaattaaaatcacttctgttaaagtagcatggttggctcaacaagccaagggcaagtttacggatctggaggatggaaactactttaaaccttggtagttctggctgcagtgaggaataacaattagaataattgataaccaggtccttgatgtccagtcaccacccaaggcctgcaacacatcagagacaagcctgattctctggctggagtagataacagagctggggttgggctattctggttgcttaagctgcagtggccaaggacatgcttcactttggtgacaccagttgtgcagaagctcttgaactcacacagttgaggtctttgtggtctgggagagaaaccctttccctgatatgtgcacagtaagcatggggctaaataggtgtgcatgactttcagattacatgcaaagaagttttagaggttaagagttccaaagaggacagacaggatttgctggagcaggcctggggtaatacagaatattccagtaacaatagtgtaactgcactactacagtattaagagtaacaatattgttactaaacaataggaggatactactaagcagtaacaatgctactgctaattgtgtgccatttattgaacaatgactacatacctgatatgatgctaaatgtgtttataatgatagcatttaattttatcatttaactatatcatgtaatcttcatatcaaccccatgacgtacttgtcacttgtcattcttcttattgtacagatgaaagttttcaaagatgaagtaattttcccaaagtcaaacagacagggagtggcttggttaagaatctgcccccaaaactcatgctgctcacttccatatattattgctcttgcacaatctgatatgctctcccatggctgactccataaatgcctcttttgtctatatcaccataagatgcatctttagatcccaagaaatctatcgattagacaaagataaatgctcagcaccataatcatgctatcaaatcattgaaccgatgaacgaaaggtggagttaaatctccctcaatgtgaagatccccactgcactgtggaatttagtccatttgatctggatttgggattccagttaaagaaatcttcatgtgaagagatactactgctgctcactgtttcttgccaggtggtgtcagtgctctgtttgcctaaaggataaattcagacatttgattttctgcccatagcatcctatttttcctgatcttacttggctattcctcaggatatgttttaagacagatatgttctttgatctcattttaaacttcctctttggtctctctactttctccctgtcttacagacccctgggcaatcacttttttccccaaccagctcagactccatggtccatcacttcaaccttgtagttacatcctcgtcctaacatcgtaccttcctagaaaaccccgcgcctaggtcactttacaattggccttctctgcctgattccaggatgctgagagctgctagacaaaattacctcaacactcagattggcccccgtgatggttaatgttaggtgtcaacttgactgaattatgcgatacccagatagctggtagagcattatttctgggtgtgtctgtgtgagtgtttcaggaagagactggcacttgcatctctctcgccccctgtgggcacagaccatcaaatcagctaaaggcctggatagaaccacaaggcaggggaagggcacattctctctccctctcccctggaggtggggcacccttcttctcctgcccttggatgtcagcactctaggttctccaacctatagactctgggactcgcaccaggggctcccccagatctcaggccttcagagagttacaccattggcttccctggttctgatgaccttgggcatggactgagccacattgccggctatcctgggtctccaccttgcagaaggtttatcatgggacttctcagcctccataattgtgtgagccaattcacctgataaattccctcatcctgtcttgtatctatctatctatctatctatctatctatctatctatctatctatctatctatcttcctatctatctacctatctgtccatccatcttcctgtgttcctatctattatctatctgtaatctatctatctgtctgtctgtctttctttttctttctatctatatctatcaatctatctatatctgtcttctatctatctatctatctatctatctatctatctatctatcttcctatctatccatccatcttcctgtgttcctatctatctattatctatctgtaatctatctatctgtctgtctttctttctttttctttctatctatatctatcaatctatctatatctgtcttctatctatctatctatctatctatctatctatctatctatctatcttcctatctatccatccacctatcttcctgccttcctatctattatctatctatcatctatctttctgtcatcctatctatctatctatcatctatctccctatctatctatctatcttcctatctatctatccatccgccttcctgtcttcctatcatctgtatatctatatctatctatctatctatctatctatctatctatctatctatcatctatcttcctatctatcttcctatctatctatcttcctatctatctatccatccatcttcctgtcttcctatcatctatctatatctatctatcgatctatctatctgtctgtctatctatctatctatctatctatctatctatctatctatctatctatctatctctatcatcttttggttctgttcctccagtgagccctggctaaccctaacctgcttgtcatgtatgatctccctcctcaactggcccctccatgctgcctccagtccctgtgtgcctctgtggtcagatcatccattctccatgaaggctgaatcaaaccttctccactttataaactttactactgcatctcctcacccctactctcagtagaaggcctcttcctgcttcttaaacgaaacagaagccgacagataagtatttcctccatgtccatctccaaactcatcatcgtgtgcctgatctgtgcccacccttccactttccctgcccttacatgagaagcatgtaacgttccctcccatacaaggtgaatccctccatcctccactggctctgcagacccctttccctcccacttctagggaccttgttctgtcaagtttaccatctccccttcttctcagtagggaaagtctctaaattatgtgcaagtctctcccaccctaaaaacaaataaaaagcagcaggagcagcagcaacaacaacaacaacaacaacaacaacaacctcccttcactccactttcctctgcagcaactgccctattttctcttattcaataccaagccccttgaaagagttccttgcatttcccggactcatttcttacccactcttcccacaatccgcagtgttctggcacccatgtctaccctcttcccagatggttcttgccgaggttgcgaagggcctcatgactctgagtccctgtgaccaccaggcagtctttgcatccctcgagtcggtgcccttgcaccaagcattcgtgccctggctcccatggcagcatgccctcctggttttcctcctccttctctggatgtttctgctcagcttgccttgtggatcttcttcttcttcttctccttctccttctccttctccttcttctcttcttcttcttcttcttcttcttcttcttcttcttcttcttcttctcttcttcttctcttcttcttcttcttcttcttcttcttcttcttcttcttcttcttcttcttcttcttcttcttcttcttcttcttcttctccttctccttctccttctccttctccttcttccttctccttctccttcttccttcttcttcttccttctccttctccttcttccttctccttctccttctccttcttccttcttcttcttcctcttctttcttcttcttcttccttcttcttcttcctcttcctcttcttctccttcttttttttttttttttgagacagagtctcgcactatcgcccaggctggagtgcagtggtatgatctcagctcactgcaatctccacctccagggttcaagtgattctcctgcctcagcctccctagcagctgggattacaggcacctgccaccacgctcagctaattttttgtattttagtagagatggggtttcaccatgttgcccaggctggcctcgaactcttgagctcaggcaatccacccacctcggcctcccaaagtgctaggattacaggcatgagccaccgcacctggcctgcctacttcttacgtgatggtctatcttgagagttctgcccagatcctttttataaccatagaacaggtttctctactgagctccagccctatgtacccgaatatttactggacatctctacttagaggcttcataagtaattccagctcaaatgtgtccaaagtgaaattcattggctttccccccaaaccttcttttcttcacatgatcctgatgtggctcacccgcttgtttaagccagaggctagagcatcatccaaggcttccccatttcccttagcccctatgaccagtcactaacttttaaaaatcttacttctaaatattgttcatctctctattcccagtactcgtcatagcgccttgtagacacttgataagcagtggtcttatggctggtagcccaggcagctcttgatcctgtcccctgggttccttccccctttccctggctcaggccaccatcacctttgacctgaatgcatccacgcaactggttttcccaccttcagttttcccttctagctcgctcactctccacaccacagagagtaatctttcaaagcacaaatgaggtctgtctcattctcttgcttacacccttcagaaagctgtctcccagcacctagcataacaccaggtccttataagtactcaaaaaatatgtgttcaatgaaaaaataattgggatctaaaataaagaggatttccaggcacacgggaagtctaacacccattaatcctgtgccattattgtacttgcccgtttgcaacaaggaacatctttggcttcacacacccgacccacagactgcgcttcagctgctgctgactccctcccagaaggccccagagtagtcttgatttaaaggcagggctgttgggggatttggaagaagtgttaaagaaaaaggagcagctttgctctattaaaacccctgcctttccaagcaaatatggctgctcctgagctcaccctggcttctgccattgcttggccaaggtgattaactggatgcctgctgtgtgctcatccctgccccatcaacaccctcacctcaaccctcctggttagcctctctgatgttgagaatgaaagttgttattagcatgattcactctccaacagcatgaatattcggtgtgactgtggctctgtgtatgtgtgtgtgtgtacatgcttatgtgtgtgtgtgtgtgttgcagtggaggaggttgggataaaattgaaaaaaaaaaaaaacagtcctaggagttatgcccttagggcaaagggaaaaggggtgctcacacacttgtcctagagagagatgtacacttttgcacagcttcctcctcaccataaaaaggtcgggggggggggggggctgttggtcacaggattgtgcaaagccctgcaagggtttggctggtgcacctgctctgctatgtctccacctgccacacaccattgcaaccccctggtaacagaaaggttcccttcccttccccaggctgttggtgccgtgggatctaacatgcatgtgtcctgacaggatgagagagcaggcacacgcatgaggcagcctggtggcagaaggccctgctcttttccaggatgcctgtggtggcggggggagcatggcaatgaagaagggatgggacagtgatcaggaaagcttcatggctgtcctatgatgacataggcctggagacacagaggctgcctgaggccagcttgggggatttacgaactaaatggaagaggctgtcaggttcgagctgagctcagtatgagggctgagcaggagagcagatgtcagggactgggagtttggccagccctgccctctcctccttggcagtatgtcttcctgttgtcaatggccaccagccgtccagcttcattctccactgggtctatgactgccagcatcccggagccacttccagggactgggttaaggtgagaacgttgtggtcacctctgctgcctactcccaccctccctgctcctgcacttctctctggccacaggtgccaggcagcatggctgcactgcaacagcctccctaccagcccaggtaccggccttctccatcctctcctgccaccgcatgtccccaggcactccttcctcctctatctgtgacagtcagagaacagggctttctgccaggttgacatcaacagcaaacagacacccccggatctgagacatctgtgtcctatccagaaacatacctcatcctatgtactgcagtgactcagtcatgggcagagacacctggctgtcttcccatgatgttcttatatgactctaaccaccacgcccctctgcctcgaaccccttacccacacaatcactttgggcctcagcccatcgctccaggagtggaggagatgattggtaagaagaacgctggaggtgcacactgcctggcaacaaaggacaggtgggtggcagacgaaaacttggggcctggcacacctgggtttgaactctggatagaccatctacttgatgtgtgacctctgtgcagcgattcagttccttcttctgtaagatgggaaaagaggatctagccagtgggttgtgagaacgaaagttaacattaagcattcctaacacagtaccccacattgccactgactgtagttatgctcatttgaatatttccctgtcatatggtaatgagcagctctctttggagccacgcaccttcctccctgggctctgccaaggtaggtcacggctctgagagactgcaggaaggcttctcagaggagctggtactatgaggggtgactcggctgggcttctgtctctacacacgtcccttgcctttgcagaagcctctcaccagcacccttcctgccccggtgacttgctgccagagctctgcctggaagtgtgatggaagccacctggcatgagcttgaaaggaactgcaaatctcctatgagcatttcccccctgctctgtggttgggatgcagtgcacggccaagcagcatggaaacctctgacgttgggtggcttctgaatactaaagagggcgcggaaaaaatgaaagcaaaggagaaagatgtcttggtcagaagtttttctaatcgctatggatttttcccccattttagtggatttgagagagggtataggaaaaggaagagaaaaaaatcaaaagcagattattaccccgagctgctcttcctttttatcctgagccatgacagcagctctctgcctgccctgtctgcatgctaacagctaaggcatgatgcaggcaaaatattggcaatcgagctgagattataggttacttggatattgaaaggcagaatcaattaaaataaagctttccagtcactggccaaattagcctctggaatcaaagcctttcttttcattgtccagaaggttctaaggacagctgagatggggttacccaaatgactgaaatgaaaagctcccaactgcagcacacgacacctggggagtaagcacacacacacacacgcacgcacgcacatgcatacatgcacacacatacatgcacacaacacactatgcacttgatacacagtggttactcaatgaatatttgttgagtttatgattttgtgtgtgtacacactcatacttatgtgtcttacccagttatatatacaccattctataattatttcaactttgcaatgctaggagttaactctgccaggcttctgtgagtttgtactaggcttacatttttctttctctctttattataacaagaatacattattttaataaatacaaaaaggaaaggtctcctttgaccactctgcctttggtctacttttacagaaaatgcggacattatggaaaactttatagaaatgtggctttttactaagccatctaacaatagaatagaaaagcaacgaagatttccagtgcttcttccctcctccctctgtcttccacctcctgaatcttcagcagcatgcacagaaaaaccaagcataggaatgtgctttgatatccacccggggctttcccacattctcaaaatctcaagagtagctcttcttagaaggtgtggccttggaatgtggagaggcagcaccatccagacaaggctgtccaggcaggaggtcctgcacatccaccttgcaattcacttaggctttgccactttggggatctacagttttaaatagcttatgatgaaagctcataactttttcatttataagtggagaatttcaatgaggaaacaaataaaaaaaccaatatttgttgagtgctcctgtgcttctccaggctggatgaaggctccaagatggcgtctcacaaggagttcagaatctaatgtgctcaaatcacacaagtcattgccataagtgctaccgtcaatgtatttttaaaaagagcccagaaaagagagattcactctgcataggagcttcactggccttgaggatgtgcaggagtttgctaggtagagaagagatgggatagatcccaccagtgggaagatcaggaacaaagctcagatatctggatgtgcacccagtgtttagggaatggtggatgtggggctagagcagaggtggggaagaaatgaggtggaaaagttgactggggccagatgtccttgggccttgaaatccttcctacttcatcctttaggcaatgggcagcgattcccggacataggtccagaggctgggattgccctgatcagggctggttttggaaagacagctctgaaattagtgtagggaatgaacttgagaaaagaggccctgcaggcggacactgtcatgagctggaggctgaagcctgggaccccgacgtggtggcgaaaatcagggaaaaggcaggactggggctatttcagaagtgttagccatgcttgggggagagcaaggtctcagttaatgcaaaagaccctcaccagcatgactgggtggaaaaggatgttttaatggacataaggaacacagcagatgtagagttttattttttttctttttaaagttggtttgttttgttgattggtttggaggcagaagaggtcacgaaggagagggaagaattaagttaagtttgtggcgcttatgagctatgtggatggtggtatctagtttatttctctgagcttaggtaaaaggttaaggccaaactatgggcttgggagccatgagcaaacccatgattggtcaaactatgagaatgaatggatgaaataaatcaacatggacagaaagagagagtaaaagaaaagagagagaaaaatcagagatagaaagacagaggtcaagttcagatgtacataccccttaggagcttttcaaggacgtcggcagggagctgggtttacagagtggagaggacacatctgccaactgtgactgagcgtggtcagagggaggagaaaaggcacaagagagcaaaacatcttgcaagctaatggagaatagaattttaaggaggacagagaggtcaaagtccccaggaagtcaagtgacaagatgtggtcatagtgtagggatgagtcccagagcctcctcccaggtccaaaatgtagctaatgatccgaatgaaatccagacagggagtcaagacagggaaggtacaggcttgtgggtgctgagggtgtggacaggaagagaggcaggagactcagagtgaaggggagaggccttttgtgtacagaaagaaggaggtcagttccacaaatgctgccgtctggaatgcagaattttctgacttgcctaaaaagatcgaaacaaaacctaagaagcagaaaacaaataaaaataagacaccaaataccaaaagccaaataagaccacgtaaaagcaaacagagcctcctcaagccagagaggcccctgacccagttttgcagcagcaagacccagagttccatccaggaagcaggctgcggcagtgagtcgcccaggcctagaaaccaaaaatccagcctgcctggagtcctcttgggtatgaaagttcctggagaatctattcatggcttccaatttccattcatcaggctgcacatttgcctaagagcgattccacgctaaacataactcagcccagaaaaatgctcctctgcgctctctttccactgctgaatttcagcttggcttaagtaacaccatgtgacataacacaaagaggtgaaatgagagctcataattgcatcagagggctgtgggggagccacccccccccccccacctcaccgattcccaagtacacttgagggaggaggaaggaggggtgtgtaatttgttcatttcttatattttatggaacacttcactttgctttcagcataattatttgttgtacattttgctgattcccatttgtgtgcttaaaaaaaaaaaactcttcactcccccctgcacacttttcttaatgcattaaaattaataactcgtaacagtgacctaatttgctttgagtactgtaactcagggttgttgtatgcgtgtgtattttttttctttccagatctgctaaacccttgacatgttactgtggtaacaggagcaacttgggaagttcatgaatgaacctcattgtgttctcccaagaaagccctctctcccaccattctttgcgatgtttggagctcacccttgcctgttgtgcctatattcaaagcattggaattgggctgctccaggctgtctccaaatccatgctcaatccccatcatctcactgccctactgcggaggtagctgccagtctgcccttaactttcctaaatgctccagggctctgcatcaggagggttctccttctctaagaaaatatactttcttggtttaaatcttctgcccttccctgccatgtctgtctgggccctcagctaaggaagcctgctgaagataggaagtaggtcactggattgcttcatcccctgactaccacctcaatccaagccaccagcttcttccctaattgtctcactgcattctatctgctcccccaaccccctccatatccagtgcagttagaggggtcttactaaatcaggtatctggttgtgttactgtcctgctcagtgatcccaggattgtgtccctacccctgcacacagctgaccaggctcttcagagtctgcagacatagagctgtacttgccccaaggtccattgcctcctctgtacatgttcctcctagctatcctgaacgacctggatttgccaggctatggcacagtcatttttctgcatgctttcacattcggttccctctgccagaattcccctatccatctcccactctcacacaggacgagtgtagacagcaccttctctcagaaagctttgggcagttggataccctacctgtgagttcccacaggcctctatgctcatctcagcatggaacttatgtgcactacctgtgtttgtctgctggtcttgctggcttccccagtaagctctttgagggaaagtcctgtttcttggacactgttgtttcttggacactgttgttatctccagaacctatcgcagtgtctggcacataggatgtactgaaatcaagattgaatgaatgaatgaatggatagactggaatctattacctgcctttcctccctccctccatacattccttctttccttccttcctccctaccccaccctactttcctgtcaatcactccacaagcattcactgctggttatgtgaaagggaaggaggatataaagacggattttattgtcttccaggaacccatagcattgtggcatccagactttgagacaatcttaaatacgttcttctgaaggctcccttaagtaagccctcttggctagtcattctagagaatgaagctgttttatgtccaaatctactttctagtagcaagtataagaatgaggattccaagtcctagttgtctaaataatttaaatatggaatagtggcagatacccatattcattcttccttacagcattctggggaagattatcaccagtttacagacagtagcaatgaggccagaaaggtggactcaatccccttatggcaaagagaaaagatggtgacaaatgatgctagtaactgagggctgccagcacccagggagccccaggacacgtgttgccttctcaccccaataggagtagatggacgaggcatactcgtaccaaggagggcataaggattttatttccacagctacctggagaagaaaattcatcatcaccctcagcagacagcaagaaaagaagagaaagaataagaatgtatcaaggaggcttggtattgattttgaaatcctggctgacaagacaatgatttgagtccatttccattttgtggctgaagcctggtgcattctttgcctctgcctgacctcccagagcagagttcatcaagaatcccctctgctgacactcctatcctgattctcaaacagcctctcgcctgtttgtctccgacaagaaaggacatgcacgtgaaaggagcagtgtggcttcctgtgtctcctctggaagaggagggccctatttcaaggctgatttcaaatagtacattttaaaagtctgcttagcctcacacacatatgagcatcaacattagtgtctttacggaggttttcggcccgcacagaaagggcaaagctcaatgcattcaacccaacaagcagcaggttcccgtcttggacaccgaaagtggggggtcctatttcaagactgatttcaaatagcacattttgaaattctgcttaacctcacacagatatgaccatcaacattagtatcgttatgaaggttttcggcccatacagaaagggcaagtctcaatgcattgaacccaataagcagcaggtccctgtcttggacggtccctgctacagccacccccagcaggctcttcaggccaggaaatgtgcttctgctgtgagtcccagctcttcgcatggccagaatcctaagtaagggcaaaaggcctatgtatttaatttacttgtaagtgaacagcttctatgtgttagaaaaaaataaactcaacctacaaaattgtaattgcttgagatttcacctcctggccacgtttctcttcctatggagttattaaaacccacacaatatgatctaataatttattaataatcaacataaatagataacagctcacatagccataatagccaatgcatgttaaataatgagggattatttaaaagacacttcgctggagagaaggagacatggtagttagaatctgcaattactgctgcagttgcagataagcatgtacacaaggccttcttggctgttcaactggctaccttgtgcccctgttactccatctgcatttggaaggggtggggtatcagccagtccctgcttaacagaaaaagacgtccaaattaattggaagggaacaaaccatttcttcacaggacaaaggaaaaatgctgtgcaattcaatttctctgaaaggagctcaacaatactccatctcctgtcccactatcaaagtccctatcatcaaacctgggcatgtctttctcatggcagtttctttatccttactccttgaaaaataagtgagtgagcctaagttcattgcagcctaatgagggactccctggtcccttctgtcattctagtccctatttgtaagcccttcctccttcaagtcatcacgttatctgccttaggggaacctcctttatactctttgcatgttttaaagaatttcaaattcaatatcagatgcttggcaactagattggaaggaaagcagaaggaaaactgtctttatttgtagattatttcatatgtaaaaaaatcccaaagaatctacaaaaaaatcactagaactaataaatgaagtcagcaagttcacaagatcaatacacaaaattaatttggtttctacacacaagaaatcatccaaaaatggaattaagatatcaattccatttacaatagcataaatagcattaaaataatcaaattctagaaaggagtttaacaaaagaagtgaaatacttgtacaattcccaccaaaaaggaaaaaaaaaaaccaaaaacatggagagaaattaaagaagttctaaataaatggagagacattccattttaatggttaaaaaatgttaagatgacaattcttcccaaatcatctttaggttaaacacaatttctattaaaatctcaacaggcttttttctcccctaaaattgacaatcaagttctaagatttacatggaaatgcaaaggatctggaaaagacaaaaaaaaaaaaaaatgcaaaagaacaaagttggagcatttaaatttcctggttttaaaacatactacaaagttacagtaatccacacagtgtggtgctgacaaaactatagacatatggacatatagatcaatgaagcagaattgagagcccagaattaagctcttatatttagggatttttttaaagaaggtatcaagataattcaatggaagaatagtcttttcaacaaatggttctgaaacaactagacattcacaggcaaaaatatgaacttagaccctggcctcataccacaagcacaaattaaccccaaattgatattgacataaatgtagaagctaaaactacaaaaattttaaaagaaaatatagtagaaaaccactgtgactttgggtttttctatacacaccaaaagcacaatccatagaataacatgaagaatgtgaacttcatcaaaattaaaaatttctgcatttgaaaagacaatattaggaaaatgaaaagaggagccacacactgagagaaaattccatgaatcatatacttgataaataacttgctgtagaacgtataggaaactcttaaaatataataataagtaagtaatgccattaaaaatggatgaaattcaagagtattaacagacagttcataatggaagaaaacatttgcaaaagtcatatctgacaaaggaatgatatccaaaatatacaaagaactcttaaaactcagcaataagaaaatggcaacttgattttaaaaatgagcaaaagacggccaggcgcggagactcatgcctgtaatcccagcactttgggaagccgaggcggacagatcacgaggtcaggacatcgaggctatcctggctaacgcggtgaaaccctgtgtctactaaaaatacaaaaaatagctgggcatggtggcgggtgcctgtagtcccagctactctggaggaatggcatgaacaccggagtcggagcttgcagtgagccggggtgacaccactgcactccagcttccagcttgggccatagagcaagactccgtcttaaaaaaaaaaaaaaaagagcaaaagacaccaccaaagatatacaagcatgtcaaatatgcatatgaaaaaatgcttgtcatgagagaatttcaaattaaaacaacaataagataccactacatacttattataatgaccaaaatccagaacacaggacaagagcaaatgctggcaaggatgtggagcaacaggccctctcattcactgctgctgggaaggcaaaatggcacagccacttggaagacagtgtggcagttaaaaaaaaaaaaaaaagaaaagaaacatactctcactatatgttccagcagttattctccttggtatttatccaaatgagttaaaaatgtaggtccacacaaaaacctgcacacagatgtttatagtattttcattcacggttgccaacacttggaagcaaccaagatgaccttcagcaggtgaatggaaaaataacctgtggtacatccagacaactggaatattatttggtgttaaaaagaactgagctattaagccataaaaggcatagaggaaactgaaatgcttattaccaagtgaaagaagccaatctgaaaaggctacacatactatatgattccaactagatgatattctggaaaagacaacattatagaaataatacaaagattagtggttgccagggtttgtggggaggaagagatgaaaagtagggcacagaggatttttagggcagtgaatctatcctctttgatactacgtggtagatgcaagtcattatacatgtgttcaaacccataacatgtactgcactaagagtgaatcttagtgttaattataaacttcgggtggtaatgatgtgtcaatggaggtccatcagttgtaacaaatgggccactctggctggtgtgagatatcaatactgggggaggctgtgcctttgtcaggagcagggtcatatatgggacctctgtactttctgttcaatctcttgtgagcctaaagctgctctaaaaattaaatctacattttcaaaaatgggcaaaaaatcttcaaaagacatttcaccaaagaagatatacaaatagctaataagcacataaaaaactgcttaacatcattaatcactggggaaatacaaattaaaaccacaatgagataccacttcatacccactagaatggctataataaaaaagacagaaataacagatgttggtaaggatgtaaataaactggaaccctcaatacattgctggtagaaatgttaaatgttacagccactttggaaaatagttcagtagtttcttaaaaacataaatttaccatatgatccagcaattccactcctagatgtctgcccaagagaaatgaaaacatatgtccacacaaagacatgtacacaagtgttcacggcagcattattcataacagcaacaaagtggaaaaaaatctaaatgtccatcgactggtaaaagaatatacaaaatgtggtctatccgtacaataaaatgctattcagcaaaaaaaaaaaaaaaagcaaatgcatattgaatgcatattgatgcatgctactacacggatgcacctcaaaaccatactaagtgaaagcaaccagatacaaaagaccacaaattgtaaaattccattgatacgaaatgtccagaaaagacaaatctctagcaatagagtatagaattgtagttgcccacagcagtgggtgggaatgcagatgatctgcaaatgggcatgagggatcacttgggagagatggaattgttctaaaactagattgtagtgatgtccgaacaactgtgtaaatttactaaaattcattcaattgcaaagttaaaacagtaaatgtgatggtatgtaaattatacctcaataaagctgttaaggaatagcagatgcttattaaggatgtcaggagggtacacgaatgcagagggcacacactaagaacactacctatgattaatttaacataaccccattactggtgaatgtgtctttcaggaatacctcctgctgttgttgtatttatctaggacatagcctcacacttacatcaagcagagacaattgaagccaccaagttcaatccaagcatcatctcactggcagaatgaaacaggataacctccagcttagccagaaagaggatatgacccgtcaactagtactgaaacaaccactgccttccaaatgcctcccatttatctcagtgtgggttaaaaggcctaagcaatatagttatcacttgccagttgactggcctctcctttgtacaagggcttggatagggataataacttacttttgtaaagcacttacaaagtgccttaacatacactagctcatctattcccatagcagctctatcagcagatgtggcaggcgctcttggttgacaggccccgtcattatcgcagctccagtcaaggacacgtgagcatacatttcctggaggagctttggagaaagcttttgccttactgatacaataagacagatactcggtctcttcctcttttccctcctctgtgcctgaaacaaggatgatgccataaaaaaacagcagttggccgggcgtggtggctcatgcctgtaatcccagcactttggaggccaaggcgggtggatcacgaggtcaggagatcaagaccatcctggctaacacagtgaaaccccatctctactaaaaatacaaaaaatcagccgggcgtggtggcaggtgcctgtagtcccagctgctcgggaggctgaggcaggagaatggtgtgaaccaaggaggcggagcttgcagtgagcaggaattgcaccactgcactccagcctgggcgacagagcgagactccgtcccacaaaacaaaaaaccaaaaaaaacccacagcagtcatgttggtactgccaggggagcagtgggtagaaagggccaagagaaccccaaagagtcacagagatgctgcttctgacatgggtaaactgctggaccaactctggcagcatctccctagaagccatgttaagagaaacaaatgaatccctacttgtttataccattgtggttgggttttctgtttgttgttgccaaacctatacctacctggcaaagtaggaattattagtcacacttcacagatgcaaaaagttgtaagtctttgaaaaactctgcaacccatcaaaccaacatcaaaatgccagcaacttgcactcagtttcctgaatttaataacagagttaataacagccacaaccacaaaagccacctattgggttccaagtggtgtcaaggctctaatgacactgggcacttgactggcatattttctctaattcttacaactctgcaggctgagtgttactatctctattttatggatgagcacagtaaggctaagaaaggtcaagtaaattgctcaagatcacataggtagtaagtggtagggccaccattctaaactggcatgtgtcttgcctgctatgaagaaagcttaaaggaataaaacatacttcctaggattaggcaaccagctactctaggtctccactgattaaaaacattatgtataggaaattagcagggatgattgctcgtgggagtcaggttagctagccaaactcataatatttgcttgtgtgttccaactgtcatactctaaactgtaacataaagaaagtttctagacacaattttcttttcactgtttacaaccacttttgtatcttatagaaataaaatagaaaaaacacacactgattacaagatgcacagtacctacgaaaatctctacaggatatgtgagatcagctttcttccagagagtgggtaacaattaaaacaccagtttttgtcagcaccaggcctaaggacagcagcctggaacccagaacaagtaggatgagacaggagtctctaggtagagggtaaagatcagcctaggtacctgccagggaaaaagcttcagtgtgagaaggaagctcctagctgagccccgccctgccaggcacacatagtacggacccgcagtgatgcctgttgttatcaatgtatggatagtattggtagtttctagtagacttgagctgctgtgggggtctgtgcatgttggattggacttagaggagggtggtaaaaaccagttcagagaaatttgtagatgttaattgcaaactgctttctcttcaccagaagcaatctctcccttctgagatgggcaacatcatctatctccatcaggcccaatgggctgctccaccttcgagcgcttaattagtttgtctttctggatgctctgtcctcccccatcaaagacaagtaattggttctcttaaacatggggcatccagaactgatggagaagtcttttcaagggatcatggaactctgtgctagggagaagacaggcctcagattctgtcaggtagggttctagatggtgctgctgagaggctaccttattttcacaagttccaatgctagcagggactctcctggccaccttaagtggcgtttccaggagaaaggctgctcctctggtaggctgcaagcatcacttcgatttgtgaggtaagacaaaaaggacaggtgaactaggaggatcacaccggtacctttgtgaggagcaagcatctccccttccttcagactgggttgtttagacccaaacttgcccttggtcctcccaaatgctgctatttccctctatatgattgagtcagcatttctactttatatgaaactgatattatagcaaatcttatcaccatgaatgtaatgaatcttcctgccaagttatcatcttgtgtctctcagaggtgtgtcttctttcccaaggtcactctgggcaacttgagtgagccacaggttcatacaggggccttgggacaatcattaggagaaacccagtacaaataaaaatctgattagactttacctcctctgacttttcaccacctcctctatcctactctaccaaccttcagactcttctagctacaggctttcccagagcccatctctggggataaaatggactcatttagctcattgaacagatcatcaaatgcccactcccccaagaaaagaagcagtttggaccacaggcaggtcagaatgccctagcacttccacaaacagcctgctctcaaaggattgtcaaacgtgcaacaaatcagtgttctctcatcaaaagcatcataactcatttaacattgagcctatatctttttaaatatatcctttttttctagattggaaaaacaatagttgtttcttttttcttttatttcagcagggttccagataataaaaagatttataattacgccagtagatttacttttgctatgccgccctagattatgaaaaagtataattatatgcaattaaaaaatgaacagtatttcttacccgagtgaagctttaaaagtcattatgaatccattagctcagcagaccttacaaacggccttcactactctggactgcatttaaatttacaacagagagaagtaacttttcctcatttccacggtgtgtgtgtgtgtctgtgggtgcatgcattttcacccttctcagccatacctggaagtggccattcatttttacattctaaggccatgttcttagtattgaacttgaccacacagctcataatgctttagaagcctccagctagaacactgaggaatgacctcagaattcttctacttagccttgtccctacctctttactcctctgtaggcagtaattcttttttcttttctttcttttttttttcttttggtgtaacagtatcgcatgagccaagactgtcatgaaactatttggatactgtactctggttccttcatctcctccatctgcatcagcctaaattgtcctagtgagttcacttatgtctgggttactgtagatttgggttttgctattactagttgtctcacttatccagataattacctagcttgattgaagcttagtctgttgactaccagaaaacaacacatacgggagaattgatctagataattcagacaccattcatgatgttatttcaattgagcattcttgtgtgacaagaactggtaattattgaaaatttcatctgcataaaaatactagatcttacccacaagtccatttcctcttgtctctcagtgttagactcaccctcagcatcatttttggcagtggcccagcagttatagtaaaaacaaacaaacaaaaaaccctccattgtcttttatttaactggccaaaattgccacctgatctctccagtctcactgtatttgtctgatgctgttagagccttctctgtagtggctgcaagtctgctaataatcagaatcacttgggaagcaattagaagtatacagagatgagtcctaacccagactcatgatcagaaattccagaagtggagctcaggaatctgcattttaaaatcactcaccaggtgattctcaggcagccagcctcgcatggtgcataaactgacgttgacattccggcagcctagacaatgggtatactcaggtgaataagagggatggtctcttctctggtcatttttctactcttacctcttcatcctttcttagtcttctgattcaagcctggatgaataaggattcctggaatagtacaaaatacttgcaactctcgcagtcttcccagagtgggctggatgaagggtgctatccccaaatcaggggccgtgccctgggaaggatggtaggcctccagggatctatctcagtgtaactaactcctcagtgggctcaaaactttccctcttgctttctagtttttaggttttctagttctgttgtgccctttattcaatgcaagccatcaacaagttccttaaacataaaactctgtgacactctaaactgcaagacaatgtgacaatgagtatgccagtctgaaaagaacaaaggagcagggttcagaagaactggcctttaccagctctgtcattttccagtggtgtggccttgcagaggtcacttcagttttccaggctttggccaaagaaaggtgggggcaggtggtaccttcccagctcaagtcttctggaatagagcgtacgcccatgaagccctgcacctgttggagcttcatagctgtaatcaaggtattaatctctctgagccttagtttactcattaataaaattggaataatagtattctcaaccatatagttgagtaagaattaagtgcctctaaaacccctagcatcacgcctggcacacggtaaacactgagtatctttaacatgatgtcatcatcatcatcatcatcatgaaaaacatactttctcatgttctaaagggcccaattcatactgcccactgtatcactctgacaaggtaacaaagtgacctcagaaacctggctaacaagagatcaaggcataaccctagccatggattcagggaacagaagctggcccttctgtggaagtcccggctgcccaggtccatgtcgtccctggctcttccagctggagggggtcactcaagcactgtggagtgacagccagacaggaaagcaactgcatttgtcctaggagtcatgtggcatgtgctggatggcgttttgaataacattttaatgaaccaagtccttcagtgtaatgcaacctcagaggtctgaacatgctggccttctcccctgcactctttgtgtggccactccaagagtagatgcgctcccttgaggcgctcccttgagccctggagcttgccgggggcagccaccccttccaggatttctgctttccatgcaatctcccttttccttctctctctgagaacctcaaaaccaagttgtttgtaaactcctctacagccccaaatggctctgttgcaaggctcggctcgttaacatgcaggcagtaaagtatgtcaggagctctgatttgtcatattaaggaggctatatgactgtggagaggaacattaaaagattttattctaagatattccctccaatccccacccactgcagacaaagtctcttgggacaagcctctgcttcagtgctcttgattgcacagatttctgataaatgttttcatcagtgccataggcctgggtgctgctcctgctccactggggccttctctttggggtctcaggattggcttttgaggtgtttctgggccttaagcagctcccatggtaaaacattcaccgtcattctttctctcttctcactcactcaattacagttaaagccctgttccagggaggagtggagggagactccatctccaccacggaacgccttactcctggaactaatcacagcatttctctaccctcctcggaacaatctgataccattatcactgacatcatcaaaagaagttccctttatagattgcattgtacaaatagaattgcctagatgtgatggctttgcccattaggagtgtacaagcatatttacacaacgccatggagcatgggtgaaggatgagcccaggacaagattaaatcagcagactgaacgataaatgaacagtaatgcattcatatcgaatacatctcagagcataagtgccatccggggtagaaggcagggaaagggcatgactgcagggtcaccagggccagaatgactgatgtgaggggtcaagggcaggctttgcctccagggaggcattaaagggccacctcctatagtgaaaggaaggctgccacatttccctatgccccctgagttttagagataccctatttgaatgagagaaaacaaagtgaggaaacggctaatctcaaggtttaggaggtgagggggacatagtatcattcggtttggtctaggtggagacttcttaatttagatattgatgcagttcgggacataccaaaatatgtcaccttggcatttgacaaaacagcagaggcaggaagtttgctctcaccttcccctcgcctttctcccctgaagcaggtggtaagattctcattccaggtgccctccctacccggaagaaaggaagatccttatctctgaagataccaggacacagagaggaatctgaataaatgggccttgctaggttccccagcttaccatcatcagattacaccctttggtcctcctattatatctctccaccactgtccattcctcatcaagtctaagcatagaaatgcacaggtttccctgtatctttgggtcttcattcccttaagaaggctcttgtgtcatgtaagacttatattccatacgtgtgtgtttttctctggttagtctgtcttttgttacaggagcctctgccatgaacccggggataagtgaggaaagaaatttttcctccttcacagtatcaagtgccaggccagggcactttgtccaggcctcactgtgaagaaagagtaatgttcaaggatggcagcaggaaggtgagaggatgaaaccaaatgctcttggagggcatcgggcttggttgccactgagaacttccagaagaggcacagctcaacgcggggtgccagtaaccgtcatgccttcctgtcccagtgggctgacttgagacaaagcacagctgtggtccacgccttgagacttccactgggcaaggaagcccaagtgaggctccccgcacctctgccaccttcccctacacccacacctgcaaacctggggagagtgacaccagccttccccagctcctctctcagtctaggctggagctgactcggagagaattgaattcccttctccattgctcctggggccgctaattcatagctgcattagctttcatttgggtaacagcatgggggattgtcagatattggctctgaccagatttaatctacaggctgtgttctgccctctttccacttgcctttcattcaggaccctaatgaagaggtttatctgattggtttactggagtcctatgtgggatgaatagcttcagcctttgcgcttgcacctctttgctgtccactccaatcaagaacgggggccctcgcaactctctcagttctgaaacaaattaaatctcagtgacagactctatctgcctcgagttctccattatgcttcgctttaggtttgctttggcaatgacaaaactgctttgacatatttgcggattctcaggcccgtgttctcagctcccccacctccacctttctgctgtccaatgtgatttttgtaatggcaaaaccattgcgatccttctcaggcatcccagtgtctatagcttttcagctacatatcagcaacattcagccacaagtgtggctctgacaggctgtggggggcagaggtgggagaatgccagagactggggagtggtttcctaagcctccttcctcaccctccttccagcagttcactcctttaaagagaaatcattctctcccgtgtctccgcaggtcactggaagaatgtggcctggggcccttcagtaccatttaaatctatgcttgcaatttagcaaatctttagatctgttcccccaggctgtggggaaacagatctcaggtttcccctgatgccttcaggggaagctgcaaaactaccttcaccctaatcacctgcctcattagactcacaacagacagatgttccctcctccttgagggcttctaacttaagcctttctcacctaagtttccttataatggcgggaaaagagaggaacagaatcccaggtaggccatcaatcatcctaacgttgacaacaataagcatgttgacggttataaagtctgcgttttccaagcttctgttagtatgctaagagttgccctgttggaattaataattgcaatgatattggtgttgtagtcatcacttgaggcctattaaggtcccttttagttctaaaatactgttcattcattgcctcattcatgcattcaccaaacactgagcatccaccatatatcagagcctttggtcagagttccctggatggaagtcctgtggtgactgctgctccatctgagccccttaaaatctcagagactgagctgggtgttttagaaattcaggtagtcacaaatcctgaccagaatggctgagatttctgagctggaacccagcaccctagaactaaggctcaagccccttgtgagaacaagaaccctaagcttagatgccagaattcaagtttcagtttttccccttaaaatgaccctaaatcccttaaaactgcaaaatgagtggtcatgccccagactgcggcctccagactctgctactagccagccactcttgtcatctggaagggaagatttggttgctacaacatgccaccatactgggagttgcaagacctggtttggtcctcatgcattggatcaccttactcaaaccaccttggcctcagcttcttcattaataaaatgctattagactttatttacacacagttgaaaaaggactaatacaaatgcccataaaatctacagactagactagatgttaagtaaggtgactttccactctaaaactctatacattatttgattcatttatttaacatatcttgagaacatgttttatgtcagttactatgataagagctcataaaatatgtcccaatatccataacaggaaggacattacttcataataagattaaatggctgcaaaaaattcaatgcttggatatcctaataacaggtgtaataataatcactactcttattaattttgtacttatcatatgtcaggcaacagagtgaatgttctacacaggttttgttgcaatttatcttcacgaaacaaccatataagtagatatcattgtacattgttcaaccactatttattgtgtaactagggtgtggtgggccttgaactaggcatttggtatcaccatacagagattgaatgtgcaggcattgagtggttaaataacttcctaggcacactgcttgcaaatggcagaaagaaccagaaatcttatccgctaggctctagaacccaagttcctaactgctaactttcatgcctacatcagcttggttttcatgatcctcaaaatgtcagtcaaagccagtgttttctgaatcaataactccctccctcacagtgtccttttccaacttagctcctctcgtttatgagccaaccatctccatggcagtccccttcactatgaaatagtcgtttgtattctccaggcttcactagttctcattttcaattgccacctgaacactgctactgctattttcttcttgtcttccactctttgctctctccttcacctctcctataactctgcaaaagatctgtgaattggctaagctgaaggactctaccataacctgattccagagaagcaaactgtgaacccttttgaaaacatttgctgcactactcagagcagacgtagtgaccaggaattcaagaccaactttcaatgaagctggaagtgtgcctgtcttggcggatttagaaactggacagccccttcctatcttgaaaccacatttgatttgacagcgtagctaaaaggaaaaggacgaatagtaactgagttgagttttatgtgcacacggaacatataaacacagcttcaagataaagaactttgagtcagattttcacatgtcatgtgtgagaccatgcagcaaacaatagagagatgggatgggatagctgttgcagactgagatgggattaaaaagggatcccatggcttttcacttagctaaaacaatctggaaatgttaacgtcataatgcacagcatcaccttagggagttctccaaaacaatggctggctgttcagactaatcagacattggtataatctttgacctcagtctaaataggtagctctcagaatctgtgtggctgttcatgctgtcaggggccatgatgctggaatgggaggtgaactggaactgtgaagctacttgataaaacatggtgttgggctccttaggcgttaactcagatatcccaattgctgcttggctaccccaaaactccaacgcacctcattatttcataagagatgttaaatacaaattgttcattaaaatacatattattggatgttaaactaccgtgtaattgattttctatccattgcctagtggttaaccctcaataaatgctttttgtaatcaacttaaagtataatacctaccacgcttgatgtctttctcctttgatttaataagaaaccaattctatattattgaaattgtacttgataatgaaaaagttggtcaaatttcaagaatagcataaaaaaaaaacctctttggcctgaacctgtccaactttatagagggatctcagtacaacggagaactcaggggaacctaggtcctgttccaaccatggggtattagctaaggtccaagagagtcaagtgctatgctcagagctaagagaacagcggggtagactagaaatactatgcagggactcttgttcatagtgcaatgcccaaagaactagcatagttcttccccagggttatgagatcaagaaaactatgagggattttaggcttcccaaaaagcataaaaagcagttaagcatttaaaagatctatgggactcagtttccttattcagagcttgaccagtgctcttttttgctttcttcaaaatctggctaggatttccacctcctcagggagtctgccttgactggatggaaatacaaggtgactgacgccatccatagggtaaacaaagtggtacaatggttagttcaactccagcaaggcagacagctggatatggggaggagttcagaagccagggaaagagatgtgagctcaccctcaaagcttctgaagtgtccacataatccccaaccctacagcctccaaaacataatcccatatacatataccatataacatgctgggctaggagaagaatgcctgaaagaaaacatgcactgctccaggaaaagcaccaggcacagagcaagtgtttaaaatgttagccattcttggctttttatattaatgtttattattctacaacatgatttttaatttgcttaaataatctcctgactaatggacattgagaggaatattatacagttatttattcattcatatattgcctcagctttctaaatatgaatttgctgggtctacaggtatgatttctggtgagcttttaagacatggaactcacactcttactagaagtgctgtacagaagcagcgcatgagatcattgtggttgggtgatctcaccatgtggttaccatggcctaggaatctttgtgaggtggtgggtcttctgtcagggggaggtagaaagaagcagcagaatgactctttatcagaactgctctaaagggactttatgtgattagtaggctttggaccctcgcatcctttccagttctgaaatgttctgattcataggcttctggaacacagagatgctcatgcacatgcccctccccatggagggacacaaagatgcatttccgcctggaagcacgacaggctgctaagctttttgcctggatgctctcacccttggagatcagaagctgagcatctctccattcagccatcaacaaaagggagagattgcctgagcagcatgctgttgttagacaaatcggaatcctcttctagaaaggcattctcttctgcatagtgagtgggaagcctgctgtatctaggacacgttcccaaaataaaattcagtggtcaccaactgactcagtgtaggagacttcattctccaagagagaagggctgctaagaatggcaggaaccacccacagatggtctgggtaccagttgcatcaacagatgcatacacaacacagccctttcctctaaagcatccagccaagctcacatcgagttctccactgtgtacattaaaaccaaaataaataatccaagaaaatctgcacgtctgtgtgtttagggttcaagatgaatcaggcaataggccaaaaaggaatgtaagacatttgaccactatttttttcttccttgttttttttaaatggaaacctaagcattagatcactttccacccttaaaatatgcaaggatggccaggcacagtggctcacgcctataatcccagcaatttgggaggccgaggcaggtggatcatgaagtcaggagatagagaacatcctggcccacatggtgaaactctatctctactaaaaatacaaaaatttagccaggcatggtggcgagcactcccagctactcaggaggctgaggcaggagaatcacttgaacctgggagacggagattgcagtgagcagagattgtgccactgcactccagcctggccacagagcaagactccatctgaaaacaaaaacaaaaacaaacaaacaaacaaacaaaaccaaaaaacatgcagggacacccaatgtctacaataccaaggctgacctctacgggcaggcggtaaagatctttcagaatctggccccatttacctaactcattacttatcttggaaatgttacagttcatctggtaacaatggtgtcccattgttcattcttatttttgacttcaggtccctactcatgcctagtgcattacaaaagacatttttcttctccatgtagaaagttacattctccttaatgtggatgccttcaccaactgctgctccctttcttctcccattgtacatcacacagatgaaggaggaggtggagagccacctgtctgcactcctagcctggggattctggaatgctagaacagcttcttaagagtcccatttgcatagagcaccaaagctcctcattagaaaactgatgaagaagattagactgaaaggtcctttgagggaacaaagattaatcctcccaaataaaggggagtttctaagaacaacccagttagagagattatttctgccccaagagggcaaagaacttactcagaggtaggacaaagatcaaagacatgtgttctgttaagaaaaaaaacagtttctggatgtggacagcagacagaaatgttcccaagttcttaacccaatcacatcttccaagcccctttgcaatgtatcgtcagataatcccaggctctggaggttaggatgtggatatcttttggggggccatcatctctctacctgccatgtgggataaggcacacatagtaataaggatagcttcagaaaagaggagcctgcaccttttgctttaagacaaaacagaagaaacagaaaaggcctatcaacctagagacctgagattgaaaagataggcgagtacatccgttgagatgctctgggtatttgataatggactctcatatttttacattttctctaactagaacatatgctttagaggggtagaaaccatgtcttacattttccagtttattgcctgcagcatctggctcactgaaggacacaccgtagatgctcagtaatgtctcactgatcagtgtgagaaggaggtatcaggaggagattatcgggggtatctgctgctggagatggttgtattctgcttaggaatgatacagaatagcagacaatcctgaataggaagaatttattgtgtcagggggacaccagggtataaggctgaggccccaatgagaaatgcatgcctacttcctccttctcttcatggaatgagtaattgaacttcaagtgtcaggcattaagcgaagacagctgtggcaatcattttgttaatatatgagatgctggagccaaggtaaccagaaagagaaccaagcctttgagtgacagaaacaaaggcaggagccaccagtcgctgggtccaactagtcctgcaaagaggcagatgaattggctaaatgctccctggaaaacctttccactttactgaaatctgtagtgatgaacttatttcaagaaaagaagcaattgaccaagggaaagggaaagaagaatggaaattatgctttaaaaaagatccatgatgagccagagttcaaaattacttaggagaaatagatgtgtattcatcatatagatctgtcttggaaaggacagaaaaaaagagaggagatagaggaaaaatgagggcttaagaataaatagagttttggctgggcacggtggcttacgcctctaatcccagcgctttgggaggccgaggccggtggatcacctgaggtcaggagttcgagagcagcctggcctacacagtgagaccctgtctctaccaaaaatacaaaaatcagctgggtgtggtggcacatgcctgtaatcccagctactaggaggctgaggcaggagaatctgttgaacctgggaggtggaggttgctgtgagctgagatcatgccactgcatgccagactgggcgaaagagcaagactgtcttgaaaaaaaaaaagaatattcatatccttcacacattttttgatggggttgtttttttctggtaaatttgtttaagttctttgtagattctagatattagccctttgtcagacgaatagattgcaaaaattttctcccattttttaggttgtctgttcactctgatgatggtttcttttgctatgcagaagctcttaactttaatttgtcagttttggcttttgttgccattgcttttggtgttttagtcatgaagtctttgcccatgcctatgtcctgaatggtattgcctaggttttcttctagggttttcatggtttgggtcttacatttaagtctttaatccatcttgagttaatttttgtatatggtgtaaggaagggatccaaaaccacgatgagataccatctcacgccagttagaatggtgatcatcaaaaagtcaggaaacaacagatgctggagaggatgtggagaaataggaatgcttttacactgttggtgggagtgtaaattagttcaaccattgtggaagacagtgtggcaattcctcaaggatttagaaccagaaataccatttgacccagcaatcccattactgggtatatacccaaaggattataaatcattctactatgaagacacatgcacatgtatgtttattgcagcactgttcacaataacaaagacttggaaccaatccaaatgcccatcagtgatagactgaataaagaaaatgtggcacatatacaccatggaattctatgcagccataaaaaagaatgagttcatgtcctttgcagggatatggatgaaactggaaaccatcattctcagcaaactaacacaggaacagaaaaccaaatatcacatgttctcactcataagtgggtgtcgaacaatgagaacacatggacacagggaggggacatcatacaccggggcttgttgtggggtggggggctaggggagagatagcattaggagaaatacctaacgtagatgaggagtcgatgggtgcagcaaaccatcatggcatgtgtatacctttgtaacaaactgtacattctgcacaagtatcccagaacttaaagtatatatataaaaaagaataactagagttttgttcatcttttcataataaacgtgctgatagttccaaagagaagagcctgcaaaaaagatcatggatgcaaatgtggatcaaatacacacacacacacttgggagagatagagagacagagagagagaacgaccaagtacgatgacaagataaaaaggctgattgctgacagaaaataatcaaatcgttctccaattttttgcaaaagagtaattctgacacatttaaaccacagactagcaggaaagagttttcatgatttctgcctctcagaggtctctcaaacagcttttctgatatactgtttttatataaattctgcagtgacttttccctggtgttattagttgtttgggtttttctctgcctaccacccgcttatttatgttaatctgatttagatcttttcttttcccctttctttctttgctgaggctagatttcacagggcaatctgctgagtgacacaacgacaagatgcacatctgtcagaggtgtgagcctgtgtgtgtgtgcacaggggtgtgtgtgcacatgcgtgtgcatgtgtacatgcggggtctaattctccccagggtcggtctgtgagcgcctctaataccctatgtggtttcttgagatttccaaatgagtgaggtggggggtggtattgaggtattgaggtcatcacttataggtaagtactggaggatgtagcgttagctgctgcctggactcaaggattatagaggaattctgggaagctttcatcaggcctcttaaaaaaaaaaaagccctgcctcacagttgacattttattttatagtcacgttagagttgagttcagacttattttgtgctattatagccgattgattatttatcacttcaatgaagaatttattgatttacttaatattcattgctgataacatgaaggatctgtaaattacaaatcatctgggccctcagaaatgcttaattatgccctgcctttcttgttcctcctgtctatctccctcctccccatcccctcgtcctcctctaggcctttatccaagctgggtagaacagatggcccagaaagcgcaaacccaccttgtctgtgatgaaggtgagagcatcttcccaaaccctacaagatggcttgattcacaacactatatttcaacctaggaagcacccttagaggtcatctagtagaatatcacaggcagttcattttaacagtagtcatatattgagttcctaccgtggtaggcttcatccctgtagatggcctggcttacccttgaacaactttatcagaaagttttttctcatagaaggcagaaatttatctcctggagtgttcacctatcatcatacggcaagcagcagctcttaggtaatgaaagcagaaagaagacgcacctcaaacatactgtgtgggcaacaactctgtctcttgcattccctctccttgtcacatctgaccagtggttcatacagatgtgttacacgtgccctagctcagctgaggctgagaggctggctgaagcaggaagaactgaccctctctctacactggccttgctctgatgatgtttgtgccctgaaggccacatctgcctgagggggtactgctgcaggcgtgtggcttttcactgtgggcttcctaatgcagtaggtttcaagcatgaattaggggaaggggccaacagggtaacgtggtaatgaaggagatggcaaagtgaaaagcaagttgctttaaccctgaaagaaagtatttctctagcaaacagcaatgctttgaaagcaattgacagaaagctggcttaatccttgttctggagatacttacagctgcccgtggtttttaattaatacactgggctccctaacaaaggggaggaggttggagagcattaacagatttactcacccaagccaaggaaagtgctttggaagaaatgccctggccgcccatgggccgggatcttcctagccctcccttccctgcatggcaaggcacgaaggtggtctgatgtggattccagggtgaaggtggtttgtcctccagtgtgtgttggccagggagacttccttgctgcattctatctcactccaccccaatccattctttccttccatcatttgctccctcaaccacacatatttattaagtagctactatacacagaccaggcacagtgtgtgaactgaagaactacatttataccaaaggcttgagctaggtgttttaatgggatctaaaaacgaacatgatgctcgtcctcagaaagcttagctctagtgagagagaagcattcagggctgatgttctgaatggcagtgctgggttcttactgcccgtttccattctgattgtatctgttttgattggtcagcaccactgatgccccagttcttaagtatttttaatattaccctggaaacatgaattgaattacacaacaaaatgcaaaatgttaaacgttctatgaaaaaagggacagggaacaatggggccatgttgccttcagggacccattgctgggctctcagggttgttttctgtcattgagtgacacatatgcccacctgcttgcaagtcctgcatcccattcctaccagcttcctagactctgccgcctctctacttcagtcactcatctctcttgttcattcattcattcattcgttcacttacttactcaaccaatgagcacttgctgaaggccaggcatcgagccgtgcatgggaacacgatgcttcctccccttcccaatgcctcctggacttttcctagagactccgctcagctctccttcttactccttcccatggagggatctttctcctttggttagcgaatctgatgtcagagtcattccatctgacaaagtctctcctcgtctgaaactccctgtctcctcatatcttcatcagtccatttccacatgtctagtcattttaatggcatatggttccagggggaaactccaaatgagggaaaattagcaactgtgcttactgggctaaagaaaatgactggagaggaagttttctttagaaatatccacaagaagcagcagcccaaggagacgtgactccagtaaaaatgatgatttttgttaggggtggtagtcggggtggattatcaatcgcattttctttcccctggaatgtgtcacagtcattaatttgtttaatttatttttgcctcttccctagtgaagcagcccaatccaccgtctgcctacccatcagaacaaattacactttggaaatatccgagtgcttcagttttccattaaatataataagaaaccacaatgcaccgttatggcctgctgactccttgccaaggatctacaagcactttttacaaccgctgccaggcaattctggttgtcacccttggtgacacagaggcgcgaaaacaggtccaggatcaccaggccctgttttaatttgcactcgtgtgcacgcctcttgggttgtgttcttaatctgcttcacatgcacgcgatctgattctgcagcacagttccaaagtcttcatacaggagacacatgtcctgcttctatggtgtctccccactgtgccagagccaatgactgctattgactgatgaattaacagagttcagccctgtgaggacacagctagctcgtggctcatgaaagctggccttccaacttccagcctcttctacacatcacaaggctcaaatgctcatctttcttcttcctctgactctctggctgctcccttataatcagccattgctcaggtcgtgaaaactgctcatgactgcagttcagtctgtcctaaggaacattgctaattgatgattacatttcattttcaggatgttatcttacttgggcaggttggaaattgaaatgtccaggggttacacatatggtatatatggctctttcaagtcagagattaattgttgagtattaatatttaattttttattgcaaaaggcttgtcaaaggctgccacgggaaggtgagagctcagatccatcctacctgatattcagcgtcctcaagaatagagcctctagcactgccagctctgcaatttctaagtcaaagaaggagcagtctagtgagttggactatggcagtctagtgagttcttggatgggagaagtttctaagatgaaggaggcagggttggacgtgttgtagggagtaggtgacctgttgagtcagtgctgacctctgcctggacaggagagagctctaaggtcaggtcaccttaacatctgtgtacacagacagttaggcataggcggagaaccagatgtctggtgtcaacagaactagatgtctgaagacctgggtttggtgccaactttaccattcaccaacaaatcatctcaaggaacttctgttttctcttctgtaaaatggtcagggtgccatctatctcaagggctgctgtgccattcagtcataatactgttcaattgtgtgttactttgcagttttcaaggcacaatgaaaaatggggatcctctatcatcttgaaagccttacagattctgatgaggtcaggtggatcgaaattgtagctttgttgcactataacaaagggttactaaaagagttaaaggagataatgtatgtacaacacagtgcctgacactcaacaaatgttaactgatttcttctagtagttgcagtttaaaaaataataataaaaggatgtctgggagtgtgactatgaaagaataattgtgtaattgtgaccattagttaggcacaaagacaggacattggaaacatggagatgtccccagaggagcccagatcctaagtgagttacatagaattaccctctttctgacattggccaagtgtctataagaggctcctccatttgagcccaactcccatcctctggcccaggggggccctttctcatcagccacattgtgtgatgaggtctaacagagacccacattcaagatcctgagactggccagcctgacattcagccacactcagcacttgggtcagccccatccctacctgggtgtgttcactcactctttcattctatccagggatatgcctgcctctttcactaaatttgatggtatgaagtggtcttcatttgtgaattcatctacagtgcctagtgcagtgtctttcacacatagtttttctgcttaatcatgataacctgtgcacataaaggcactcaaacactcatgcaaagcatccctagcaaagggtggttagtgtggttttggggatatttcctataaattagagcatttctcctactttttaatactttcttagtcttctttgtcccttcttcctcctctaagtgccccttgtgatggttaattttatgtgtcaactcgactgggttataaaattcccagatatttggtcacacattattctgggtgtgtctgtgaggatgtttttggattagattagcattttaattagtagactaagtgaagaagactgctttcctcaatgtggatgggccccattcaatcagttgaaggcttgaataaaaaaaagactgacttctctctctctctctctcccctgaataagagggtactcttcctatctgatagccttgagctgggacaccagtgtttccctgcctacagactctggctagaacattggctgttgtgccagcttgtggactagaacagctcttctgggtctctagctttccaactgcagatctggatatttctcagcctccatacttacacagaccaatttttaaacagtaattctctttctcatctatctgtgtatctatctatctatctagtctatctctgtattatctatctgggataaagacacacatgtgcacgtgcatgcgagtgtgcacacacacatacacacacacacaattggttctatttttttctggaaacccctgactcttatacccctaaatgttgttgttgttgttgttgttttagccagggttctgtcttagcattttcccctcactctgcatgctatacttgaataatcccactttcttcaatggctcccaagaccacacttatgttggaaaattccaaatgtttctcatcactccagatccctcctgaactccaagatacaacctcatatattcagccatcatctcggtattcctccttagatatctcaatgttctcccgaatcagcctgtccaaaggagatggcagcactctctacacaagcctgccttttcctcccctgctcctgatttcacaccttgccctacctttcactcattacccaacctgggggccacctcttctacactctctgaatcccattagtcctccaggatgtggactgtgcctccaggacccctctcacagctaaccccttcccttaacggccattagcactgctatagaccacgtgtcaccattgctcgtactcactgcacatgtttgtataagcctttctacgctggattctgtactccttctgggtaggaatcctcactgatccactgtttattgtttttttaatccctcagttctcagcaatgtacttagccaatattagatacttagcacatgactgacatctgaatgaatgattgaatgaatgaatgacttcccttggaagtccatggggtatagggaaggaggcagagcatatgataagaacttggcctgacgcaggagacaagaaacagaaatagaagtcaatttgtttgccataaataaataaaaggcaaattctccttgattaaatttgaaatgaggaaaacagaaacaagcagttatcttaagagcagggtagtttaatatcctaactacctaccatgggataggacaaactctgctatagaaggtttttgttttggggtttgtcattttcagatatccagccgaggacactgaaccaaacgtagtttttctaaagaggccctaggttatatttaaagttctcccagtgctcactccctgggatcttaagactttgatttaaaagacaagcacagagcaaaactcctgaagatcaattaatctaactcatcaagacggatctgatttgaattgcggttccaggcagcaactagtagtccagagacaagactgctgagttggctgatgggtagagagagcacagcctcaaataccctgcaaaatgccagacagaaggctgacaactaagcaaaaaattcagattttgtagatcttacttttgaagaactccacccctctcttttctttcaactatttatcaatgtatttttttttcacttacatgcacaccttgttttattgtgctttgctttattgttcttcgcagacattgcattttttacagcttgaaggtttgtggcaaccctctgtccagcaaatctattggaaccatttttccaacagcatgtgctcactttgtgtctcacattatggttattatcccaatatttcaaatactttcattattattagggctattatggtgatctgtgatcagtgatctttgatgttaatattgtaattgttttggggtgccacaaacacaccatatgagatggtgagcttaatcaatgagtgtggtgtgtgttctgactgctccctcaaccagccatttctcatctttctccctttcctcaagcctccctattccatgagacacaactatattgaaattaggccaattagcaaccccacaaaggcttctaagtgttcaagtgaaagagtcgcatgtctgtccctttaaatcaaaagctagaaatgactgagcttagtgaggaaatcttgttaaaagctgagataggcctaaagctagacctcttgtgccgaatagtcagccaagttgtgaatgcaatggaaaagctcttgaagtaaattaaaagtgctactccagtgaatacataaatgacaagaaagcaaaacagccttattgctgctatagagaaacttctggtggtctgtatagaagatgaaatcaaccacaacattcttttaagccaacacctaatacagagcaaggccctaactgtcttaaattatatgaaggctgacagagatgaggaagttgcagaagaaatgttggaagctagcacaggttggctcatgaggtttaaggaaagaaaccatctccataacataaaagtttaaggtgaagcagtaagtgctgatgtagaagctgtagcaagatatgcagaagatctagctaagatgcttgataaatgtggctacactcaacaacagactttcactgtagatgaaacaactttttattggaagaaggcaccatctaggtctctcatagctagagaatagaagtcaaggcctggcttcaaagtttcaaaggacaggctgtccctctcattatggactaacataactggtgactttaagttaaagccaatgctcatttatcattttaaaaatcctattgcctgtgcagagtagattggaacaatgaaggctgaaggacagcacatctgcttacaggttagtttactgaatattttaagcccactgttgagaactactgctcagaaaagaagattcctttcaaaatattactgctcattgacacttaacctcgtcacccaagggctgtgatggagatatgcaagattaatgttgttttcttgcctgctaacacaacacccattctgatttctatttcaaatcaaaaagtaattttggctttcaagtctcattatttaaaaatacattttgttgaggctctagctgcctcagatggtgattcctctgatggatatgggcaaagtaaattgaaaacctattggaaaggattcatcattctagatgccattaagaacatgcatgattcatgggaggaggtcaagatagcaatattaataggagtttggaagaagttgattccaatcctcacggatgactttgaggggttcaagatttcagtggaggaagtaactgcagatgtggtggaagcagcaagagaagtagaatttgaagtgaagcctgaagatatgaccgaattgctgcaatcttgtaagattttagtggatgaggagttgcttctcatggatgagcgaagaaagtggtttcttgaggtgaaatgtactctcagtgcagatgctataaacaaagttgaaacgacaacaaaagatttagaatatccaataagcttaggtgataaagcagcagcaggatttgagaggatggacctaaattttaaaagaagttctattgtgggtaaaatgctgtcaaacagcatcacatgatatagagaaatctttcatgaaaggaacattcaaattgatatggccaacttcactgtggtcttattttaagaaattgccacagccactccaactttcagcaaccaccaccctgatcagtcagcagtcgtcaacactaaggcaagaccctccaccagcaaagagattataactcgttaaaggctcagatgattgttagcactttttagcaataaagattttgtaaattaaggtccataaattgctttttagacataatactattaaacacttaatagactatggtatagtgtaaacataacttttatacgcactgggaaacaaaaaaaattgtgcgatttcctttattgcaatgctcacttccttgcagtaatctggaaccaaccttgcaatatatctgaggtattcctgtgtttggaaagatctagccaaataaaaaataaccttttatagcctaaatggctgagagcactgataaaataatggagaagacaggaacagttgtggaagagatctagccttctaacacttagtttcctgaaataaaggaagtgttagccttctcccttgccatccttcaccaaacagaacacacatacacacacacacacacacacacacagacacacacacagacacacacacagattcttgaaagtttggaagcactgatgcttgcaaataggcccattaaaagaagataaatcaactggaaatgcataaaaagtctcatttatcataagacgtgttggacagggttttgagttttacatacatttattctagaaatctgtttatctgtgcaacgtttctgaacaaaatgctttgtgacgaaccatcctctccacttgaatctatatggaaagcaattaagttcaaaccccgaagacaaaacatgataaacacagcaggcatgctattgatttggaatttcacaactgcccttcttccttttggatatcatctccttataccccaaaaggcctcctatacctcctacacttatgaaatgtgtttcttacgtcttcagccaaggcaacttccctgactactccctgaggactacaaacaatgagttacttcaacatgtctggagatgattaacctgaaagtggttaaaagtgccacccctggagtgaatgactttcctcagcccagccaggatatgactccaatgccaaaaatttgcacatgtcccatttccccacctgcacttgtccataacggaagagggatgtgtatttgagcgaggggaggtacagaaaaaattagaaagccactcaacttatccatattacactttcaaatcccttcagtgcaagggacctatctcatgaattttttcattttccatctctagcaattagtgggcaactacaaggtttgagaaagagaaaaacttcatctgtgcacagggcctggctcagtagtttcttaataaatattcaatgaacagctattgaatgactaaatctgtacatacaaagcagaggattccagcccagctgatagactattccagccatattcataatctggggtgaaagcaacacatctgttccatcatgaagagtgttattgattagcatggtcagattggtgtccactgtctgacatctgcagacacaggctgggtggcatgtgggcaacacccccttctcccccatagatagatagttttagctcttcagtgaatataattgtcagtgtgacagactctagtaggagtttgcctagtctgcactttattccatgttgggtaggtcctcctagaacccctcctccaaagaagagaaataagaatctaagatcaggaattctcttagaaacactacaataatctctcctcagcatttctgcacaaatgcccaggggtacacccagcaacctcaccccctgagggcctgccaacagcttgtgctacaaactcctgcaaataggatttattagaacagaatcaagtgacagactcagaacgaaggcagcacagatgaagaagaccctgaggttctatgcagatgttgacttttatcaaggtcaacactgagatttattgacccaagaggtaaatattgatggaggctcaggaggtcaatatttgccccaaggtgaataaatcttcccaatgaccctcaaacagaagtctgtatagagtagactcagttcgaaaatgaattagctgtgacatagattaagatactatttcattagattgtctagggcattggaaagcaatattaatactaagcacttcatgttcaaagtactttccaaacattcattaaagtgcacctccctctagcagatgcataaaagtgttgtactcccaactcaacagatgggatattagagccaagaaaaagttaagtaattttacctaggccacagaaaaagcggctcaagaacagagagataaaatggagataagtgtgagttaggagctctggggatgagcaaaggtctacagaacagtgtcttaattaacattcctggtcaaattaataagtccacttggtttgattactttcatttagttaatttatatcccattgttcacaaatctacttaggctgttcaattgtattgcttatttacagagatgcttttcggcatttacccatgataaactctacctttggacatcggtactcaactcttaagaagtgaagagtgtgttagtggtcactgggaaggaacagattggtttatccatgtatttgcataatcattatcatcacattctaattctcatacaatacctcttctcagtaacaagatgctggtactgagaaaccagtatcctggaaccctattgtgaaagactaacacgtgcgtcattgccatttgaattcacggatccagtgatccctgcttttgcattgtctcaaaactgagctttaaatattataaaattttggttctttgctgatggagaggtcagagccatggataatcgaaacctcagccaaaagaagatcaataaatattatttccttctgactttggagtgcgttattttcccgtgttttacgttggccttgttgtttttctctggagagttaacatcagaaaagagtgagtgcttccagagtgccagcgatgatagccagacaggtgacagaactcgatgtgtgtgggtatcaggtcagcagctttgaggttgtgccatgtaatccacaggtaggtacttgagtggactggcctcaacttgtagaatttagagttttcaaagttacttcaatctactttaaatctttggaaggaacaaatggggtcttgagagtgtgaccatttggttcacttgaaaaggaaacaatttgacttgaagagatgtaaatggttagctgatgccagggtctgaggaaagaatttaggaattttgaccccaagctgcttagatacctcattattttatcctgcaataggattttggaattgtagctgttacccagataagtaagtgataccaatatgatctgatactgttacaaacggtaatttgactgacaataaggtacagacaaatgaaagtgtttacagggtttaatatttaataatgtaaaaggaaaaagtcggcaaaagcaggctggagatgaaaagatctgtatcgagtcagaatttttgccgattgtcagagcagcatgcgtctcctggggacctgaataagcaagctgctgttctgcagaaattgttatcttgggcgtattgattgagtgtgcaccactcaagctgtcagtttctccctcctatccttgctttatattttacatcatggtatcctcctaaactctcacatactgcctggccttcacactttaggccgcagaaccgtggtgtactctcgaaggagacctaggtggtgtgcctgacgtgttagttctgtctgtgaggagcatctcagtgactcttctctagggcatactaatgggctcattctggaggtggctgggtgctttgagtctagagacatgccactggcccttctcttaactagcatggccaagataccaacagacttgctccgtggacagttacttaacctgtatatgcctcggttttctcatctgtaaaatgggaataatgcttaccttacagaactctcaggaagataataaacctaaaacaatcagcacactttctgacacagagctgtcctcagtaaacaagaatgactgttatttattaatgcagtccacagaaatctgtaaattaaataagaaactgtttagattgcagaagacctagccctaaacccagaatcccagaattcttgagcgagaagggcatttgagaggtgatcttatccatctacctgccttctctgtaagcccagagagctgacaatctctttactttcaaaagccattagaaatgactctgaaactttctctgacccggagctcaatgtttgtacaacctgacaatagcttgagtagctcaaacacctctgacacctggagcagagactggaaccctttgtccagctcttcctctttgtgcgtaacactgttctatttctattagcttttcttcagcaattttactttcctcggtgctccttcaccatgcccgcacatccctccaaagagcactgcaagttctaacagcccctggaaccttagagaacaggagagcaccgtgctaatgagaccaaagtcaacaggttgcttcctaccagggaataacttcccacagggaagatctgccttctggcctccaaactgcagcctttcacttcaggagctgccttgcaataataataatgatcacatctaaccttcaggtgcccttttctatatttgaaaaatctccacatctcagctgatcttcacagtaaccccgagaaatgccaccactggacttgttacatccatctcagagacaaagaagcaaccgcagagaaatggccaggatcgtgtcctcagaatgaggcaatgttcactcaagcccaagccttctgaaagtgagccctgggctctttttcttcacattacacagcaaatgaaaatggtagtggttctcaggtgggggcgattttctcccactccctccctgggtacacttggtgatgtctggagatatttttgcttgtcgcagctggggagggggcttgctacaggcacatactgggtagctaaacctcttacaatgcacaagacaacccctcacaacaaagaattaccctgcccaaaatatcaataatgccaaggttgagaaatcttgtcagatttatagtaagaggacaaacaacagaatccagccacctgactaccagccaagccctattttcctgcctatcttactaggccaacttgcttcccccaaagaaacttcatagacatttgcaaaggactttgggatactcagaaaaaagttaatagctaaatgtagagttgttggattttgtaaagctgttggtaaagttattttcattttgcttttcaaattagtttgggagttggtgttcttctttacataattacaagctgacaaacatgcttctgtattttttttaattaacagatatatgtattcaagttctccaaattacatgccacagcttgcatattacaggacagctgccatgctccagatgtaggcaataaccagaacatggtaatggcaaaatgcaaaagaaagaaagggggaagaaaagaagaaaagaaggaaaggctaatgtatcaggacggagaagagcaatttcaatcaatgggtttggattttttacagagatgaataccttagattctcccaaattttcagctcagtttgaacatttgggatgaagctgtctgggtcattcattgctgccatcaaaggctcaccagcgccttgtaaaagcagattacagatgaaatggggcacatataaatgctaacagcgtgctggagaaactattcaaattgctcctgtttacaagtgccctattaaatgtgctcagctcctcctgaagaaagctgctctaagctgggtaaactgctatatttattttgcccatttataacacggcagccccttttggtcactcaatcccaggtgcaggctctgtctggtatccacaaatcaggaactctacaggatggggctctgcagtgagaaaggggcaggggcagtagatgaaagtcccagtcccacacctaccaactagcttactgtgtgactctaggaaaaggactgtacctctctgagactcagttccctcatctgtaaaaaacggggcatgactggacaacctctgaggtcccttcgactctccaggttaggagtggttacatttttgagtatctctgcagatacgggaaaaccctgcctctccttgcatagatgtcagaagtaacacttcaggcgggggcgtctgaggttcgcgtgtgagggaatcaggtgcattgcacagtcatctcctgctcaagacagaggagggcgctcaggggccaatcaaacgacttctaaaccgcgaaaacaggcctggggcaaaagagtccgtagataccgcagtcaaggggcgattcactccatttactgacacaatagacatggagtgcctcccatggacacagggaatgaagggatagacagatgtcctatctttgggaatgctggccttccaaggagagagttgtccactggggaaaacgcctgggcaattccctgcagtgtggcaggtgtgaaggtggaggtaagtttggggtgctatgggaactcagaggagggaaaaaagccactgaggaggtgacacccagcggtatctggaagaatgaacaggtgtgaaccaggggaagagggagtaagaacgtctcctgagggcggaggctgtgggtagcaatggagcatggtgtgttcagagccagccaagcaatcccacaggagaacacaagaaatatccccacggcacagcctacccaagtgaataaggcaggaaagacctgtgagaagtgaaaaggctcgggtgaactgtgatggtagccatgatgcttttccacgcccttgatgacacaggcttatttgaataattttgcagtgggacctggctcacttttgtagatcccttcaaagctggagattggtgccttccgggattctgccattgaaggaaggaaaaaggtagcagacagcctttcccttctcttctcctttctctctactctgcatggaaatgcaaaatgctggagtccaaacacattcataaaataattttgtagggctggtagttagttccagcaaaaccattgaggggaaacaaaggaagttttgtgttaatgtgactagtgtatgactctatctgagttaagacaacgcaatacgaaagaaaatctggctaaaattagccttcttctaccagtcacagccaagctgccctaggttgtcacctagggacggaacaggaaaatgcagcctctctaccactgcccctgccccctcagggatatatcatgcatttgaaaaattctttcttctttcagtttttcgctcttcacagctcagttaattccacttaagacactcttgtttccccgtatttttactcatttcctttggtttcctttttgtttttcttaatttgagctttctcaggaagttctcttcttttccttcttttcttccctttcttttctctctcacattatcttgtttatgaaacactgctctttattaaacactacattaaacacaaataggtaggcataaggttaagtgatagttgtgccaataaacagaagaccctaggtgtgtagcgacattagacaaaaagtaaccagtaccatcaatctttaaaacccctacagtgccctgtcaaccccacagagggtccagaaaaaagtcatgaattgtaccagtatattgtcatctaaggaaatctgatttttattaagtatcaaatcacagaacacgtttgcttttacttttgtgtactcagttaccgaattgctaatgaatttactaatgttgtgatgggattttttctattatatgtaaaatgataaacatacagcatttcaaccacatccctagttaagtaaaattttgtgaattagtgaaggaactccatttaatttagaacattgcttccatgagaacaaggttttcctagtttcaaataagtgatatctaaggacccatagaaacacttgcaaattaggatccaatgaggctcacctgctgccaggtatctacgcagcaggagaaccacaaacagaagcacatggcggtgctatggcttctcccccacccaccagtctcccttacagtagctgcgaggtgcacaggtagttttaggatttaacatgtttagtaaacattgcttttccattttccttttatttattgttccccactctcaacagtgtttgccttccttcccatctcttgtcatttccctcaaagaagcagattcttatttaggtggtttttgactatttacgagtacaaagtattatctacatttctgatgacatgaattccagaaacaaaactgaataaacattatgaaaagggtaatgtttgggaggttaaaccattagtgaaaaatcatcaaggtatgcttctgattcttgaatgaatagaggtgacagaggcaactcattcagtgccccagttttcccagctataacctgagaataatgatctttatctaaaagattgtaatcattacaaattgcttggaaattctgaagagataacagctaggtgtgaaaatgagagttgtagaaaccactgggagctggacagggtttttatgttctgttcggggtgttgtcttcccaggctgtcatttgacctttggcatcattgagtctctctcttactgagttcggcacccataaaaatatgatcacattacattaactcagcagtcctataggagagtgagttcctgtcgtgagagcactgaaaggaaccacagaaatgaaaatatcatcagtccgattcttcactttgggccctatgtaagatattattagggaaggaacttgtcataaatcgtctgtaacccaaattagcaaagggcatcgaagacggtcctctgaatctttcctatagtccattcaaaaagcttgcagggaagaggcaggaaaatcttgcttattttgattcacttgcattgattttccaaataagcctgttctgggtgacttgggctgagtgcttggtacagaaaagatgacaagcaactgaactcaaggaggtaagagcaatgtcagaaaaatccattcagtccaggatagacagattagtgtttgtgaatttacatggccctttatccaattcataactataaacccactgctgcagaagtgacacacaagctcatctgatttctcttgtttggaaagttgaaatctccggatgagttagagggcatgatgcttcagtgcctttttcactggaaaatatcacagggtaaaatgaatttgtacattttccctagacctggtgcctatgcaagagggtctggtagagagagagagagagagagagagagagagagagaggactgtgcatacacatttccacacacactgatctcccccaggaatcagggtaaaagtctccagatgtgtcagggtggatatttgctataccttttggcttcctagattgggggtaaattattccctctatgagtctttgtggaaacaaggactccttcccactctatgcaaaagctgacaaattccaatcttagcttttccagcctcccttgcagctagagtgcaagccaccatgattccgtcactgctaatctgacccactttccaggcccagccacaggacttagtgatgctgagaaaagggtaggccaatattccttccagcagagctggctgctgtggaaagatcaacacagtcacgttactgaaggagcaggcattctgaccacggtctgggatattatttaggccaccacagagcctggctcctcagctcttctgacatgcccaatgttgttttccatttaaatcagccagttggcttctgttgcttgccattaaagaccctgcctgacaccgtgtccgtatttgattgcgtgtatgccacatgtatgtacacacaccttctcttccttccctacatattcttctttccttaccttgatcaatgttatggtgcacctagctaaaaacaactgcagaggaataaaaaggaaaaaaagtcattttttcattttccgccatcgtgcacataaaaagggacagaaaagaacgaacaatgtgctgctctggttgagttgatagccttaaattctactcaccctttcactcaaggaggacgccagccaaagtcaatgggaattatatttgtataactaagggcattgctgaacccagagagactggagaacaatttagcagacaacttattccactgccaactctaagttttgaggaaaaaaaaaaaaaaaaaaaagacagaaattgagtcccgaggccaatctgcatgagcatgttagtcacgggtttctgaataacaggctgaatggccctggcatacaattccactcatttttatgctgagggagtcttcttagggcttctatatcaccaagattacagtcccatattgccaagttcaagctgacccaaccaatgtagacttagcctcaggggccaccattcagttgcatagagagctgcctaaggcatgcattccttctctgtgtgaaggccaagggactgcaggggtcaggggaatcaagtcatgaggggataaggtcaactacttggaagtgatgaagagttctggctgctgctgaaatcattgttcagagcttaggtctagatccatttctgttacagactatcatggtgaccctaagaaagtcacttcacctctctgaatctcaagtcacttgtctgtaaacagaactagcagaaatggcgtgaatttaggagacagaaaactcaacttcagaacttcagttttgttatttacaagtttgtgatcttgggcaagcaactcaatagcatttttatttcagcatctgtaaaacaagaataataatactttttacagagtttggaagaattaagagtaatgatatacacaaagtatgcactacactgcttggcaaggagggactcaataaatgttagttgcattcattcatccattcatcaaatatttattgttgctcccactgtgccaggtactattgaaatcctgggaatatagcaatttatgtgacagataatgtcctttccttcccttgtggtacttgcattttctctccctaccagaagagtgagattcatgttccaagggcaagactagggctcatgttttctttagttgtcctgtgtgctccctgagggcaggtgccacatctagctctgctttctgtgcataggaggtactcattgcacgttaggggttgaattcagttacataagatgcaaaatattgcaaatgccatctccacaagtaaaacatttaaagcactttatgcaacatgcttccacagacttgtccatctctttgtttcaaatgtttactcctcttttctatagagctcatcaccatctttcctttcctatctagacctctctgacttcattatttctgtgctgtagtcaaataatgttttcaataacagtcatgcatcacttaacggagatacgttctgagaaatgcattgttaggggactttgtctttgtgtaagcatcatagagtacacttacaccaacttagatggtgtagcctattacacacctaggctacatggtatagcccgttacacacctaggctacatggtatagcccgttacacacctaggctacatgatatagcccgttacacacctaggctacatggtatagcccattacacacctaggctacatggtatagcccgttacacacctaggctacatggtatagcccgttacacacctaggctacatggtatagcccgttacacacctaggctacatggtatagcctgttacacacctaggctacatggtatagcctgttacacacctaggttacatgtatagcctgttgctccagtctacaaggtttggctctatcacccaagctggagtgcagtggcacgttctcagttcaccacaacttctgcttcccgggctcaagtcttcctcccacctcagcctcctgagtagctgggactacaggtgtgcaccaccatgcctggctaatttttgtatatatttttaaaggcttaatgtgacttatttatttatgtatgtatttatttatgatggagtcttgctctgtcacccaggctggagtgcagtggctaatttttgtattttttgtagaggtggggtttcaccatgttgcctaggctggtctcgaactctggagctcaagcaatctgcctgcctctgtctccgaagtgctgggattacaggtgtgagccactgcgcctggcctcaaaacactattattatcttataagaccaccgtcatatatgcagtcggtccttgaccaacagctatgtggcacctaactgtattgtacttcttcaactgagtggtaagaatgtgaaaatcctggaggtcaccttagttgaggctttcttccaattcagcaaacccctttatgtcatctctgatgcactattatccatcctccatgtcaagacagctgtgaatagagggttgactgcccacaaggcccacttacttcatgttcacaaagctttcattcttgcaaggttctttctcctacccccctgaaatttccttaaataagtatttgctgaccacctactgtgtgccagaaccatattcacaaccaggggtacagaagtgggactaccagtattcctaccctccagtagctgctagtccagtggaagatttgttgattagaattctgctctctccacataaaagaggcttgttatataactgaggacagttatagtgttctcttctaagccagttttctttaagaatgacagtcacctgggatggtagttcaattgcaattttctgggccctcctggaactaattaatcagactctctacaaatctagggactggagcagctagaatcttcaagtttaaaaaagcaccccagttgattctcatgcacaataagcctgaagaactcctaagtcttgcttttctgccttaataatgctaagttcgctaagttcctcccaccttcctcatattacataattcccaggtttttcttttccctccctccctccctcccttcctccctcccttcctccctccctccctccctcccttccttccttccctccgtccccatatccaagctttcagtatatgccccagtttgtaaatggctaaggtgtggctctcaggacagagcatacccattccagatgtgggtcacatcagcagagggtgccatgggggtgttagcatcttccagatgaacacatcgctttctacagaggatgctgagaagcacattatttgtcaccatgccacattgttagctcatattgagatttcaataagataacactcctccaattaagaccctgcaatatacctgacagaggaaaatttgtttatcaaatttgtgaataacacaacatcacaaaggagagacagattatgaaattataatgacatattatttttcttaaatgagatgttagcatcacttgcttttagcaagccaaaggttgcttccagggaccacagattattttctgagtgtttatgaaccgttacattaatctcctgcagatttttttctggagatttatatgtttacctgtccactgtttctgaatctactgtcatctacaattttacttttttaaaaagtgtgacatttttccagactctcctattttgcagtatttcttgactattattcacccagaatggtaccaggatcatattttcaaacggtttcagtgttctgggaagttaattttgttgaatctagtaatcagatttgttttaaacataccataagcatcatcattattatagtgatagttaatatttattgaatttttctatgtgtcagataatatgctgtacttgcagcgtatcatttaatctacttaacaaatctatggcatacatactcttgatatgtctacatcatagaagggtaaaggagaggggaggttactactggcataaggttattacttcacggtggagctaggcacttaatccttgatctgggtgactctaaaccaccaacttgtatgatctcttcctgtcacatcccctatctcaagttttaattccttctcaattcagctgatcgtccctcaactatgaacagcacgataggaaagagagtaccaagagagttaagaagaagttctctgtaactgataaacatcatgctgcatttcccaaggaggactgccctttttattcttcttccttcttgaaacctaaaaaaatctctcttttccttttttctttttctgcaggcttcagctccttctgggtcttagtgtcacttggcacctttgttacaggctcctgcacctcttttgtcctcttcttctgccaggtgccccgcctgccatcttttgtacctttttttcaaaactgagctccttggagagtgtctgcgcagtcaggttggtttcttcggatgctgccgccctttccttcttcatcaggatcattcgtttggtgctgtcaaaacactgaagctgccatctttcttgagccacctttctttttcatcacccagcttttcatattgtttattttctactgcctctggcgatgctcctgatcctccaggatcagggtctggccatgcccagtgtcctgtttttattatgaattcctaagattagcatccactttctttcgagattcccattatattaattcaatcattcctgtattctttcaacaagcatttattgaatgcctactatgcacctgtctatttcatcaggtttataccttgttggcacaatgcctggcacatagtgggtgttcgataaatatttgttgaaaaagtgaaaatgagttagacttgagcccagagtgacagagtcccttattgatttttccccaaccttctgaatgatcaagctgcttgtaaggcaattaaaaagtatgtcaagaacactgtttcagcaggaccagccttccaaccagtgtctggagagctgaagttgtcaaccctggctggaactggctcctgtgcctgatgtatggttgatattttggatcaggaaagagcatcaatttcctgtgtaccacacagtcagaggcatccctgtctcctttttcttggtgtcctcactcagtttctgggcacgacatgtcccactctccattgagtggatttctgtagtacgactctgctgccagtctactgacagcctccttctccagcacggcagcccaccaaaagtgcctccttccaagcctgtggccacaagccccagggataatggtcagcacattgtggcgttggatttttctgctacttaaatttatgatgatgcagggcatgcaggtaatcaattatgcgattctttcagggttgcttctgcccttcctcttctccaacattttctttgaaaggtgaccctgctccacttcctctaccaacattcttcctgtgtcagatctgtcctcccctgtggtgggcgtgttcttcaccttcccttcaaactttagccaattaggtttcctccattcttatgtgtggaacctctggaatgaacctgcattcttttctttgttaacccaacccctggcagcaattatgtcctaaaggaaagtcccctggtaacctcaaacaggttgctccctctatcatccaatatattcttgtgtttacgtgccctggccagaaagctttttggcttccaggtctatgcccagtgcattcagccactgatgctccttggttctggccacgcccagctccgtgtgggtccctgagtggtctacgttctcccatgcttcccaggctttagcacctgctactccctcttctcctcatcccgctctctgcccattttcttagctaatgtccactctgccctggagctttgcttcatggtgggagtttctctgagctctgttcccccaaggtgggctaggcaaccctagtgtctgctcccacaggagctaccatatgtggatgtcccctgggtccctacctctctgcacccgggatgcttattctcttacctggcttccctgttatgccctgtgtccctgaatacattgaggtacacctgcctttctgaaagtttggcaggtttcccagtgtgtactgagaaaacaacaagggttgccagaaatgggaaacataatttcaagggggagaatggcaaatgtacaactctccaacaaaactgaactcccaaacacagtgaaaagcgcaaactctcagacaaacagctattaaggacatagagtccgaattcacccggaacaaaagacccgtctataaccattatttatcactcagcaaacactctctttttgttccattgtcaatgctccacagaccacatctgcctttgggcagaggggaaagagagaaagggagagagaaatgaatagaaatgagagtatgagtttcattttatttatttattttacatataaatcagctaatcggtttaacattcatattaaagttgtaatcacctttgcatacattaaaatacaaactagcacaagtaataggccttaagaacaacattacaatagctattaacatataacagctaccttatcaacttacaacatccctataaaataataactgcatccaggattgatttgcgggaaattcattctcccagagcactgaagcctgactcgaagtctggggaaggtgagagtctggttgttctttggctgacgcagagaggtggctcttggggagtgaaggacaccagaggcggagatagaggcttgagctttcgttttggctctattatccactagagagatgacctggggaaaatgtcttaacctcactaagactcagtttcctcgtcagcaaaatagaaataagggtgtttccttcatagtgtttctgtgaaaacttaaatgaaatcataggagaggacctggcctttgtagcagatgcttaagaaacgtcagcatcttttcaagaaaaccaggtgctcttagagggtgcaagggctggaccagaaggatgctacttagaacataatatggtatctttcccattcattcatttgctcactcattaaacatttgttgagcactgtcagagatgatatgaaaaattttaaaacattagagtttctctccttataggacttaccattgagttgggaaaatatcaagtcaagaacaagctggacagaactgaacacatgaaaggatagaatatacacattatgtcggcagagaagaaagggcagagtgactgtgagtgggaaacaggaaatcactacacagagaggtaacctttgagccaagccttgaaatatgaagcgtatttcagtaaatgatgaggaaaaggatattttaagctaagggaacagcataagcaaggatacaaaggcatggcatatccagggaaaatcaaatattctttttctggtggaagcttgaagagcaaggagggatggagaggaagatgctggaaagagagatggtgccagacagaatgaattgatagaacaaatgcaagtatctacagattgtaggggaccttcaaagctgggtaaggatggaggtgtcagataccaagtgaaggtattggggctttgttttacaggcaaagggtagccagtgggcttgctgagaaggggaggagtaaattgtgtaccctatgaagatacaagtggtaatgaatgacaatggtgaagggtgactgtgagaaaaaaaatcgaggaacttgatagggtgctataatagttttggagaacatgagtagggcaatggaaggaaaaatggaaaggcagtatagatccatgtgaaaggcaatagagattaaaacgtgtcatgacaagagaactaattggttatgggagatgagaaagaggctggtgacttggcatccacactaagtgctgggaatataggatgctctttacggagattaggaccccaattggggagaaaataatgagtttagtttttagaatgttgttttaaaagtgatactgggctacatgtgagagcatcaccgatcaggaaaatcaacaactcacaaatatattttcattgttactctcagaattagccaccagaatgggtgctaggagtgtgaacgtggaaagaaccaagattcagttaggacacaataaaataattttgagatcacttagaaattttcatcctcagtacttagcaatgagagatggtatacttagatctctgtaccgtggactatcattattcaatttaaattgctacaaagtactattcttacatgattggcctgaaagccttgatgctgagttctagatatttgaagcctaataccacaaacgtacctctctggacaaactgtcacctggatttttagacaaaagaaggaaagcatggcccgttggaccacagcaagaccttcttatttttgcaagctattctattttatttgttcttagtgttcagcctgggacctaggcaggctacagatgttactgctgatggctgcagtgaccagtatcaagtgatttcttatgagaccctgaagaaggaggctgatggccattgggcccactgacagcatattgcctaatcgccattattctggaggaaaatgctcaggaggtgttatatgtggtgtagcttaggattccaggcagaagacagtccagtaccttcctaagtcactaaggaagagctaaacacatggtccctgtttcactgaaatgagatctgcctctaccacccgactctatgaagcaaaggcaaggaggtatttcttaatctgagaagacatcttgccttttatggcactgttaaaaccacacatttgggtgtcggaggaggtctcagccacacatgctcagggggcttttatcaatgcacccccatccttggagtaggttcctgagcttggtgcctggggaactggggaaggcccccgtttctaccaaagagggcctctctccaaggtgcctcccagctctaggcctgaggtttctgttgacagtgcctggaggagccatctgagcttctgtagcacacactcccttgcttgggggctctgctgggatgacagcctttaaacacctcattaatattcaaatctattcaagtcatttcaatttgaattctatgcatattatcagatagaacaaatgcaaatatatacaaattcatccatatgaagaaataaataggggaagctctgcataatgggattataatcattctcaggcttgtctctttcttttaattccccagagcccagagatccagacccagcctcaatgctcccacctgcaactgtttaacagcaactaaacctttcctggacacaggttcctcaagggctgaacatttgagaaacctattatcattatcaacctattatcaacaaagatgttatcattgtctactggttgcttctctctctgggcttgttaaggtagagctgtcagagacttgtaaggtgggtgtgggcaaggggttggactcagagacccatctgtaggctcaggggctggccctagcctgggcacattggccttcaggcctaacagcctcaagtcttctatggagtcttgatgcatctggtgggaagacactggggaggggactaagttccctaatttcttaaatcttctcaaacctgagggagacttcataaagcctttaaagtacattaactgaacttcaacacctgggcaacaatgagtggcatctaatgttataatcgtatctctcctttgcagcaagacacctaagttgatcctggagctgccacttctcctttacttccacgtactgtttctacccattcccccagcccaacacctccaggcgtgactcttttctagccagatcctcagccaaatgctagaaacacaatgctgtaagcagacaaggagggaaaaatcaaagtgcaggcagtaagcctcctaccctgcagcaaatcatacatggacaaacgcagggtccattcatcctttctttcacactgttgttgttgctcatctctatttcatctcaactactccaaagacaggaggaggccaaggtctatagtattttaaaggagagttctcatactctagactaataaagccaaagtaaattgctgttaagaatcatttagtgaggtttaactacagcatctaatagatgtgcctgctaatctctcccccatgggacccaatgatagttgcatctagtagtaactccattgattatgtaagcgtaatttgtgccaagtcatagtatgatattataataaccattttgtactaagcacctattatttgataatccccatagatatacatggggaaggtcattttttctaacttataagtagtgaggctacttgtaggtacaatattataataaccattttgtactaagcacctattatttgataatcccaatagatacacacgggggaaggtcattttctctaacttacaagtagtgaggctgaggcacagatttcttacacagagaggtaggataggaaagcctatattttcttctgaaagggagggctcatctaacgtctgcctttggttcttgcggtagacagaataatggccgccaaagatgcccatgtcctaatccctttacaggacaaaagggattttgcagatgtaattaagttaaggtcttgagagagagagattttcctaaattaccctctgtggtctgatataatcacttggttccttatgagaaagaagcaggtggatcagagtcagtagtaggtgaggtgaagatggaagcaagaggttggagtgaagggaggaaggggccacgagccaaggagtgtaggcactctgcctctagaagccagaaaaggccaagaaattgattttccctatagcctccagaaagaaacagccctgcagcacctggatgccagcccgtgagatccattctagacctctgacctccagaagctaagatagtacatttgtgttgttttaagccactacgtctgtggtaacatgttaacagcagcactgggaaacaaatacactccatacatagcctttctcaactgagattcctcctctgaaccagagaaccccgagaataatatgattaactatttttacttctcccaaaagtagtacatatctagtatcattttagatgcataggaaataatttaattcattgcatgtaatggatgccttttatggtattagaggttaattctccccatgagccccactgagaaaacttgcacgcccagaaagccacatggcaccttgtcttgaaaagagactgaggatgctaaccagatctattctgaccttgggcagcagctcagcacatctggagacactgacccagaggaaggcaagtacctcacctctgaatagtgcccttcatagagtttcaaagccctcacaaaaaggtattctctctggagattcacaacaacttcatgagtcaaggaggagaaaaaggctccttccctcttccataccaaggccatgcaccaggcaagtgacagagcctgtagcctgtctagcctctgctctagggcttgtgtcacatgcttggaggatgaggagttgtgatgagtgctctatgccttcaagcaggtcttccttgattgacaggggggcagacggacacttcatggcagatgcagtgcaggggggtcacagcctatggacccagtaaaaggttgccctgggaaaagcttccaggccattctcactggctgctgccaggtgctaagtccttactataatggagttattatgttctctttgttatgcctcatttacaagagagggcctcagtcaagagcagttttcccctagcctctgcacagagacccttgtgccatagttggaatcaaccaccactttttaccaggaactttgtccaagctccccgcacaaattgctctcctgcctctcaatgaagtattcactccaccaagctccatgtgagcccgcaggaagtgcccccaggagcttcctctgccaagaaccctctaagcacatactcttcgggggcaggaacccagggaggagacctggaggagggaaatggaagaaccctgggcttggatttgaactcctgggttttcattttaactttcccacccactacctgtatgactttagagaggccacttaaaataacctggccttattttccttactttttaaaggcaggataagagttgattcagggaggaagaccataattaatgtgaaagtgttctggaactatgaaatactatacacatgcaaggaaggattaaattattatcaccttttccccaaggaggactcggtgctcataggtactcgagttgtacaaggcaataataatgataaatagagcacgttctctgatgaaacactttcatgggtttgcaagtgaaatgctgggcacggaaaggtaggagttgtccagaatccctgacacattatgctcttttcccatgtaagaaatactgattgtatctgactctgcgcccaagtccaacaaagccactgcacggtagatggaggtgagaaggacccagccctggccgccaggaagctcacaatatggaagggaaggcggaccagaaacactccatgtggataaatcatagtaagagccacaaaaggcttcctggggcgctgtggaataaggaaggaagggcatttaaattagattgtggggagagaggtcaaggaaacttccaccaggaggcaaaaggagctgagtctttagggtagaagttatctagactaacctgggggagaggagacggccactccagagggacaggaggcacgagggagcagagcacattcggacaatgtcagcggctccgtgtgttggagtaaaggggcatatgagagggtggggagactttcattctgagactctttgtcctgaaggtgtcgggatgctgtcaaaggaacgtacacccatgagaagatagcgaactctgtgcaaagctgatgatttggttattgtcacagcggagctactgacatagttcaatgatgaaaggaaacttcaaaaccttgagtataaggcatgtgccttcatgacccccctactggatgggagagagttaaagctgttgtttctggacactatatagcctagtgatctcctgaagcctaaaatgagtatctcacaaacacgccagctcacttagtctttctgtttctctgtctctcctctctggcctgtacaatccaccacctgtgcctttcccccttcctctaccatcactacagtactcagccacctggggatgcacacagggtgtacacggcatccactgtgggatgagggggcctttaaatctgtggctggctccccccaagcccctcttggttgctgggttcatcagctcatgcatttggtttcccattggtgagttgggttgaaaaaagaggcccagatgcctagtgatgagaacatttttttttatgaattgaaaaataaaatgacaataagcagctagcagatcccagttcacaatgaagtgaatatcaatacttgtggttgtattgaccttgaatatttttttaaaaatacagagcaagaattctcggggtgcattattatatacattctgaatctcttcactgtacaaaacagaaaatctatcctttatggacaagagcatctctggtgtacagcattgactttaaaatcaactttctaaagtgcaggtagaagaaaatctatggctactcttagagacattcttccctgtcaacatagattatgacattgcttccctgggttccactggggtgggacagggaggaaagccctgctgaaaggaagcactcttgatttctttccagttgtgagaggaaggcaatgatgtcagtgacggattggcatagctgctgtgttccacatcataggtatgaccttatcgtaagtttggcttcttatgcccaggacagatcccgattcctgatgtaacatgaaaacatgagaggcagctcccacgagtcaccttaaattctctggttagaaagtgactttcgactcccttgtagacttactatcagcagtgtccacatggaggtgaaaatgaggggacaccataaggaagcaagactcagccttgatggcacctgtgctccaagctgagcaggcctcaggagcagctggtgggctcggtataacacaggctgctggtcaaaacccttctgatgtagaaggtctggactggggtccaaaaatggggatttctaacaatctccaagttgacctgcagaccacacttgaagaaccacggtgatagagaatctacgaactcagataacccaggaaccatagaaagaccctaatacttccttgatatgtgagataattacctgtcaggaacacgcaaagggagtctacacctagaattaaggggatacactgacccacaaagattccttttccattgcaattgtgagtgagcaaatctagcagagtctatagtacgcataaagtcaacaatgaacaagactaagacaatttaactaaaaaatacaaccgtctatgtattttcaaactttccttggcatgaatacaatggcatggatcttagaatatctgttgataataagagtgaaaggtagatttcctgttattttcacagacaaacaggagaggtaagtgttcagattttctggttggtatgtcttgattctgaccagttccagtattcagctgttttcacctgtaaagtatggatttctctctgcaaaaacctctgtcccaatctgatgaagagaacacccaaaacaaagctcatgcccagagaaaggagcattgatatggatttggaacccaggcatcagctgccaaggctctgttgatatgacggcatgtcccactgaagtaaaaagaaggcatttgaagtattctatgcagagatctatcttccttgcattcctcctctgtattgctctgattcgatctaaaggagctttgaaaacgtcaaagaactttcatgttttgctagtttatcataagtgtctatcttaaaccaatattacaattttaagcatggcctgggtagacatgtgccatcttctaaaatgatttctgacacaaggtaagttgtaccagccgagaccaaagtgaaaagaatcataggctctatgacactcaggctctcctacattctaagagtctttttatttccccctaataaccattattaatcatttcagaaacacgtaatctcctgatatttttactattctagacttgacagaaaaggagggttttgaagttctggaaagtctttttatgtagagtagctccattcttccagcacacagctaccacaaggctcaactctccctaagcagaatgggatttatttatttatttcttaatccactgaagggaagctgggtgatgatgaattcttttaaagaaatcagcatttggctttcaaaatgttaagctatactggaagtgggttgtggaggcagagagcagtcgctagccatggaggaaagcttctcaaattcttactcagcttttgtttgggggaagaggttttcttccatttttatcagctctccgtcccaaatcctacaagctatgaaggaggggacccaccggccagggcaggggtttctgtggcttgctgatggtcacacggctgtcgggacaccagtatttctgaaatccttcctgaagaatttcagaaaaaagaatttcagaaatactggtgcctccacagccgtgtcgagggcacaggtgggcataggcctggaggtggctcctgaatggagcagcagcaagggctgtaaggggtctgcacaagggtgtttgattggcaggtctttgactctccagtcgaatgaccttcaggcaagttaccgaatctgtctaagcctcagtagttttcatcggcaaatgggtctaaggatccctactttattagattgctaggggatggaataagggaatgcatgcaaaactcagcagtgggcctggccacaggcctcagtaccatctccccgtggctggtccccattcagcaatcacaaggcttcgggggtagagaaacatgctgaggccagcacactgaaaccattacaggttttgatttttttttctcaccactctcctccctcctcagttcagctttctattaaggtatcccaaaacactaacgcagctcttggtgaaaggagaaagggaaaaagtggccaaatcaaggggtcgggggacagcagggccaaggtcaaacacctcgttggtataacatcttttaatttgaggaggagctcagtccccattattttcagtaaattctcaaactatgcagctctatgtttcctcttctacccttgtagcatcaactctgcagtttgaagtaaggttttgcaaaacttatgcaaaaagttttcttttctacaagagatgctgaagaagtcacctggaatttgctagtagaactatcagtaaaatgaagacagcaatcctgccttcagcccaactccactgcccagaaaggctggcactgtggggacgaagggggcagtggcagctcaccctgatgcagagagagcggcaagggactctgatggtgagtcagctgagggaagctgctggggtctcagcacaccgtatagaaaatccctccagcaacttcagaaaaactgaatgaaaggccaaaggtaacataaaccgccagctctaccaaccactcaggctgcagaccagacaagggagtggattgttcccatggtggctgcacctttccttcattctattcccgctatcttagttcacgctgcctgtggatcaactcgggatctcagacacatctcgtcacaattatcaagtggcaaaaaaggtgagccgccatccccttggaggtaaagaaaggcatgacgaagtcttagggccaacaggggaacgaagtcttagggccaacagggttcccccggtgtctctcctgcagcatgaaggccattgtttccagggcctgtggccaggatccagttatcttgcctggaaggatgttcaaacagccatggcccgtggtggttttttataatggtgttgttggaaattagtaataccatccagaggtgaaaacagagtagcacctccacagcctgcccaggagatcaggaataatgaagcctcattttagcatctgtttgttttgttttttcagcatttgcggggaatgacaacagaaatattggctccctgaccctggaagggtggaatcactccttgtggaagggaaaacgcctggagcggggcagggggcacaggcctggaggcggctctagggagaggtaggggctctgggctggcggtccccctgctggggaggactcaccttcacatacaggagagaaacatcatccctgtggcagggaaacccgtgtggtgggctgagcttcctcgctccctctctttgaagctctctcaagcccctctgagcatttgcaattgtacccccttagctgctgccacccttcatccggatcccctcaaacactccaccctcacaccctgcagaatcaggagagaggaacccgcctcctgcgagagccgccgccatctgtaacgttgccctcaccacccagaggcgaggaggagagccccccatccctcccgtcccttcccagctcccggcagccactaggctttccccttccccgtcctaagggacctcccgggctctgctctctctgggcaggttcagggctttgcaagcgctgctgctgccaccatcaggctgactgaggcactgcagccttcacctggcgtcagggcccaaaatagtgccccagctcttggtgcggcttcagaagaacagctcctctctgcctccgcagttgcccctcactcaggtgcagcttcctatgtaagaaaaaggcttcagagggcatctccctgaagaaacagaactccttgtgaatgtggggtggaccccagcgtcctctagcaagacgcagaaaaagtgcaggtcctaggatttagggaacgcaaccactgagggattaagtggtggttttgctttctttgccacaaggtcagtgaggcagggaagggtgggaatcactcctcctgccactcccggatgaacgtgctaagcttcctgtgcaatgaaccaaccgggccccagtgttactctgaagctgtcattgctcccagcattgccaagggtgacaggtggactgtcacactgcaccagagccgagtcacctgtgacatttgcaggtgactgacagaaatgggcactgacatgcattaaagaacagaaggacgcgatggtttcctgttgaagctgagcagtgggtggcttggcagaggctgtttctcttggcgttgtctctggtgacccaaagggcattcaaagccttccagaaaggaacaacttcctgcagggcacgtccacacttcacttagtcaggttcttcttctgcctcctgccaggggccctctcagcatctctccatgtgctgatattacaagcactgctggcttctcctctcattacccctcattccattccaatatttccacacttattcacagccttctatgtgcccaatagtgtgctagacaccaggggtgataaaagacttggattttaatcaaccaattaagagaagcaaagtccctgcctttgcttccttcctttttattattattattattattatttgtcagaacagccacaaaaggagctactcaagcagtatgtccttaattactcttcagccccaaagcctggcctgttatttcctctggaaactttgtaccccgaggtaaaactgaatgccagaaagataaagaaactgactcagaaagagtctggaataaaaaagaaattgaactacaatgctgcctccttgttcgaaggtcagacctgggattcggatgcatgattttcataggaaactccctaaaatccttttccagtcctagacactggggattgccacaaattataagactatgacctgtcttatgacaccacagcttaggatactctcctgcattttttagtgttgatgtggaacagctggatgtaccagcatcttgaggaacatcaaggcacatgaataagtgaaccagactgaaaatgactttagtcaagcaaagtaacctctctgggggtatgacagcaataatgcccacttctcattacttctgctgatgaaatgaggtagtgcttgtgaaagccactctgcaacttatgaagctttacacaaatgctagttatcatcaccatcatcatcataagaacataattactgccacgactaacaacaccctcaacaaccaaaagaatttgccaggcacctacaagaaaatttgctggcaaagagcaaatagaatgcatcacctactccctaggaatgtgtcatccaaaataaatagattgttgctaagagataatattcagagaatcttacagttggagaggttttggacgtcatctagtctactctctaacccatttctcaggaattgactcctacattcctgatggcctgaattccaccgtgagtcagaacactctcagcaatgagagactgttcagtgggccagccttagacttgagacttacatatccgcagtcatggaaataacactgtctatttcttgctgaacaatcggggttttgcttcatcattgagcttgtcctgccagcctccaccagttcctgaagagaacaggccaaagtgtggaacatacaggtagatctgatgatattctctactcttaaatggaagggtactcagtgccagagccttgtaaaacatttccaacatcttctgagtagaattgtttcacttgtaaccttggtttccctaaagccagtataacttagcttcctcttgagaacaagaaagacatcatcagcaaaatgtccctaggtttttgtgctcacctgctccagtgctgtttcctcttctggttagcacccatcttcaatgttaggctgcctgcgcctctaactagccaaggggatccacaaactggcaaatctcattcctcaatgcactctttctgctcaagtccagcgtgcagccagcagtcctgcctctgtgtgtttccatgatcttttttcttctcttccacattctttagctaacacatcattctggcattcatctacccaccatccttctgtgcctcctctctggaatgtggactaaccattaaggtcagttccccccatacttattctcttgctcacttcatccatcagctagaaagaacgattaaaaagtatatttccattcaattttacatttttagccccatgtgaaacacaagaaataccaagaagtaaaaataacatgttgatccctaaacccgtgatgtagagaggaccacaaacccataggctactagcaatgtttctcaggtgtttacttaattatctcaatccatcctcaaaagatgtataatggcacccatggccattcacgagttgactcttcccttcccaaccttcctctcccacttccctaacacagcagcactctagccatcatactgcccatggcttctgaacatatcgcattctgttctgccttttgtatttgcatacactgtaaggtatgtaagagactggaaatcgcttttcatgcttcgtttagagaactcttgagcatcctataatatcaagcatgatgtcatctcctctgtgcaaccttttctgatgcctttgctgatccacctgttttcagaacactctgacagctctgaacccatcatattgtaaccttaatcgaagtgtctgctccccaaccagactaagagctctggggcagaaacatggtcttcattatctttgcatcaaaagccccagcacagtgcctactgcataggaggcccacagtgagtgctggctgagtggtcaagggctgagccttagtgtcataaaatggtatttgatcacaaaggaaggagcagcatatttcacccactgagacactagactatgtggagcccctgggggaaaatgtggaatagtgacagcgatgtttgtttgttattgctgcaactcttggcctcagatttcagattccagttgtccaggcataagttaaaaagaatctgcataagttaaaaagaaacttgcaacaacaatccactgaatacaggccaagtgagcagaccatctagataattcagcatgatgcgcacacatcctttcttatactgacatacataggccatccattgcagttttagtttcaattatcaaaaaaaaaaaatcagcctcagataaatctactttgctttgcctatgaagacaggcaaagagtagggtgagagcatagctcccatttgagaaaagtggctgattctggagatatcacactgatttaacattaagtggtgtgtgcgtgtgtgtgtgtgtatgtgttcagtagggggtcaggagggcgtgggaaggcttccagatgccaggaaaaacctgtccaggggatgcaggcaggtgtctgtgtttggctgccccctttgcagttatttccaaggagaagaaggatgacttcctctttccacccttcatgccccaacagaacagctccacacagagcagattcacctatgctggccattatttccatggctttaacttgttaccaagtatgccaaggaatagctgacatttatttaatgttcatagtggtgttgactgtgtacgcactgaaacattgtatgcttatggaagacatttgtttccaagcagcttatgctaaattgcagtgatataaaggaaacacttatccaatattgacatttaccaacttctagaagtatacagccagaatactcatttttaccactgggagaggagaaaaagaattaaaaagcataatggtcctagctccttcagtgagttagaagctatgagtgaatgaaagttaacgtgcagtagggggaggttcaatgggggagaagatcccccaccctcttgtgacccttggctctatggcacagtgtgctttctgagaggactgaagcccttccgtgcttcataataaagctttggcagatggcaggacatagcatcccttccccaaccatgagagaagtattctgatgatctataaggtatctatgttcttacttgacctgcacttctaactgggtaaattctgactttctcttgggaaaagaaaatgacatgcaatgacgtatggaacagtactgtgtctcggtgcagtcgattctcacatcattcctctaactggaaataaaaatcccactctacttggaatacaggatgaagcgattacaacctgggcgcagtatactggctggctttgctgctcactcccttacgaatagctgtgatgggatatgaaatccaagggaactgttagccccccagagcagctgctcccaccgaccctgctccaagagtgctgggatgtccgctggcctcgaggcaagacaagagctccaatcactctgctgcaagcgccaccattaaagtcaagatcactgtggtggggggagttgaagtgtgcattccagcatgctcatgatcttactgaccttctccactgatgaattagaacacccctcttcccaggcacaggacgagttcagtgcctctctgtttcttgatggaccccaataaaaaaacgcctgcactgtttttcacctaaggtcatctcgacaatttacaaggataaggattgtagctgcaaaataatgcctatgcccctctagcccccttagcatcccccatctatatcaagaccataaaaccagtgcttttggccctcctcctcactcctccagtatgggcaattttcttttcctcatccatgtttccaaaacagtttatctttttatctccttggaagaaaagtactccacaaatcaaaggtatcattagtattgttattattttgctattgaaatctcttcaattcgctctggattattcatgtgcttttttgggtctgcaatataatgctgcctaagtcatccccactgggctgaacaaaaaagaaaaactgcatcttcgggcctaatctcctgctccaccccatctcctgctggccctggcttccaccaacacaggcacacaccaggcagggctgcttcttggtaccatgcctagcttgccgctgcctgttccaagccaaatcctcctctgtacacccaagagggggaccccatggtatcctcttagagcaatgtgaaggccttgaccccaccccactcgtcctccccctagggactttcttttccatcctcaataggtctggctggcaactgaggactccctactgggatacagacatgcaaccacccccatttccaacagacatgccccagtttccccacccgaagatttgttaaagaagtggtcccacacccttggcagctgtgtattgaccttctggcacaaaagaactgattcttcttcctctagacaagacgtcatcccacatggggttctggtaggagggagaaacacacattacttccctcatcttttgttttatgacatttctgagtgagtgtaagtgtttccaaagttgctgttcactccccactttgtttgctgattccttctctgcctgtaccccctatgatccctccattctttaggccacctctgatgtgttcaggctctcttccgatgcctccccaaccctgcccctcccaagggaactccttgctagttcaagcctcttgaagtggctcctccttttccatgcttcttgtcatctccatggctcccttcaccctggctggctccctctgttcactctattttacccttctgtctacgagatgcctttctattccctaggagattcagatcaccatgaccctctgccctctgacagctgctgacagccccttttggtgtttccagccaggcaggagagcaagtgggctgcttagattcttcccagtagggagatggtacctcaaatgcatccttagctcagggatgccattaacaggtaaatgcaagttttcacttttaccccaatacagtacagtgtgcatgcaaagccaaaagatctgggttcagcagaattagaaccttcacaaccacagaatcacaaggcaggacaggacgctctaggaatgccagagcaaaatgccagagagtagggaagagaccacctttcttaagagcgagtgtctggagtagaaggcgccaagttcttgccactgtggctcccctgtctatctcccctgtctccgaggtggagatcagagatctccctggaggcagggagtcatcagtcctctaggaccttattccctccaagctacctaagctgtgcatgtgcaggctggatgggatggggcttgaagcttaaggagggcacagaaggaaatagttgtgggtgaactgaaatgataaagaggaaaaaatatagcaagttctaagtttatggatgacaaaagaatcgattattttttcacccaggggcagaacatgtctattctcagcaggaggcaaattgtgctgtgacattatccctctctgaacaaagcatgaccgtcctgacagctgagggaagaggcatccacggcaagggagaagcccacaagcagtacacactggcagctctccattcccttgttgggagccaggcctggggactctggcgggggtggaatcgggaggaatgttatttagccttactactgccaccttaagaaagataaagaaatacttgatctcaatctacatgaaaagcccaaactttcaaagaatagggacccaccatattactgatattaattatacattgatttctgttctctgtctctctaaaaggttataagaaaaagtaaaggtaaacaaacatttgacaaattaggaagaaaaggatggctggaacggactttaagagtttatttgtatcttgagagcactgcttggagcactctctctgcacggggaccaagatactgggagcatggagcttgggaatcttgttcccagaaactcctaagtgccatgcagattcccactgtgagatgtgttggacagcagatggccatgtcatcggagtgccagataaggcactaaaaacaaccctggacatttgttgtctctgagggaaaggccatcccctgggtctcttcacatttcctgggagaggcatcccagcatgcaggaggcaggggtcaagcaggtggctgtgtgagggtgccgggtgggggggtgtaacctcaggcctcattctgggggatcacagtggagccatttagagccatgtgggctagacctcccaggacctgttagacatggatgcgttctatccaataagttgatgaatgcatgacactgggtagaggtggggcacagtacatgagctaagcatatatgtgaggatggtcaaatagaatcctctggggaattcataatgctcaaaacaacatccacataaacaaatttccacagatcaaggcaaaagataaccatatcacattgcagtgaagtccataaaacaccttcccacttgatggctggaccccttgattcccatagtcggacactgtctattcaagaagcacaccatgtacagggatgcagggtatctgaccagccatgtccacttgggtctcctcatttttgtttagacctgttttccagcctctggaccaggtatctaccatttggtagggtggacagtgatggccaagctcagaacactccaggagcacaaggcattaagaactgcatgatgttatggtttcttcctagcgctctcaggactcggggtagataaaacagagcatttaacctccataggtaaatatttaaagattcacatgaagcagtcaagaaacagctccagaccaagaaagaaataagcacaacagaagatgtacactgtaatgattcagacggccagggaggtacttagacacctatagccttcttatgccaatctacataagtatcacggatcaagcttctaactacacaaaaggctgattaaagcatgcactggtcccatgcaaatgtgagtttgtgtgtttacggggggttggttggaagattccctccttctcaggggttctatatcaaaacttcctgagtgaactggtaagaagcaaagacgaatgggagtgtgtgtgtgtgtgtgtgtgtgtgtgtgtgtgtgtgtgtgctcataagcaagcacatacacatccaagaaagagggtaatcttaccaaatggtaatataactgaacctgtctctataccagtgttctgagagagttcttattcattcagcctgaaactctggggaaggcaatttatcttcctgctgctgtagggagccttggtgagaagcacacaaccatatgaatacatgagtgtgtgtgtgtgtgtgtgtgtacatacattatcattatacacaggcattagtatgcacatacaaatatgaagaaggagccccttcggtttcatcaggaggaccagaagcaaagtttgaactgcacagataaggagaaagtctgcagtgaccacaagcacgggtggaagagcagaagaaggaagccaggtttttgcttatatttggcttctccccgacaggggagaaacagaagacatgctgtttgcttgcaaagccagccacccatggcagtgctttgctttctcgaaaacttttacccttcatttaatcaacagatggacgtgctctgttgtggattttttctgagtcttgcacctctaagagctgtgttggctggcacaaatgcagcctcagatggcagaggtgcattggcattccaaaagagcgggaaggagcccatgtacttgcccctccaaactcaattccacaggtgacttttgatgcctttggccaactaggcactcacattccctctcccgaatttccctctcctttctgcaccactaccagccccagggctcccagtggcaaggagcctagaggtggcaaagttctttccggagagtccacctgcttctctgcccctgctaggctgcagaaaggaaaccatcagcaccacgggcgaaatttcattttataccctgaattcagtgctgtgtaggattcagaattcaacctaatttagggaactcgatgacgttcaatgaaactctttacaagcttttcccaaccactgcaaattaccccccacaatacattctgtaattgcaacccccttttcaacggtgcaaaccacacacattcgcttttgaatacacttgtgcaagtcaaaccctattcaagctgaaatatccacctaaaccaagctctccctccctgccgtctccttccctggcctgggtctgaaggagaggaggtgcccagaagttcagagcggcataaccacagagatactacctaattaacataccagaagcataaagaactcatttgcattggagagtttgagctggatattgacaagtgagaggagaaagtcattcccctcccctcccataccccttctttccaaaggaaaataaacagtaccattttgttgcattcgcaaaggcgaagaggcaatgccagagcatctcagcccggcaccgagagacgcatccatcagtccgagttcccgaagcctgcccacgttcctgcccacagcctcccgcgccctgacaacccagccgactttcttccaactccagcagcgcaggggtcctaccttgactgaagaggaagaagcagacgaagagcagatcgagctggaagggtttcattccttagcgcagcgaaggaaagccggcggggtaacttggctgtggttagtttctcttccttggcggctctcggtgctcagcctccgccggtcctctcgggttcgcgcctaccatctgtccgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgagtgacagaaggactcctttcactgaag

SEQ ID NO: 1611 - DNA, 28504 bp, Homo sapiens
tggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactggtgagtaccctgcgcctgcggcgggcgtctgtctcgcggcggtggctgcgggcccgggcgcctgcttcgtgccggctccgggtgcgagggcagccggcggcgcgggcgctcagcgctaacccgccgcccgagcccgtgcaggagtcaacgtcaaggttgcaaaggtgggggtggggggagggggtgctgagaacatccagacaaaggacgtgaactcggagccctcacctaagtgacggccggagggtttgtattggttggcgggggagccaggggtcacgtgtgaatcccccccaatgaaaccaccctatgcggagagctgcaggaggcgcgcgccccacttggcgcaggggggctcctgctcttcccgggcccctcctctttttctttttgtttgcatgcaagtctcaacgtcgaggccggcagcagcggggctgagctggtgcggccgcagggtttgcagagctccgggggggtggggggcgggaaacgctctccccacacgtaaccccactaaagccacaagcagcagggcacgcgctgcagcctctcaacccctgccctctccaccgcccctaaaaaccgacgcacattggtgggggccgggactgggaggagccgccttcgccgtgctgaaggggaaggagcccgggccgggcgcggggcgtcggaggtttgccccggactggggatcggagccgggagggatgcagagagaggcaggcccctgactgctgggacttccttgctggcagtttcttccttcctgctctgggttagaggagaagcggccgggggcgagcgccggcagccccggagcgcgctctcaggtgcggacgtggggagctcggccccgagtctccggcaggcgctgagcgaagggaaaaccggcgcaagccgcggcggggtccggcctggcccaagaagcggaaagttcatgcttctcgcttcaacttttcgggccggcgccacagccccgagcgaggaagagccgcccctacgtcagactcttcaccctgcgtgcgctcttctggctcctttctttggaggtcgccagcagcctttccaagacccgggaggaaactgcctttgcagggcccagctcccgaacctaaacttgccgcaaagccccgcatcttctgttagtctccctgcccccatccgtcccagcctggcagtgtttagagaggggactgaacttccctctctcaacagttcaagttcccccaccccgaggcttgtgtacccttcttgtgggtgcccctcccttgcctctcccgtggtgtgtgagcagctaggtgccttattataggtgaagctttgaaggctgttggaggctttgtgcctttggctgctcaaaatttgccaaggtgggtgtttggacccattaagaatattatgagaaattaaggtttaagtttatttcatcgattagcactttgcagcttgcaatgcttttatgcagacattagcccttaacctaactgtgaggtatgcactattagcatcagagtaacagacaaacaggacacttgtggctcagagaagttacaggacctgttcaagatcacacagttcttgaggggcagagcctagaacctattgcttctgtttctaaatccagtgtcatttcttatctatgtagtaaccatacaattgaagaggcatctggtacccctgtttccttagatactgtccctcaaaagactcccccatatttttgttttaaaccatgtgcacaggcacgatggtggaaagcattgggtgctgtgtagcaggtacctgtatttggtgcttatgttcagcattatgtgcacgggatcctgtatgtgcccagagtttgtgcaaggataagggaatattcgtatcctgcttagagagtacaaggcactttcacatgtcagccattggtgggccagcttggcccctctggaaatttcctttgcagtcagagtcgggtatccttaaggcttttaatccaggggatgtttttcaagctgtgagcatgcagctgctgtgtctggggctagagaaaggggatggatggcagatgtgaaacttgcagaaaagctgaccccttggggctttaagtggaacattttgccaaaaggagcaccagagagacaaatttaggaaagctgtatgattggactttgtttccctccagttgacctgttattgttattgtgtattaataatatatagagttcccctttggaaagttcatgtgaggattatttttattcttagttggagaagtgaagggagatgtggttgaattggttttaatatagacagatggactcagctacctactgttttggtttctctggttctgtcatttaaagaaacattcagggtccctctgtgccagtggggactagagtacaggagaggagggaagaggtttgccagagaggtctgcagacaatgggctttgtctgttgcggctgagccctggggctgtgggcttgcaaggcgcttcctcagggtgtgagcttgttttgctgcaagttctgttttgaacacctctcttcctgtctccagacagtcccctgatcccacagcagtgaatgcatgaagagttaggaatgtgaaagcgcgtgtgtttgttgacttttggtctgggtttcttggcagccccgactatctgagatcggccaagatgactgaggtgatgatgaacacccagcccatggaggagatcggcctcagcccccgcaaggatggcctttcctaccaggtgagtaagtcctggctcccctctgactctctagagcctagtggtttttgctgggggtgaggacagacttggttttgcatcccagtgccacatataagagctgtgggactgtggcagagtcccctaatgccagtaagcctcagtttcttcatctgtaaaatggggcaacaatcgtccttatctcctaagattgtggtaaagattcaccatgacaagtggatgtgtaggaagcattcctagtgtctgggacagataagggctcagcaagcattagccattgtgatgaattgaccctactggctctgtgaactttgccattcaccgcagcaaaggaggaaatgatttgtttagtcgattgagaccagaactttccttcccagccatgcctggggtagtagaagcattgctgtcgggggcttctgcagaagggtggtctggtggggatagccatgtccaatgctgctttcttccttgggttgattattgacctgttgattcagagttaacattcaaaccacttagagaggaagatattttccccaaagggaggctagctcagggatgctattgctgggatcttgcttggagatcatcctgtctggtggatccaaaatgcacaaggatcacaaaaagggaccagagtgagccctctggactcttaccccagccctctctctggcttgccctgctgcctctctactgcccctgggttgggggtgggagcaatggagcacctgcagttccctctgggctgtgagctggtttggggttttggaggagagttcctatgttgttaaactggggggagggaggagtctcttcttaaggaagaccttggagctagggaagttgtgtaggatggccagcccagggaagtcgaaagggagtgtgatgggtccatgggtccgtgctacagacatgaaggtatgcccactgcacgccaagcactctacagacgctgccttgctcacatcttaccacagctcccaggcggggatcctcaccctgttcacagatgaggaaatggctcagcctgagtcagtgacttgggtctgtctaaccccagagccttgttcttctgatgtattgtgtgtccacaccatggcttggttccgctagggtctaggttgactctggctggtcattccttagaactgttccagggacatttattttgtaaattaaaaaaaaaaaaaaatcaaatagaaagccagggagccagggtgggtgccatggagggaaagtaatcagatagaaccaagctaaaagttcaggcagggtcacttaacttcagacatgcttgggaggctaaggaggcccctttgtgttgtctatattggcaggcctgtcttgaaataagtagccattagcttgaagggggtgtgtggagcaagggggaactctctttgctacgtttgacttttctaccctcctcccccagagtgggtctgaggaagacaattgagggcccctcaacctggtgggaggggtagaagtttcctggcccaccagccagggggttttgggtagcagtttccaagcccctgagtcagaatgaatctctttgtggttacaggtgaggttctctttcggttctgggttttagatttccatcacagaacctttccaaatgcagtcatctgttcatcttgtgtgtgcttttcatattttccttttaaatacatcccaggataaagggccaggccctatagggccgttttctcaatgcttcgagtccttcaggccattctgctggacctgagactcagggcaggtggtgagggaggaaggagctgggggaggaaggccaacctggggctgcaagggcagcaggaaaataaaatcacctctgggtgcctgacacatctcagcactgcctgagcaaaggatccacacatcttcccttgtggtgctggactgagggcccagttctcagagccccctcccaggaaatctgtttctgctaccttggtggggaccactccccagttccaaaatatcttacttggaacttcagagcactctggtcacaatttttcacagcttttctgatttcagaaaggtctcttggttgcctggtgaagaggaaagggagattgtagtatttaaccaagcaacatttaggggcactttccctgtgcaacctgctgtgctggcctctgtgcccagggtccagggcccttgtaagaacccagcatctacataaacatctggaacacaggtggtgcagtcagtccaggtgggggacatacagaagctacagtgagtccaggcatcgacagcaacaatgaaatccagccgacagaatcagagggagggcagactggggctgggctctgaaagaaaattaggactttgagagggcagttccatctctaaggtaatgttcttgcaccttcagatacccctgggcttgcccctgtttatgccaggggcagggctgtgcagtgagctggtctgaccattgcggtgtgacagatattctccgggcccactcaaagctagtgccgtccaattagacacattcccaccagagctctggggattggctgggactggcacttggctggagccccttccctttgcatgctcaggctcggctcaggcctgggggcaggggatctcggagctctgttcttggcattcctcctaaggataataatagtacgtggcttttactgagacctgcttttctaaggaactgagagtgggaaggagacatcaatccagacttggcagatgaaataggatctcaggcttgtgatttgaccttgaaagaaagtcatcaagtaaatggcacattggactttgtcagtcacttcactgccttgcagatctatcgagagtgaagctttcctgatttctctgtaccagctgtgacgtttcttttaatgcctgtggcattttgtacttgccaatgatgccgcttcgaggatacgggtcctgttttaccttctctttgcccaggtccttgaaggcaagggaggacttatcttcatctttgtaccctgcccccacccaaggtgcctaagtgctaaaagtgggtggtggttgtttccatgaagttgagtctcctgattctaaagctggtcaccttctcttctgccttagcttctggaaagggcctcctcacgctcatgcctaccaaggtttcagatagatgcccttttaatcccctgaaagattcaaggaagccccagctactggtcctggggcagttagggctgtgttgtgagccagtgccttgttttgtagtaacattcatttggagaggcagttcagtaagggaaatccacgtgtgcacattcacttaacatgaattgtgacaccctgtggggtgggtgagtaaatggttgctagaaagtctgagtacattttgggcaggcaggctgtgggtggcggccagctcaccagctgagtggggagggtctccagcaggatgttgatgtccctgatggcagcagctccctccccacttccatccagcctgtggaacaggaatttctgctgcccagtgccttcttccttaccctaattcaaggaagcaagtcagcagctgcttctttggctccagggactctaaaaatatggtgttagggaatgcctctgcgactgggtctccttcgatgctgtgcccgacttggcctgggctctgtctggggaagggtcttgggaatttgcctgtgggcaccgacactgcctccacccaacggcactgggaccctggccttgctactctaacttcctcagcacagcagccgaggcgtctacagtttcatcaccccagctaaggtccagatacagatgtggctccttggttttcatttaaaacttccttctaaagcacctggaccaaggtctgaacacatcatccttctccaggctctttaaatttctctaatcagcacacgtcccttcctggctgccccttgtattctttctgcttttattcttggtcatgtccccaccatttgacatccatctgtcagtcaggcaagcgagggaggatgctctgggagggaggaagccaggaggagcgatttcttcacacaccacagtgcttgtgtgcaccacacattccctttgataaacagagctgagagcttcctgcatcttccccttcattccccaggtgggagggagtgatgtcctagtgctttctatggtagggaagagcaggctagcgggctgacttttcttgcctcagccttagtatttgcctcgtgcagttggagagcctcagctatggccctgcattgagaggtggtctgaaggaccattgtgggtggacgaccagcctttcccggcacaagatctcttgcccctttgtctctcaggtcccaaatagccaccttctttctctcactcctccccactcttttttttttttttttttttttgagatgaagtctcgctgtgtcgcccaggctggagtgcagtggcgcgatctcttctcactgcaacctccacttcccgggttcaagcgattctcctgcttcagcctcccgagtagctgggactacaggagtgtgccaccacgcccagctaattttttgtatttttagtagagacggggtctctccacgttggcccttcccactccttgtcagaagcagcaactcatctctcaaagaacaggctcagtttgtttcatcaccgaagttaggcggtagctcggaaaccccttctctttgctcacatctctgctgagcctctcttgatggagacctcctgagcctggcttcactctgccggttccacctgggtggaatgcgtgtgtggaaacaggtgacgggttaagcccttaggaaggtttctggtccgtggcctctgtcccccaccagctcacgaggccattctgggcataacgcatccactctatccgcctcctcctcattacccctgtctcattgcttactcccagctgtagttccccacatgtcctcaagagtttgggaggcgctgctgagcagctgcacgcaagtcccatggtcaccaggaaacatctttcacaatgtcagacttaaaaggcctcagtagtccctggagagacatagagctaaaaattccagaacatttggcaggaggcatccagccgcggacacatgttcctgggattgcaacaactttcttttctcctatccctactccccccacccgcctctctccttgacaaaaatcacaggaatgggatgtagaacaggcagttagggccacgggtctcaaaagcacaagtaatgtgtttctctgagtggcactgggcccgtgtctgcacattctgcctctatgtgagtcattgttcaccttgttcagagcaaatctactctgtatgaggatccagcaccttccctcctacactaccctgcagagggctggaattattcccatggggatttcctcctgggccccataagccccctggtcacaacagtgagtctgtagcctggtcagggagagaacaagctttcttcactttcccagccaacacgttgcatactagggccatacatcccggcctcctctcaaggggcctgtgttgggcctgacgcctctctctccaagaggttatgtgttcatctctctgctgagccaggggctgtgtcttaggctgctctttgtttctaagacgctgggcacagtgtcctacaaatagttgcttaatgagcctggatgatggattggcccttcctctctccccgtcctgcactgagaatccttttatcttggcagtctcatgaagccaatttttataggatcagcattttctctaagtaggcccggtctcccacgttggatagaaaggatggtactgttagggaaagggatgagtttgggtggcgaatgttgtgactgtagccaagagctattcctgggtgtctagtgaatgtcctgaaatgatcttgcaggcctgagtcctgaagtagtcctcagaggatatgaagacaggccctcattcacacagggcgtagacttgctgggggcttcattccttcccagtctagtagcttctgtgctgcctctgactgcctctcacctcgccacctgcccttcccttgtcctcaagcgcagctcaggaagatatcgttatcagcacatcaaatcctctgcttccttcctgggctgagggagggccccttattacacagatccatcttgaagaacaatttcaatttgcccaaagtttctccaaactatagtcaagctggcattttaacctcaaggaaactttgggagccccctcaagccccctctccggtggacttaattgcctcccaccggcagtagcttattttaggtaaactgtgtagaagagaccccaagcgtttagctgaaactcatacacttcttgcctctcagccaggaattttatttgaaccaatgggaaggaaaattctggatttctcacataaaatggaattggtctaagcaaagagggcactcctaaattttagtacagatacagttggtgtctaagcctgactttctcttgatttggtggttcccaaacagaatttaaaatataccttgaactcatcttccagcttttcttaggagagcttaaagcacttgttcaaactggatttaagaggtatccttggctttcccaaattcctaaacattttcactagatgtagccctgcatacaagccctaatttagtaggtggccttaaggtcagccacttatccccatggacgtaggcagtggtgccagcgcacatccactaacacacacacattcacacacacaactgtaagggcagatgggggttaataagtggttgttttagattagtgttttaattataggaagtttttccttccctttccctctgttggcaatttcatatttttattgataaaatatgtattttattatttttatgcttacttttccaattttaaaagaaacatatgctcattatggaatttctatttttattttctttctttcttttttttttttttttgagatggtattttgctcttgttgcccaggctgaagtgcaatggtgcgatctcagctcactgcaacctccgcctcccaggttcaagggattctcctgcctcagcctcttgagtagctgggactacaaacacgtgccaccatgccgggctaatttttgtatttttatgagtagagacggggtctcaccatgttggccaggccggtctcaaattcctgacctcaagtgatcctcccccctcagcctccccaaagtgccaggattataggcaggagccaccgcgcccagcctattttgtttcttaaatttttttgtttttcagtcaccacaatttcaccatgcataaatcacaacggttaacaatttagcatctttgccttcttttcctgtgcacttacgtttttatgtagccaagatcacacgttgcattttgctgctttccttaacagcgtctaagtcatcagcactctattgtgatgatttatcttaaaaatattccaagcgatcatttttagtaactgtgtaatattatatcataaagttaaaacataatttgtcattcaattgttgaaatttttaggttacgtatattttctcttataaatatgtaaatatgtatataaaaagttatatacagttttttataaatctttgtgcatactttatactgtttccttagcatagagactgtggaataggatttcttgaaaaaaggtaaaagtgtgagtatgcatatatactgttacatatatgttattattataaaggtaatattctttttttttttggagatagagtctcactctgtggcccaggctggagtacagtggtgcaatctcggctcactgcaacctctgccttgtgggttcaagcgattctcctgcctcagcctcccaagtagctgagattacaggcgagtgccaccatgcctggctggtttttgtatttttagtagagacggggttttgccttgttggccaggctggtctcaaactcctgccctcaagtgatctgcccacctcagcctccaaagtgctgggattacaggcgtgagccaccacgcccggccaatatttattctttatagaaatttaggaaaatacagagacatgggaagagaaaaaaaatccacacccatatttctatcactgaaacattttggtatgtttactttcagtatttttctatgcacttaaaaaataaaattgagaccatactgtacatgctgtagtgaatccctttttcacttaatataatatcgtgactatgttcttgtcatttggttttctttgtaaaattctattatgtaacatttcttaatgctgaatatttaggttgtggcatattatgttcttacaaagaacactattctgaacatcattttacagaaatctctgcacaggtctgatttgtttctttggaataagttcctggaagtagaattactgattcaaagagattcaacatcattaagccttctgattatatgttaccttaaaaacagaaaagatcaaagagtttatcaaaatataagctcccagcattgaaagctctagcaaatagaatctccagggtagaacatctataaagatgggataatggtagagctttttggatagaatcagaaagatatttggctattttaaagtgtttaggagatattgtacatcttcctattgtttgttaattacttatttcaagcatgatgataacagttgatgatgttcaagcaacatttagccagcattgcaaaatagctggtgatcatattcttgtcccctagtaggtacactgacaccctctgtggattaaaaatgtacacaggtcagcgattactcagcttttctcctttattctattaatgacattgagcattgtgtaaaccttgaagaagaccagtaaaattacattgttctggagacccaagaaggttcaccagatgcatgctttgtctctgaaccaacttggctttcctggggttccagatctggctcatgaataactcatggttgagaaatattccttccctggaattaaggatgggctggactctttttttttttttttttttttttgagatggaatcttgctctgtcacctgggcttgagtgcagtggcacgatctcagctcactgcaacctccgcctccctggttcaagtgattttcctgcctcagttccctcagtagctgggattacaggcacccactacatgcccagctagtttttgcatttttagtggagacgggtttctccatgttggccaggctgttctcgaactcctgacctcaggtgatccacctgcctcagcctcccaaattgctgggattacagacgtgagccactgcgcctggcctgggctggactcttaaaagtagatcttaacataatggaagtcttggacccagtgtcgaagggccacgtacccaacaactctccaagggtctaggtgctttgcaacacgtagacagcccaggccagtgctctagcagggtccacatactcctgatggtttacaaagttcatttaggtgctatacagacagcttgaaaaatgtaagactagttttccatttatgtagtggtagatttttaaacaagtatgttttaaataaatgagtggaggaaactaagacatgtatgtggacataacagggatgatgaaggtgatatcacaaggctgacacataccagcttacatgagtgtgaaattccacagcacaatccttttaggatcctctaaaatgggtatctctttggtcatgtgcccctcgggtatggcagttgaagcatcaggaaccttcctgactgttttcattggcagttgagtgttagagatttgtatgccaaattacttcttaataatgcttatactacttcacattttaacaaaatgttaaaatgggaggacagctgcctctggggttcacagacactttccaaaggacatgatggcagggagggttttcaggaaatccatttccacatcttaagccttcttctcttgctttttgcaaattgcatttcctgaagactagcttcacctgcttccttgtcctacctttctttcaaaactgcccttctccccctttacaagaggagaacctgtcgcaattcaactcactattgcagtaagaaaccttcattaaggctggacgcgtggctcacacctataatcccagcactttgagaggctgaggtgggcagattgcttgagctcaggagtttgagaccagcctgggcaacatagggaaactccatctctacaacaaatacaaaaaaaaattagccaggcgtggtggtgtgcacccgtagtcccagctacttgaggggctggggtgggaggatcgcttgagcccaggaggtggaggctgcagtgagctgagatcgcaccactgcactccagcctgggtaaaagtgagaccctgtctcaaacaaacagaaaaaaaagaaacctcaataaaaatttacctttgtgtttaataattatttgtgatatgtttgttgatcagttatatactaatagctgcaataaaccaatccagaatttgtaaattaacaaagccttaaagtaggacattttttaaaatatcattttgtatgcataaatacatctttttattgtagagaattatgaaaagctaatgactaaaaactttcaaacataaaaatatattacatcaagaaaaaattctgtggagaagtagaatggaaatacagttttacatagagaaagtaagaatacaagatttgacttaagagcttgttcttgagttttttaataggtcatggttgccgtcaaattcttatggtatttgtaatccatttagtacatttaaaagagtggtatgtatattttattttaaaatgtcaatatgtataatatatcagggattttagaacatgtgaaaggagacagagttgttcagaattccactggggactacactagaagttcggaaaccatggatacgtacactttcttcagaatcaaagcgatggcactgtaggtcctcagaggggagggcagctttgagcttggtcctatcaccttgataaggaatgtcctctacagtagcctgacatcgggttacctagatattctttggacactgtgacacagagtccagaacctctcagcacagagggattacagacttaagaatccggataactggtttctaatcttggctttgctgctacctatgtcatctcaggcaactcacatcacctatttgggcctgatttccatgtgtataagtgagagaactaatccttattgtgttttttaaaagtcgaataatgacatgaaatccaccatcctaatcctaagatgtgcccgttggagtttaaaaaacaaaagcaacaacaaaaacctgttctttccctacctatcagcctttcagatatcagaaggcaccttttatgttcccctcaaatctttaccagttttaaaatatgttgtttttcaaccttgacttacatagtcttttttttttttttttcccttgagacacaatctcactccgtcacccaggatgcagtggtgccatcccagctcactgcaacctccgccttccgggttcaagggattctcatgcctcagcctcccaagtagctggaatcacaggcgtgcaccaccacgcctggctaatttttgtgtttttagtagaaatgaggttttgccatgttggccaggctggtctcaaactcttgacctcaagtgatctgcccgccttacctcctaaagtgctgggattataggcgtgagccactgcacctggcccatagtcatcttactgaggattatttctccaggccaactattctcaaaccttttggtctcggtccctttcacactcttaaaacttattttaggactacccaaagagcttctgttcatgattatgtcttttgttttgattatgtcttttgatatttactgtttcagaaattagaacaattttcaaaatttttacttattcatttagagtaacaaaactgttacatgttaatgtaaataacagtttttagtaaaaaatatattttccaaaacagaaaatgtttaatgagaggagaggcattgttttacgtttttgcatggctgtttaaagtctagtttaatagaagactaggctagactctcatgtgcttctccagtcaatctgttgcagtatgtgttggttgttggttgaagtcaatgaaggatatctagcctatgcagatttgtttctttggtacttcactagtttttttcctctttctttctctctttctcttttttccttccttctttctctttctttctttctttttctttccttcctcactcactccctccctccctccctccctcctttctttctttctttcagcgttttgctctgtcacccaggctagagtgcagtggcatggtcatagctcactgcagcctccaactcctggactcaagtgatcctcctgcctcagcctccccaagtccctatgactatagatatgtgccaccatgcctggctatttttttttaattgtagagatggggtctcactatgttgcccaggcttgtcttgaaatcccggcctccagcagtcctcccacctcagcctcccaaagtgctgggattatagacatgaaacactgtgcccagccaacaagtggtagtttcttaaatgttagtggcaatgtgatatctgacatcttatcaatgacctttttgtacactaaaattcattagtctattttgcactttgagtgcatcttttacccatgcttagtgtaatgttctgatcatttggaaaatataggttcaccaagttatgcaggtcttcaaaatgttgactcatttcattatacaatatcataaaatcacatttcttaatgtctctactgatctcaagcattaggaagctgtcaggctcatggtggctgatacaactttttcaaaattctaattttcacttgaaagctctatttttatcattggtgacaaatactgttattttccttgaagtgacaggctcactttgtcactttgtccatttttgagaaaatgcctgccaaatacccaagttggaataactacaatttgttggtcattctttcaagtaagaatggtgctccgtggcatgagcggctagttcagctggcaactctgtcacatgactgctttcctcaagacagctgttgtacttccgtcagcagcagaaatgttgtaggctaactgtccatttcactgtgccacatacataagtgacatgtggttgagtcaatatttaatataaattactttttaccacttcatcaagggcattaattttttttgtttgcttgctttcgttttaatcgtgagggtgagctggcgaacaattgatgatgccaagtatggtttgctgccactatgttaattctcgccaaggtgccagcagtttcttccactgttgctttctatacccttagtgcaagtgttaacactgaaaaaggcaaacgacatcttagtattactatgaaaatatgttacctctgtggaggctccctcactgaaaggatcttggcagttgagcttggagaatggctgccctaggctaaatagaatatgcctgatgagagggtagcaggtccatcagctctctgttagtgtagatggtttcattgaaaggcatatacctctaggaatatagccctatttgcttcagttgttagcctcaatgctgcagttgtgatcaactaaaatctccaagcttcttttatgggagctactatcaaggaagacgtcttgcgtggggcaaaaaaattttttgtggaggacaaagtgagtcgtcctggtagtgcactgtagaatgggtagagacggaatgaaagtggagtaaaggccgtggggcagggctgcaaggaaggccttcgagatttgtttccatccagggatgtttttggaagctacgtggtgggggttaggaagggaacccaaacaagaaatggaaggcaatgggacaggctaaatattcaagatttgtgtttccaaaaaaagaatgcggggatagttagaaatggcagctgagagaggtgtgaccatgggacattgggtagtactagtggagggaggatagagagacggatgtgccacccacagatgcctggaggtgacagggggccagtcttctttccagaaggtaatgatgatacagtcaaaaagtcgtgaatatttgaagtcatctgtgcctgataacaagtcttttctcactgccccggagaaaaaagttctctaacattccaaaagcctcctcattccactgggcccagagttagcagtagaaattagtgcaattaattagaatttggaactcctgactcgcaggatgggtgtgtgtttgagagatgtttatgaaagatggtgtttatccaaaggatttccttttcttttaagtttcaaggctggaggcttaagcatctttgatccaaaggaaggaggtctagcagttgttataagccccaaatctttgcttaagtcctctataggattagaggcaccagggcaaggcagaacagagtgaggtggatgttctgtaaccccagtccaggggagatttaaggaagatgagagtcttaaagatggacagtctctgagtagagactggagaatattcttccttccctgcatctagttagtagccctgctgcccctttgctacaattctttctgttcttattagccacatttcacgtggaaaagccagtaaaatgcaaataataataatgatgataataaaatagcaggaggcaagtatttcaaagacggaatttcttgccttcacacattgttagggggcaaagaacaggtgggttttttatttgaattagctgctgcttgttcattcatcccttggcagagcaggatgctggtagagatctgcccattgttataagccagcccatcgtaggaaggaaggaacacacaaggcaattcattgttgttctccaggagaagtaagaaatccagacgttgggaagctgaggggcaggcccctggagtaagtgaaaggaggaggtagaagaagaggaaggcctctggttgggggcggggtagtgacaagggcatggttttcattcccccggtcctaacccacgccctggggaaacagagccacagggagggaagtgatgaatgaagttgcagccatttctcctaagaactcggcctaggatttgtgggcacaagcccaggagtgctgcgtatttgctcctgtcccaagccacagctgttgaccccttggttcctcactctaaatgctgctgggggaccccagctttacctagtaagaaccatcattaggaaggtagagtttacagggcatgttcacacatacctgtgtttgattctctccaaagccctgcaagatcagcattagcactgacccaaattatagaggagtagaggaggagaataggccaccgcttcgatgagcctgtcaggcactgtgctggctctcaaggcacagcactgtgaccttgccaaccataccgtaaagtggaaatgattttctcattttactcgggaggcagctgaggctcagaggcgataaaatgacgtgaccagggtcatagcgataataaaagatggaggcgaggaaaaagccagatccttcggactctgtggtctgcctgtgggaagagcaattttcctgagcgggtttgggctgattgttcttacttctctgcaacaagagagggtagaagcttactgtgtggttttgtccacagtgccttagggagctagcctggttatgtatctcaggctcgctcccctccctctccacccccggccttcctctttcctctttccacctttgcaaaaaagagcaagatgtccaggctcctgaggtctcagcttgcagagctggtcattagccctttgtgtcctgctaaccacctttcatctcctctacctgctggtgtccgctttccctattagcatctctcggctctttgcagagccctcggcctctttgtggccagcttgggttgtttgtcagatgatggctgagagatgcacactcaggggagggtggctctgaccaggagcgctcacattttccatgccaggtgccaggcatctctctcctctcccaccccaggggcagccaggtttaggtcacctggcatggaggcagacagttgatagcccggtccctaaatttggggcctttgaagccctggtgttgcctttcagttcccctccaagggtgaaatgggaactggctcaccggcaacttttatgcctaagcaagaagcctgctgaggaattcctggtctccagaagctcaccctcaggcccaggattctctggtccaacagcctccactgttggtcggtcaaacaaacgccctgggattcccaggaacatcctgctgccttcatcgtccgcatactaaatcatcaatccaacgaggcagccactcgccacacagggccatttaaggttacattaaattgatatttatagtatataatataaatttctattaataaaaattaaataaaaaataacactttagccaccattcttattttttattgtcagtagaattttttttttttttttttttttgagaaagggtcttgtttcgtcacccaggctggagtgcaatggcacaatctctgctcattgcagccttaaccttccaggctcaggcaatcctcccacctcagccccacaaagtgctaggattacaggcatgagccacccgtgcctggccaattttagccacctttcaagtgctccatagtcacacatggcaagtggctactgtactggacagcgcagatagagaacatttccatatgcagaacattcttttggacagcactgatctatacagccagaaattccagtatcttacagaccatctcttcctgctacgaagccttgaagctcccttgacctttcaagtgaattcatttgagttcccaaaatgccacggcctgttgggactggaggccaccaggcaaaggatgcctccgaagaggtgtcccctgtaaaattcaccatcaccatggccaggcatggtggctcatgcctgtaatcccagcactttgggaggctgaagtgggaggatcacttgatcctggaaggttgaggctacagtgagctgagattgtgccattgcactctagtctgggtgacaaaacaagaccctatctcaagaaaaaaaaaaaaaaaaaactaataaaaaataagaaaggtggctaaaatttttattttatttttattaacagaaatttatatgtgatataatataaacatcaatttaatgtaactttaaatggccctgtgtggtgagtggctgctttgttggatagatgatttagtatgaggatgatgaaggcagcaagatgtttcagggaagcccagggcgtttgtttggccgaccaacagcagaggctgttggagcagagaatcctgggcctgagggtgagcttctgagatgaacaatggtgcttacttttctacacagtggagaatgcaagacctgggagattcatggtgtgtgtaaatgtcaaggcttcattccatttgcaaaggatggaacttggtgatatggcttggccgtgtccccacccagatcttatcttgaattgtagttcccataatccccttgtctcatgggagggacctggtaggaggtaattgaatcatgggggcggttactctcatgccattctcatcatgatagtaagtgagatctcataagatcagatggttttataaggggcttttctccctttgctcggcacttctctctcctgccaccttgtgaagaaggatgtgtttgcttccgcttccaccatgattgtaagtttcctgaggccttcctagccatgtggaaccgtgaggcaattaaacctctttcctttaggccaggtgcagtggctcatgcctgtaatcccagcactttgggaggccagggcgggcggatcatgaggtcaggagattgagaccatactggctaacatggtgaaccatcgtctctactaaaaatacaaaaaattagccgggcgtggtggcgggcgcctgtcgtcgaagctactcaggaggctgaggcaggagaatggcgtgaacccaggaggcggagcttgcagtgagcagagatcgtgccactgcactccagcctgggtgacagagcgagactccgtctcaaaaaaaaaaaaaacctctttcctttataaattacccagtcttggggatttcttcatagtagcatgagaatggactaacacacttggtgtccattggattcatttcagccatcagctttggcagcccaatgtggctgctggatgtggagtccagggctggcagagggaggaaggtgtagggctgggagaatcacagctgggggtggattcttctagacctgccctaccctgggctgagggtgagaaatgcctctgagagctgcagagagaagggaaaatgatttgtgtttgtttttgcctttctgtagtacagagagaaggagcactttggggaaagaggtttaaccagaagcagtttcttttgggaacaggggcagttctttactccctgccagttcctgcaggcaggcagcatgccggcctggcctgccgcctcaacccctacctgtcatgtgcttggcaagtctgactcaagtccttttttccactgcctaccccacccgtcaaattgcagttgcaacctctcatttttctgctgcctagatgattaaaaagcatgacttagtggaaaaatgttgacctccttggggtcagcctctgaagcagctgtcagagataagattgtgctggcaaattactcagcagcactttgcaaggctttctgtctgtctgtaaggaaaccagaagctgttggttctgggtactttttgtgtttggagagagctacaattttgaggcccaaatgggtataatctgataataaaataagatctctgatggaagggttcgattattgtagtaatttttaaaaatacaattaataggctttgtaaacaaacaaacaaaaaaatttaaacagtgcttgcttcgagcaattcagggagcaaagtcctctggcagctaagcagtatcagaagttcaattctcagacctcttgcaaggtcttaaaagacttaattgtggagctctcggtatgaatggcgctgtttggaattattttaattactgtgttcatatgactccctcttgcttggagattggatgcttactgtagttcttttgaaactgctccaaagaggacattatagtttcaattttgcttatgtcctcaaagtattttatcatctttatatttgccaagaacttgtacccatctagtgagacaagaaggtcacctcatgtctcaaaaggagaaactgaggtgtttggggttgagaggacttgaccggagttatacaatggtggtcaaggacatagtgagcacctgggttgtgtggcttaacccatgctatcaagtgaacgcttcatttgaagtcctacaggtctgagtttggatcccagttcagctgcttcccaggtgcgtggctttgagcaagtcacataccgtctctgtgcttcaggtttcttatccacaaaatagggttacagtagtccccgttatctctgggggatacgttccaggacacacagtggttgcctgaaaccacagataataccaaacccacatatgctatgttttatcctatacatccatacctgtgataaaggttaatttataaattagactcaatgtgagattaacaatgatagctaacaataaaatagaacaattataacactatactgcaacaaaagctatgtgaatgtggtctctctctgtctctgtctctgtctcacaatatcttattgtaccgtacctacctatcttgggattgcagttgaccgtgggtaactgaaaccaagaaaagcaaaactgtggataagttggggggtggtaactagaattattgtgaggtttgagattctgctcaggaaaaatttcatccatcatcatcatcattagatttttttccttattttaatgaaagacctgtttccagcttgaagtgaaatccaatgcttcccacccctctcctcctcttcgtcctcttcctcctctcttcctcctcctcctccccctccccccctcctccttttgctgggcctgccctgcttgtcatgccttttgcttttccttggcttaggctgtcatagttagaattgggttttcactctcccagccctgacaatgtggccctggcacaggtaggcacaatcctggcagtgaggtcagagggtggaggcagggccaggctcttcacagggcaggtccccctctcctcttgacagcttatggcgctgtcttggatcctgaaggtttaaaacaagcattgggactgggaagctcacctcctgggctggggccctcacagctgcctgggcagtgaaggcccagagtcttactctccctccctgctcagttttccatctgtgaaatggggtggagacccagcagcagcctaatccattttccagaaggctcaggcactgaaaacagcagatgtaggtttgaatcctggctctgccatgtgacccacagagtcccgggtcttactattcctagagtggcagtgagccctgaacgagctgacatctgaaagagcttcgtgacctgtagtgggcttccctccatcggggtccctctcacccactctcagagctcatgcttggagggcgccttgtgtcctcacagcccatggggggctctggccccacccaagaaatgaggacgcacccaaaaagcccacgtggcgctcctcgctcggcacatgcacgtctgggcacagcgccgtctgagggcagaacttctgggccaacctggtcaggaagacagagcccagagtcggggtccgtgtccccctctgcctccgtgacccacactggcccatcccctccctggacttgttttcctcctggctgccattatgataccttttatgagcctcgttaagtctttaatgatgcctggttgtgcagctggcttaaggcttaatccccagcaataggtcttattggataaatggttaataatcactcgtttgcaggtattgggaaggcttcactgaggcctgtgattcctggaagccccacgtggcctgtgatgtggtgagagtgtgacttggctggggcagcactgcatggggttgggttgcaataagaccgggtatcctcagagcaccacagaagttgggaaggcctgagtttgtaaaagggcctttcttctatgtcctggtaatgggtgactcctgtctgctgccgtgggcctgtccccatctggatcaaggtgcaggcaggaccaggcagccccccagatctcttcaaatgtgtctccacccactcaaagttttgctttcctttcttgtgccatgaacaagctgtgtgaccttaggcaggtctcctgacccctctggggccttgagttgctcatctaccaaatggagaggtgggaagagatggccatgaaggtgccaagtgcctgattctgggagcccagcatcccagacagaggcttctctctctagctctggggtgtgtcactgagggctgtgaatggcagggaccagcagcccagcggattaagtacttaaactgctgggccaagaattgggtcagctgtagtcacagggcagtgtatgcaaagggaatccgcagagccagatttggccctgattttatagctgggtttggagtttctgccagctctgggcaggacacaaagtaggcattaaaaaacaaagcctggctgacgggactctggaaaaagaagtagactccttcaggtgtagagctggcaagaagccaggaactgttcacaggtgaaaaaggatccttggattttgttcccagcctgcctgtgactggggaccatgccgttcatcaggatttggctttgactttacagttgcaatgggatgaggacccatctgcttgagggacaagctggtgttggggcaggggaatcgaacatatccagtttttgtttttttttattttcaagatggagtctcgctctgtcgcccagactggagtccagtggcgtgatctcggctcaccacaagctccgcctcccgggttcacaccattttctgcctcagtctccggagtagctgggaatacaggcgcccaccaccatgcccgcctaattttttttgtatttttagtagtttaccatatgagaggtttcaccatgttagccaggatggtctcgatctcctgacctcgtgatccacctgcctcagcatccgaaagcactgggattacaggtgtgagccaccaggcccagcccagacccagttttcaatctcatcccatccctcactcatttctaggctgtctggtcttggaccacctactctcccaagcctgagattctttaagctagcattagcaacacctgtttttcagcatgactgtgtgggttggaagtgatatatgtatagcacctggtaacctgctcacttagtgccaataattattccgggaggtacttaatgctgtggcacctgttgtattctttgtactgctggagtaaaatacttcctgcagagagagaccagacttactgtggataacatgatttgggatgattttatctgcaaataaaatacagaatccaaacagaatcacatcaacctttaaactcagcggcactgcccccaaactttcagcttcaggattggaatggaagtctgactgagggacagtttcctatgttgccccagaatattctcccgtggctcccaccttatatactccacagcctcccgagtgcaaagcacagtccctggcctatggcatgcacccagtatgccacatggatgtgcaaagaaggaatggaatttctcttttcaaatatctacgtgaccaggcacctgctctgcttttctttcagatcttcccagacccgtcagattttgaccgctgctgcaaactgaaggaccgtctgccctccatagtggtggaacccacagaaggggaggtggagagcggggagctccggtggccccctgaggagttcctggtccaggaggatgagcaagataactgcgaagagacagcgaaagaaaataaagagcagtagagtccctgtggactcccatgggtcataccagccagcatctgttcctgaactgtgtttttcccatcatgacggaagaagagagtgagccgcaattgttctgaaaatgtcaaacgaggcttctgttttgcacctgcagatcaccgagttggttttcttttcttttcttgcctttttttttttttgaaatttgccgagcagtggagccctctgacaatttgcaaggccctctgagaaaggaagctgcttagagccagggggttagtgggtgaggggagcgagtgctgtttttgagatcattatctgaactcaggcagcctagtagaggcagtggtgggattccaatgggtcttggtgggtgggaggtggggcatgtgcaaagcaagcaaggaacatttggggtaagaaaacaaacatgaggcaaaagaaaaaatacatgtttttaagaaaacattgagcagagaactgcagccaggatgcgctcagcagacattcactctggctgctgggacatcagaaaacaaagtcttcatctctctctccagtttcacccaccccaccctttgctttcatttcaggtgtgttggtctatatgacagggaggagagtaaaggagagcaggagcaattggctgcctgcaaagccagctggaggtgaagtgcaggaaaggaaaggtcaccccattctactccatggcctctctgctcccagctgtggtaggctcacatagccagtgtgatcggtttttaagaggcagtgcttttcagcttttctccctgatatatccattttgcttcccagcactttttaggagtagtgagagcacttcctgcccttgttggaagccccagggtggacactcagcacgaaggtctctcccttaactgctgcccttccaagacttgctcccgagatggagtgggcgtggtcttccaggctggcccttccttctcctcaccgccaccttccctgccccagccccagcagccatgggtacatgggtccccagctcacctatggattcccgccagtctgcccagctgcagtactcacgccccatgggggatcttggtctgtttttcttgtgggagcctagtggagagcagacgtggctttttatgtgtcttgttggggaggtgacttgcatggtggggacaaggctgtcgtggcaaccttgggatcgagtttgagactaaaggatgtcatgagatccctggcttctccccatgttgttcccggacaagggcagaagggaggcatggcaagggacctctgctgtccttactcaacagtggtcctcatccctccccacctcccactgcttcctgcaagggcaccagttgtatgagaaagttggcctttggacttaggatttcttattgtagctaagagccatctgaagcagcaggttgcaggacaaatgcttcagtccgccgagagcagtaccgtgtggccaagaggtggactcagagccttccttgagctaaactcggccaaccaaggcacgcagcatgtcccctcaggtctccagtcagtccaggttgaccctcagttctggacgtgtgtatatagctgtatttaatacctcaaggtcattgtggctctggggatgccggggcaggaggacgagggtgcgctgtggacacagcagtccgcggaattccgttctgggaagccaatggtcgccggcaccccttgcttcctccctctgttgtctgcctgtgtgacacacatcaatggcaataacttcttccaactcctcgcagaagtgggagaggccggcagcctgcaccgagaggggctttcctctctcttgctccccgcttcgttctgttttggctgcagagagtggttcatccatactctcattccctcgcctccccttgtggacgggggtcttgccttttcaattcctgtgttttggtgtcttcccttatctgctaccctgaatcacctgtcctggtcttgctgtgtgatgggaacatgcttgtaaactgcgtaacaaatctactttgtgtatgtgtctgtttatgggggtggtttattatttttgctggtccctagaccactttgtatgaccgtttgcagtctgagcaggccaggggctgacagctaatgtcaggaccctcagcggtggagcctgctggggggacccagctgctcttggacaagtggctgagctcctatctggcctcctctttttttttttttcaagtaatttgtgtgtatttctaactgattgtattgaaaaaattcctagtatttcagtaaaaatgcctgttgtgagatgaacctcctgtaacttctatctgttcttttttgaggctcagggagaaactagcatttttttttttccaaactactttttgtcactgtgacagttgtaaataaagtttgaaaatgctttccactctg

SEQ ID NO: 1612 - DNA, 1368338 bp, Homo sapiens
tttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtgggtaaggtcattttatatatgcaaacccatcagtggcatgagcaaacttgggcatttgtaatgggaatgggtgacttgaatgattgctgcatcgcattgatggctgtgatgtggccgttattggcactgaatggaataactgcagttgggtgtgttgatatgtgtgtgtgtgtgtgtgtgtgtgtgtgtgtgtgtgtgtgtatgtgtgtgtgcgtgtgtgtgtatatgtatgtgtgcccgtattctgagtgcaattgaaaatcaaagtatcactctctcccccaattattttgatatggaagagtgtcttgaattaattctgggtagacactctttgtttgaatgtaatatttgtggcccctgcgttctggaaggggtagcagcagtaaaagaaacacttagtgaagagccccatttaaaatgaaacgagctactctctatgcattaaaagaaatatgttttcaactcagtgcagcattctgctgcatttcacagccgcaatgggaccagggacatcccacttgtcaagttcttaaactttaaggtgataatcatcgttaattgttctctaggttgtggttactggagattattaagcgccctgggctacttttttatctactggattatcactcagagtgaaaaaaggaaaagaaaagaaaaagctaaaaatgatggctaacatagagaagaataaggcaacattatcttaaatatcaccacagtgctttctttctcaagttcaattgcccaataatataattatttacccaatatcctaaatagctgaagctgagacccacgtgcaggggagtcgaaggtctgaaagcagagaccgtccttttattgcaatgcagccagcttgggaaatgcaggcaattaattacatacttcccctaaccttaagttgaagatgtgtcctgtctgctacatctattttaccctttcggtaaaaagttagagactagaacactaaggatgtttaagcatattctgcctgggaaatgggataaagaaatcaatattgatgacgtggttcagtgcactgtactgcaatgctaaagttccatattcagtgcctgtgatgagagagtggagcatttacatatgttataaatctcacctggtagattgatccaaaggggaggggagaagatatgtggatatgtaggaagatggatggaagtcgtgcataatcggtgattatgtaacttcattacatcagcgagtttcagtcaacgatagtgagatgagatgattgtatagagagaggctccatcaccctgttaacttttgaaggcttgtaacagctaacagaggaggagggcagagagagattagctccaagggtcctgtaaaccttgatctctatggcaaattttgcatgagttttctcatagtgagtttcggagggacatcagatcatataagctttagggctggacaggaccaattttagccacacccgtggagagtcaaaatgagtctgcgatgtttcagaagtgccccattgagtaactgggactgatgattccagccaaggtcatagttctttaccctaggattgaaatatatgaccccaactgaatggaaagttaaattcattgaaatgatgactgtgaacggaatgaatatttagggtcctttcttgcatttttcctggtagagcttgatgcagatttcagcctggtggttccctcataaaaatgatgattgcttccacagcgtgtcagaaatgactgttttgtccctttatcttaaccatgacaatctctttctgggccattttaaccttctgggaaaagagaagtaaaagcattcaaaggtaacagtaccctgttaaattacaaattaaatggcactggattcattattaacacaaatcccagaaaaaaagagcaatccatgttcaagtttcacttattgaatggcttaaaagacaggttgcagctgccaaagacttttaccatcatatgagataaatgtactgtgctcactgtgcagagaagggaatactgcagaataaaatgtcattttccctcatgttttatctggagttgtgattttttttaaagaagatacacatcaggtccttttggccttctactgttttaggatctgttttctcctcaatagatcacatattcacaaaaaatgaaacttctgaaatcctaaccctgttcagttgaatcaccttattatctagttgtgctatttcctatttctctttacatttattttacaaagagggctaaacgacttttctgtcagggagatgagatgatttttttctgtttttcttttatttctcatattccatttccttccagtcctaaggagtaagatgcagaatctagacaccctctaagtaactttgaaaagatttgctcaccctgagtcagaatggtgggattggggaatgaaattctaaggtctgatatttgaggtgactttcatacttctgcaggacatgcacaaacattgatgtattgtgccagtggattgggaggtttggcgttcatattgtgtaggaaattgaatgtgaatttaactcctgattccttccttcaggggtcagggtagcacaacagctgcttccaggctgttggtttccaactatgtgcacaaatatagtctgtaatgatttttcctactccttctttcaatattttataaatgacttcctcagttgttttctgacgtaagccacacatatgttaccaagcagggcataggttttctaagctcagtaggagatggaaataatagcaggatggaaaaagattctgtacaaaaagacactggttgtgaagcaaatatacatatgtaattgctaactccttacttgaagactgcatatacttctattaggaaagatagtttcaatcatgttaatggcactttataagctgttactttctttaggaagattatgtaactaaggcaggttatggcatttttcttaagtatcctacacattagtaataaaaagctttgtctaataggaaagcatttaaacatgatggcagtgggtaatttgaaatgtaacatctattttctattttatttccattttgtcagccgcagtcatgtagttaggttagaaaatatttgggaaaaaaagaaataccatttatgaatatgaaagctatcaattttgcttcctgaccagttgcttcagcaaagtaaggagatttagcagataagtaatcacggtattcctaaaactagagaaaattttaaattgaattttcattatgtttgcaacatatgtgaacaaatcagtattacttttaaaatggctattagataaaacattttaaagaacagttgaactttgaagatttatatttcagaatttgttagtttgttacacactgaaatgtttgggatgtactttgacttacaacagatatgatgtttggtgtttggcaaatcttgtgtttttataaagcagactactctataatttgtagcaacaaaacaagtgttgattattgagatttaaaagtagcaagttttctggtgatgctcaagttataaagcataattataattgtaccggttgggcagctataggtaaggtcgcgtcagcctttttattactaaattccaaccctatttccattaggtttatcgggaatctcaaagaggagagtccagttctgtgagacatcaaggcattgtagaattccgggctgagtcagagggctcgaaactgtacttccggctctgtcaattactagccttgtgacctctgacaccacatttgatttctcagtgttccagagaatcattttttaaaaaaataaatagttgcacattgctctacagaaaggagataatatgtgtctaagtacttaccaccatcctatgccttagaaatatatggaattattattaaggattcccttaagtcttattaatttagctgtgcatgttttttacacccttattgtaaatctgaataggtgctttctagtagcaattacagttagctgtacataatactgttcagtgattaaccaacaaagacaaattaaaagctttgttggttaactttcactcagtactcagttttttccagaagtactcatatgggaatatagttgtcttaagtaattaaaaaaatagttgcttttgaataacattcaaacagtggtaactaagggttttatgtgtgagagtgttttctgcagattgctttttaaaaaatgcttctgagtacttaggagtttctgtttctgctaccaagagcacacaaacaaatgtacacaaacttgatgctacttcacagactgagtacattgaccagaaagtgactcttgtctttcagtatattaacaaaagcataatgagtttgaataccaagtgtaatagagaaaatgagaatataaagatacccggtctgtttggaattttctagttgtaataattactaactttctttagggggaggcaatcccccatgtgtcactactaaaactgcatctctttaatgttcttgtatcttaacagaatgatatttacatatatgcaaagaggatagtttagtgatatgagcttccatgtatgtttttcagtgactgaataatcaggttacagagtaagtttttgtattttggttaaaatagaattggaaagtgcaaaattaaccctgtaataaattagtagtcctgggcttaaaataaagaattttcatgttgtagagcaacctcctcttcgtaacttcccagtgtcttgcttttcttttcaaggattcccaatatatttttgtttcagatgaatttcattatgcatgtttatctgacttcattgatgcctattaatagcaagcattttcttggtttcctatatttaaaaaatgcatgttctttatgtcttatggcaatactttagatttgctctggcagatttatgaaagaatattgtatgaatgtagacaggcttgtttatttgacaaattcagctaatcaccttacaaatatgcttttaattttcacccagaaaatgccaccctggagtgtcttatactgcatataacattctattacagtccaaccacatggctcagtggacatacttatccattaagtatgcttatcctgaccattggtttactaggaaagatccttaattgacatgctttttggtatccttgtgtagacacaatattcaggtgcccaaactctaaaactcctgtcttttagctacagagaagggatgactaggtggcttgatgttgctttcttatcacatgatctgaaaatcccaggcactgaactgtgaataaagcaaagggagaaagaaaagaaagagaactaaaagaaaattttacttctgaaaattttgctctttcccattttaatatcacaatattaaaagcaatcttttttatcacaagctattcaaatggtttgttatagttactatgctcatatatatcaaatacgataaatggcactaaatgagctgctttgttcttacaggagctacacctctgtgaacataaatttaagagttaaactagattgtacgttgtaacactacgtcaggatattgtgtgtagaatttggacttactgaaaaattgaaatggattgtggattgtaatcatataattatagacttttactctttcgatgtttattaggtatcttatactttatttgaattataattataataaatcagcatatggataatcataaaattattcatagtagtttatcttcttatgacctaatcaaaacgagttaccttatcgatgttttagattaatatgtatgacttggtatagtgatcttcatcattttctggtgcaaagttccctttttaattaaaaaaattcactggaagtccacttagtcatagttatactttcagtatccattaattgagaaaatgcatgataataatagtaaattattatgaatataataactctttaaaaatgaatttatgtatagtcacaacagagtctacttatatctttgaaatgcatggtttattctatctacatagaaagtttggtgtttatatagattctagattccttggagtaactcctgcagctgtagtaaataaaagatccatatgtctagaggcaaaatacttgcattacatatacatattaatcatgttcatcttacagagaaaatgaaaggtaagtgcgtatggtggtggtttgtggatcaaaggagttgaatttcggtatagatggacttaagagtatataattttctgaggatgtacatttagagttccaaaatattcccattcgagttttaggattcaacagttgtaatttaaaattggttgattttggaaaataattgcttttttaaaaaataaacattgtttttattgtagccaaaataaaaatgaattattataaaagccaaaggtgatcaaaatctcataaaaacctaatagaattatatgcattataggagtaagggatgccccattatgtgattttaaacaaggaatttgcaaaccagagaaatgaagtgaagtttccaagatcttacaatttgttggctctctcatgatgcatgatttcagttccttcatataagccctcagctgggtgttctagttatatagcaatatgtcctggcatacagcattattttttattagtacagctaatgttggcatatcgaatcctttggcctctagcttactttaccgatttgtgatcagtcgtctgacttctgcactcagaatctgtggactttatttttcctttacgcacacctgatttttgacctcatttgatccctggagacacaatacaaaggagagttgagaacataggtcactggtgggtcttcttgtcttttccatactgtgcttttcccattagctttgtatctttccacctgcagggaattgctcttctttggagcctctccactttctggactttcctgaacatccctggccatctttgtctcagtgctgcatgctaccttcttgcttccaggggattccactaaggggtcctatcaaaatatcttctagctacactttatcccactttgacgatattgaatttcatatttcatttcttcatcaacagggtcagtctgcttacataaacaatagtgaaccaattttggaataatgaagacagtaatattttatcaagtttgccaagctacaatcatataactactactaaatgaacaagatacagctggtgtgtgtgtgtgtatcctcatatcctaatgactgcattaatatgtgtatccacacacatacatgatttttgttgaaatgtttgacaaatgaatcatcgttaatatgctaaagaggaaagtttggaataacaggctttatccctttgtattataatagtgacatttctagaaaagatgccattaacttctgaccccgaaaaatagcttgaaaggactgcattttagatgataaggtggagacagggctgtggaggacatacttttgttcaggctgaatcccgcagtgccctctagagttactgggtagggagctggtagcatacctgtatgaagaaatgacactggctatgaacactatgatgcttacaacctctctgccaactttatttcagaagagacacagtcaggagagctaaatacagtggtaaaaatggaaaaactgagagagttagaatggtatcaagtattttgtgtaaacaaagcttcatgtggccaagggagaaaatttgaatgtaacaaatggatctggtagctctcagtgtttggtttttggatacccctattaaagctcctaattgttctcaccatgacagaactcctgaatggtactcaagaggcacccagctccacagtgtgcagagtaaatgcattcaagggatctctaggggtttttgactctgctgttttttcttgtcgaggttctcctacagggcccttaataacacagccacagagcaagccgcttatgtcagtgggtgtgctcttctcaatgagtgaatggtttagcttagctctaggaggcaagtgcctgctggtcttgtatttccagggcccaacattgtgcacagcatatagtaggtcatcagtaaatcattacacaagcaaacgcttaaacacttacggataacaggtcagttttagatctgtgttctccaaaactcatgctacattatacgtagagacaaaagcttctgatttaaaaaagtaaaaaaaggaaaattgagtaataaaggagagagaattaatattaggtagtttaaaacctacaaatgaactgaaggagaagaaatcacctgcctgcctgtctccctccctcccttccttccttccctccctccccttcttcttcctttcctcccccttccttccacctctatcataggtatttaagtgccttcactgttcaaggggatgcaagagggactgcaaaggtccctccctacagagatgactgatgtcatgtgtctgggcccaaaaatggtttagttagggatatgactactaaacaaaatcacatataccgacatcccttggtgtccatggggattggttccaggaccccttgtggacaccaaaatccacagatgctcgagtccctaatataaaatggtctcgtatttgcatatgacctatgtacatcctcctgtataaattatctgaagattacttatacctaatacagtgtaaatgctatgtaaatagttgttacattgtatttttatttgtattatttttaattattttgttgttctttttaaattgtttttaaaaaatattcctgatccatggttgcttggatccacagatatggaaggccacctgttattataattcaagatagtctaccatacatacttctaagagagatgccaagtatgctatgggctcaagaaacgttcaggacacatgcacgtagagggattaggtgaggcttgctgaaggaggcagcctttgtattggactttgaaggagttaacatgggtatggagatgtgaccttctaaatagaggggagatcaaaaatatactgtaaggaggaccaaatggagcatggttaaggaagatccaatgttcttgtttccccagagaagggggtatatgatatgaaatgtaagaagataaggctggagccctgagccttcatgtctggcaagcaggagccaatggaatggtattgcatgagcttaaggaaaacagaacatttcatgacccgctcagatttatgctttaggaagaagggggatgaattaagagtgtgtatctccaggttaccattgatttcaagttgtgtgaatttcccagtgactcctgagtttcacgcttattccaattttctcatgtagaaccccaggcctcaaacaggcatcactggctctcttcattttcctctttctttcttcctttcaaagaagaaactgctgggtgcagtggcttcacgcctgtaatcccagcactttgggaggcggaggcaggcggatcaccggaggtcaggagttcgagaccagcctgaccagcatggtgaaaccccgtctctactaaaaatacaaaattagccgggcatggtggcacatgtctgtaatcccagctacttaggaggctgaggcaggagaattgcttgaacctgggaggcagaggctgcaatgagccgagatcacaccattgcacttaagcctgggcaacaagagtgaaactctgttcaaataaataaataaataagcaaacaaaccactgctaccagtgctggataaatacagaagccagagtttaacattagcttttacttttttcaagcagaaggcaagattctgtaatggggctgatccattcaaactatccttgcttggtagtattagaaagttgccacacactgtagcaacaatgctaagatttaagtaactctttaatgagtacactggataatgtttaaagtttatttctttactgtgatggcaacagcaaagtgactctaaagtgacaattcatctggaagaaagaagttgaaggaagcaactgggaaaaaagaaaaaaggaaagtgctttatataatgtaatgccaaggtggaaatatagatttcaaaatggttttatagtaagatcatatggaataagaatattgctttcgagtagaatgtacattcagtaataagataataggatttatttctaacaagtgtgaactcttttgctaactaccaataattataacaattttgaattgtagctggaaattggaaagtgagcctcctagtaataaaaaatccccatgctagtttagtttaaattatttttcttatcaaatactttatctacacttctaataagtggaagaaaagaaaccagtaggtatagttttttttcccatactgtatctgatcattctatattggaagatgtagtaagctggaaaatagccaaacgttgaagacaaaatgagaaaaaatgcaatttacttaggcacaaactaaatgttatgtacatcatccttaggattcaggtgaaagaacaagtctcacagtctagctgttgtcaaaactcactcccctatccctgaggatcctgattcggtgtttggaatgcagtatagaaatttgtaggtttttttttttttttttgagatggagtttcgctcttttttgcccaggctggagtgcaatggtgcaatcttggctcactgcaacctctgcctcccgggttcaagcaaatctcctccctcagcctcccgagtagctgggattacaggtgtgcgccaccacacccggctaattttgtatttttagtagagacggggtttcaccatgtcggccaggctggtctcaaactcctgacttcaggagatccacccaccttggcctcccaaagtgctgggattacaggcatgagccaccgcacccagccgagaaatttgtactttcaaaaacatttgagggccaggcatggtggctcatgcctgtaaccccagcactttgggaggccgaggcaagggaaacagcctgagttcagcagttcaagaccagcctggccaacatggagaaatcccgtctctactaaaaatacaaaaattagctgggcacattggcaggttcttgtgatcccagccggctactcgggaggctgaggcaggagaatcgcttgaacctgggaggtggaggttgcagtgagccgagattgcaccatgcaccattgcactccagcctgggtgacagagcgagactccatctcaaaaaaaaaaaaaaaaaattgaggtcagtaggatcaccaagatgttccttgggagggcttcagcagaaacctctcagtctctgtcagtattactttcctcctggcgtcataagttacaatggatattggatgctttcttgatgttttccaaagtgcccctccaactcagcttcaactttcaagtaataagtcatttccaaccacaatggcacagggtaggcccctactatgctgaaatcctcacactgccactgtctcagttgattatcatgcagcaattgtggctcattgtgggtccctactaaccactgtccttcagtcctattacgtgatcagaattgccccttcccatatgtattttaatgaactccttcatgtgagtgaatgagaaatactacttgagggccctatctgttgtaagaatggtgcttaacacaggctgtagatgctcaagacagttcttgccatctaaagcttatggaccagtgggaaaggcatatgtgttcaattgggctccctggaaacagactccgagatgaagaattgcatacaaaagttttagttgtttctgaggcagagaaactgactgcaatgtggttgcagctggggccccagcagttccaatgagaagttctaaagatttgatggtccttcaaaattgtctcacattgagtcaagggggttggggctttctgttttcacgtcaggcagtgactggcggggggctgccccacaggaaggagcataatgttgggaagacagttacttgcagctgagggtaaatcccgatgagggactcggctgtgagccaccaacggcaggatgggtatacaggccattaagaggggaatgaaagttatttggagtctctgacaagatcgtattttttctctcaccccttgaggcatgatgcaataataccatatgaaattactgaggaaatgctgtgaaatcgtaaacatttgtttaaagagataaagaaactaaatacaatggagtataaggccttgctctatgtagttttgcttcagagaatgtgattttctcaggaatgtagttcaagtcacattatagttactctgttgtaagttaccaggccacaaatatctaatgagcacgttctatgtgtcctggacttccagagagagagaggaaaaagtggaaaattcatgcctggagaatttacataggacctttttttttttcctcggtggttcatgtgcctgattttgagtttaaggaggggatttgggggtgggggtcaaggaaggggcaaggaaatggaacagagtagagtggggccaagttttctgaattccaaggataataagacaattgtttgggttgtacaggaccaggctacagaggaatattgaaagttggcggaaggcacagacttgatgaactgagtggtagtggaataagtcgaatgtagatttactggtacagaacagacagtgaaagcagtgtttcattagcattagccagtctatgatttggactggaggggaactagttttgaatacgatgaatttgaaatcatcgaaataatatatcctagagttcaattttcactgaaaggaagcatttcatataacactattcacttttatattatgtggaaatattaatttccttccttaatgcaagggaagtgacattacttagatttttaaaatgctttcttcaaccctagtgaggtaataggagcaccttctatttttatcctataaagattttcaatcaagttaaatacactgacacttaattttgccagtaagtttttaaagtactggctgtgtctaaatgggcaaccattcattaaatcatagaaaaattgaatagggatgaactaagtacatacctttacagatataaacatctctcggccaggcacggtggctcatgcctgtaatcccagcactttgggaggctgaggtgggcggatcatgaggtaaagagatcgagaccatcctggccaacatggtgaaaccctgtctttactaaaaaaatacaataattagctgggcgtggtggcgcgtgcctgtagtaccagctactctaactagaggctgaggcaggagaattgcttgaacctgggaggcagaggttgcagtgagctgagatcatgccactgcactctagcctgagtgacagagcaagactccatctcaaaacaaaacaaaacaaaacatacaagcaaacaaaaaatctctcaactaccaaaaaattatccattaactgatattcactttaataaataaccactttggcaattttttccctcacttgacctaacattgactagatggtcaactcaattcagttcaacaaatacttccagatgatccacctactccatgcttaattcaagcacaaagctagaatgaggaatttactcattgccacagcaactgaggatgcacattgttaagcattttaaaagatctgtcttaaaaaaaaatagtaatctttgctaccagcacctagcttgctttaaaagcatttgttagattccttctctggctttggcttggtttttttggaataataataataaaaaaaaaagttggccaggtatggtggttcatgcctggaatcccagcactttgggaggccaaggtgagtggatcacctaaggtcagaagttcgagatcagcctggtcaacatggtgaaaccccgtctctactaaaaatataaaaattagccagacgtggtggcgcacgcctgtaatcccagctacttgggaggctgaggcaggagaatcgcttgaacctgggaggcggaggttacagtgagccgaaattgcaccactgcactccagcctgggcaacagaacgagactccatctcaaaaaaaaaaaaaaaaaagaaaggttcatggtatttttaaaagaccaagaattcaatcaaggtgacactccttttccatcacaatactctacttgtgtgtatggacctatatattttattgtttcaaatacaaattgtgaagcttattaaggagagtccaacatttctatatattcactagctgttttttcattaaatataacttcaaggctccaggctcaaaaattgttccatttttactgattgcatcatgctatttgtgcacagcacacttttatttttgtccgcatagatttgaagcaatggtttttttactctgccacacaatgccacatccctgacagtaggtaagttatgttcttttgcattttttactcaagagctatgtaggtggtatgggagatgagtggcggctattggaacagactgtgcatcagacgctatttaaacctcatctatatgtgcaagttaagagttactatttcctgtttccaaagtgaaaattagttttaatttcttaaatttgtaatcagagaagatgtgggttattgttctaagcatcttctttggactcttccaatgttttggtagcaaagattcaaatattagtaagtctaaattcatcttttattaatttgggtactcctgctagcccaatcttattatttttaatattagtgttaatgttactattggctatgattacaaaagtataaaaataatatatttaataaagcctcatcatgtggcttcagtctagttttgggaacctgaaagatattatgaaaattaaaggtttagtattgcttcattgaatcattacttaagtcaaagatgttaagcagacttagttattatgattaaatcctttccactccaagaattacagtaccagaaatgtgcaatttgtatacacacaaatttactttttgagactattgaaaggtaattggaaataatttcatacctgaggacagtctcttagaaaacatatttgtgtgagtccttgtttatttggatcatactggagttgtaggcaacatatttgtgtgactaatatcatcaccattgtctccatcataatcattatcaacaagctggtattaattttaaaagtgttcattatacaatcaaaaaagaactatataggacaggaccctgactattgaatataatgagcttgaaccaaggattatgtggcttgcggaaatactgtgaggtaaatgaattttgcctgtgacatacttctgtgttcagtttcagcaactcccacttcgtttgaatcccaaatgctcacgtgaataactttagtttctgaatgctaagagtattctgtcacagagaagactgttttcttaaaaatatatgctcccaagctaccactagctatgtatttttctcatcaaatttattatttttaaatgtatttctttgtgtcttcctaactttagtataaggctgagaggatatgacctcatttatctggttcaccacatatctttggtgcccaggagagtgcctgtcacattgtgcaatttagttcaataattatcaaaggaaggaaagaaaggaagaagaaagggagaaagaaagaaaagaaagaagaatctcccgaggtgtcctggtctaagcaagataataggagaaaagagagtttgatttaaaaacacactaagcctagcttggtagatatatgacatttgcattgtaaaggtgttgttcatgatgcaatgttactggtatagtaaagttagcgtttattccatccctcatggggatgggtacaggtatatcacatgctctaaattgccaggtctgttgacagaatgccagaatgccaagctgatagcttagaacctatagccaaagattttggttgcatcaataatgcagaaagcgatgtcttaaggaccattattctgacagtatgtttttaaggtgagcaatgccaagatagactgaagcctacagttagatggcactatatattttataaattacaaggtgataaaagttctcattgttttagcttcttagcttttttccctacttttccctatatataagtatccattaagaagaagctttaaaaaaacactaatttcatttttatctctttcatagtatcaatataccttctcccaattgcagaagacatcatgttatactagaattcacatttggatcaaggcaagtgtgagttccaattttggctttgacatttactagctgtgtaaccttggataggttacttatgtttcagagtttcagtttccagatctctggagagaaaagaatacctacctttaggattactggaaaaagtaaaaattgtatttgtaggccaggtgtggtggctcatacctgtaatcccagcactttgggaggccgaggcgggtggatcacgaggtcaagagatcgagaccatcctggccaacatggtgaaaccctgtctctgctaaaaatacaaaaatgtgctgggtgtggtggcacgcacctgtagtcccagctacttgggaggctgaggcaggagaatcacttgaacccgggaggcggaggttgcagtgagccgagattgcaccattgcactccaggttggcgacagagcgagactcaaaaaaaaaaaaaaaaaaaaaggtatttgttaagcatatcgtgcagtgcttgacaaatcatagctacataataaatgctaatccttattttaatattttaacatgttatattaaaatataacaggaatattctttagttttctccctgtacccaatggtcaatattccatctttatcatacttgacctgtgggtaacaattgcacaatggatcagtccttgtccttgtttatttggatcatacttgacttgtgggcaacacttacacaatggatcactcctcctcagtacattttctttacctggctttggggacagcacaatctcttggtttaacttttttgctccttttaattctttgctgggaaaatgctccatggtttaactcttggctgtcttctcagtctacactcaccccttagtgatttcattcactcactctcatggctatcagtatcctttttgtcaccacctcttaaatttatatctaccttggtaacttttctgatttccaaacacatatatctaaccacttatttgacatcatcagctatttgacatttgtcacttactttgtccaaaactaaacttcttttttccctcccaaatctactttgttcgcaattttcccatctcgattgatgtcagtttcatccttgtatttgttcagacccaaaaccttgaaatcactcatcatttctctccctctctcacaaaccacatccagtcatcaagccttgttggtactatctttacccagatctagaatttaaccacttctcatcacctctactgctattatcctgtggaaccctccatcatctcttttctaaattactgcaaaccgccaaactgactctatgcctctgttattgttttctacagtctgctctcaatatagcagctacggttgccttttgaaaatggacaggttgtgtcactctacttttcaaatccctgcaaaggttgctgattttacttggagtaaaagtaaagttcttataatggcctaaggaaattcgcctacattacttccttgatttcatttccccgactcattctctcttttctagctctctcatttctcaccactctcaacttgctgttctttgaaggtgacaggtaagttcttgccataggaccttttcactggctgttctctttgtttggagcattatttacccagaagtctcaaggctaacttcctcacttccatcatttttggcttacctgtcatcttctccatgagacctaccccgaccacaccctctaaaatttcaatacactcacctccacactcctgatctccttatctggttctactttctaattcttttaggtacttcttaccatgtaacttttttataagttatttattattcttattgattattgctagagtttaagctccacaagagcaaagatctttgtccttttagttcactgaagtatcccaagcactgagaatgctatatgtaaatttggtaaaataaatattgttgtaaaataaagataattttcttacctagtgttactattgtgaaggtttaaataagataatgcagttagagcattttttcacagggcctgacataaattaagggcttaataaatggtcgccattatgaagtgtctcatggcgtaaacacacatggtatacaccaaaaatcaaaagtattacagcatgaaccctttttctcacattgaagttttaccaataccacaggcatataatatcttctctaggtatacacaagcatatcttattgtttcatgctcatctagtaaagataaagatatgctagcattcagcagtagctgacagttcacatatgtcagtgaaataaattgacactgttcttttttactttataccaattaaacttcatataatttaaaaagttggtgacaaatattctctaataaggataattttaaaaatatcactataagatgatattctctaataaggataatttttaaaatatcacaataagatgatttataagattcctgagagctccctaagaattaaagagctaacaaaaaaatgatattcccattatgcattttaatgaacaaccaattttcttctttttgtagatttcaatgacaacttggagagttcaacatgtttaacatttttgattcttttccatgttttataaatagaaaaaaataaaaatgattgtaatgaggtattcttatgtgcatcacaaatgtaggttttagtgtgcgggattcaatagaaaataaatactttctttttccatcttcatttgtgaaaatactgaaaaatagttataacggaaagtcttttgtaaatcaaaacaaaaagtattatttctgaatactgaatagatgttctcatcttgtctattgcctgatcatctagttgcttagtctaatcaaatacatttattcttctatgtttcattcgcatagcttagtcttttccagagaatttacgaatgttttactgcatgccaaaccttgggtaattaaagtcgacgacagaatgtgcccatagtttattctgtagatctgactgtagatgcagaggcttacattacatttggggtgaatgataagcttatattattttcttcttctactaaaaatattttaaagatatagattctagaattcactaaacaggtaatttgtgaataaatatattgccattttttaaaattgctcttttgttctctcatatgttcatcatgcagcttaatttcctttctccatgtttgggatggtcaggtagtcaccacttcccactaaagttcgttaatttttcaaccaccagaaaaaaaggtgaggaatgaaagaaggagaggaaaagagaagaatggcaaactccacgtaattgcctgaatgctaccttagatctaaatgttgtaagttttcctctaacattttagaaagaatcactttttttcaagcatttttattgccactcgtgcctactttactttgttactcctctgctgcttgtgggtggatggaatttgactatttcagaatagttactggtgggtgggttcaagaatctctagtgggttgaggaaaaagccatgtttatatagatagtgatccttctattaaaatcctaagagtgagtaatatttaatagctatgttcaccacgcacatagcagagtccatctgtacagaaactgagggtatctgaaaagaattccacgggagttttggcttcctatagagtttgcacgcagaggctctaatctcccaaattaaattttgtgacttgatggatagacaaggtttctttcctgagggcatgacatggacctggatgcctactggtctatacaagtgtaagatgctatgaacctgtcaagacttagctttcccactatagtggatcataacacacagctttagtgccttgtgtacattgctttgactacagatgtaaaacgtttaggttgactggctttaaattgtgggtagctgtggtaagggtaatcacatgatctacttagatgccaagtgagtgaattctcttctttgatttgaaatccagttcttttatatatatatttgagtacagagctggtagcagccagtgatgcaatgtacacattgaaagtgccataaatttagagatactttctgtatggccagaccacgggaaatgacaggcctttcaaactatagactattttagatgattgttcttgaaagaccacttcacttaatgtgatatttggattacaataaattctaaatcattgtgttctcatttctttcttttctatactgaagaaaatgccttaccttaatctttaccacttaccttaatcttcagagattgagtagtcattgatgttcattacccactttattgcagcaatgctactatcaaagcatgagatttgggtagctgcaacatgtgtacagctgaattctaagttttgcaggcagaacaccagtggtcaaattacatatattgtgtcataattattaaaaaatgtaacatatgaggacaattaaaggtctaaataatttgagatagacagcccattttaaaataacattttactttcattttattggcaagttttaagaccaaaatttaaaaggaccaaaaatggacataatttagatgtgcattttaatgaagaaagagaaaatgctaaatgatttggaaaaaaaagatatttagcatgatgcaacttctataaatgttttttttctcctgttctttaaagaatgaaataaagttacatgtaatggacggtattaaattcagactggcattaagatgtgaatgttttaaataagtgacatattttaatttgaaaatttgaatctaatataaaatgcaaattgcaatagcccttaatgtagaaaaagggaaaaatgtagtgattgagtttgggggaattgtaacttgggcagctctagccagctgcaatgatgaacaaggcttcctttattattgcttcaagaaaagctattgagtgtctagcacaaagtagctgcttgaatacgggaatatccaatatccctttgagaggcgtatttgattatacattttccctttaccctcttgtttctttctaactctccaagttccacaaaaagccccaagatcactgttgttattatcattggtgttgttttttgacccagaggttataccactgacaactactgttacctatgtaaaatgatctctatcaatctttgactaaatttatacctgatcctgttgttcttttgtttaaaatcttcccataaatctttggtccttacaggattatctgtaagagggttagcctggcaggcattttttttttttttacaatcagattcaacagagttcttttttggcttcatttctcactttgatcaaaatgacttctcagcatgcatgttcttacacacacacacacacacacacacacacacacacaacatacctacctctctgatatatgcttcctattaatttctgcctagaaaactcttactcatcctctaatacccatctcagatatatctcttgttttaacccttccttaatgtctctggtagaatgtgttatccaataaccctccctgtcccccgaccccactcaaccccaatgatcagagaacatattcctgttaaatcacctattttactgaaattatttcatttgtctctctcactttttagaatggaatcttcataaggcctgagatgctatttatttagctctgaaaaaactagccttgcatacaagtcttgtcataataagtcctaatgaatagttgattgactgaatgaacggatcttcacttgtggattttgcacaacctacagttgtgggtgccaactcaatgtgcagagttggaagctgtttgtagctctgccagtcagttttatgttctgccagcacattcttggttgttgtacattccccactgataggattttacccaacagtacttggcttgattacagtgttcaaaattgtttttcaccatgtctgggtttttttcccctactcgacttcattctctcagtttctgtacagcaggcttctgggacatcctgttgttacccattcccctcctgtacctcgcccatccaagtaactttgtgaggaaaggctgggagactggccaatttccagcatcttgttgctggtgatcctgtattactgtaggcatataagtggtgaacctgggcatgctgccatggctagcagtgaaggtgaatgcattccggtgccaataagggctaaggcatggaagtaaatccatgcagaattgactttgtcagtgctttctagtaaaggaggagtttatacatggaaagtatatcggtagcagttagcatcattttgtcccttatagttctagatgaaagaacaccaatatttttttaccttaattgcctagtaagaatctgatgttcgtagaaagttctgtacccttgttgcatttgctgcctagctcagctccgagacaggaaactgaattaggtatacagtcctagaagtcactgttgctcaaacttgaattgcacatggatcattaagggattttaattcagtaggtctgcggtggagccaagattctgcatttctaataagctctctggtgataccatgatgttgatattgttggtctgaaaaattcacattgagcagcaggatgtagagggcagagtgagctctttgacaagcagtgccagctaatgcgcgtaccctctacatcttgagtgcctcaacaatgccacaggatgacagagcatgccaaaacacaaaataaatcagttccctcatcaccactgcatgttagttcagaatgttactgacggtggtggaagcatccctgagttagtgttctccctcccacagagctcatttagattctttgtggagaagggaagaggttggcttccccaccaaatctttgttgaaaatgatttaacacattaaaagagcaaatcagtatcttaaggtttaaacttcttagctgcagaggaagttaagttcagttcccaaggacttaagggttcagtgaattttcaccaggttcttttttcacctaaacttcaagagcgcggtaggagagccatcatttattgagttcctgctatatgtgggcactgtttgttaggtgctggaggtacaaagaggcatcacacataatctcttgcccgagggagtttacaattgactccattaaaggttcaaattttgaggataaaggtgtgtcttatttgactttatatttcccaaagtgtaaaattaataactgcctattaactaaaatgttgctaaaccacagcataagaagagtgtattttaaggctaaatcatgccacaaattatgacatggttagtatagttacaagtgacaattgcatgccatttccattctgtaaatcagagcttcctaatactgctttaaacacaaaatgtgccgttgggcaaatgctgtattagcaccactagtactctgtttttcaaactgcaaagggcatcccagagttttaattttgtttcttggtgtaaatttatatgttctttggataaccacccaatttgtccatgtagccaagcttctcataggagagatgacagaggggaacagataactgtagaacacaagataaaatatgatgagggccaggacactgaaacacagataacgtaggtatcaataaactactacccatgacccaaatccagccagccacctgtttttttaaataaagttttattggaacacagccatggccattcatttaggtattatctatggctgccttcatgctacaactgcagagttgaggaattgcaccagaaaccatatatggcttgcagaacctaaaagctatgccttagagtctaagaagcaggctttctaatatttgtggggtcagggcaagaaaacaaaaagataccttccaactatgacccgccactctgctgttctcaccctggctctgtcctgcactgcgagaggtctcaaatacaccctacttatatgtaagttccatctactatcctcacactcctgcttcacaaacacctgtatcttgaccttctttcaaagaaaggggtgcacacacaaacattggtgtctgccctcagaaagtaaaccaatggaagaggcccatagaggccctagaagtggtcccagggaccccgggcggggcgttttaaattttggggtggcagatagtgttctgaaagataaaggacaatggctttgggcaggcacacctccttggttcccctagactccttgtcccatggctaaggcatggcaggaatagggccagagtagcaccccctaaagggaggggcaggaaacaggtttctctgcctgagtatgagggtgatattgttaaggagtcctgtttaaattggctaggcaaggacactattattacaaacagcttttagctagtgcttgatgattatgagaacactgttgtgcacaaatggtgaagagaggtattctaaggagaggaaactttatgagcaaagtcatagagatgaaaaagctttaaacactagtagagaatggctataaaagatggatttttacacctgtgaaaatatatactatatcattttatctttgcaacaggctctaatggctagtatggaaacttttctcttcagtggggagaaattgaaccatatattagttaaaattagaacctggaaacctgaatgcttgtttgaatggcaatgctatcaaaaatatcttgggcaaatctcgtaacatttctgcctatcagtttggaagattagggactcttgtcatatagatctatgatgattaactgtgtggagggtatcactgtaaatactaggaatttgttgtgtgctttaaaagtgtttcagtgtgatttgggagagaagagaaagaaaacccagctgtaagttgagaaccagtgctcagctgagataatggctcaggttgcctttattttaagattagacttaaactaaaaatcttctgttaattagtggctgagctggaattagcaaatagtcctggtcctcttgactttgggccctgttgtttgtcctgtgtatcagatttgataatcagcaacatgggactggatacaaaatctattagcctgtgggaaacagggcatgtattagaccagtggttttcaaatcttggtgaaaacagtaatcccctggtgagttttctaaagtgctaatcccttaaccaaaggtgagggactctgattcagaaggacggcctgaggcctgggaagctgcattttaaaaacatcggtagaaatttggataaaggtagtccttgggactcatgttgaaaagcagtggtttagaatgtgctttctttccttttggacagaagctctgtactgaagagcctttagtctgtgaaagacctgagttatttctccagggaaggtgactgtctttggctgaaccatccacattctcttgcccagttcctctgaggtctatggagtgcccatatatgagactaaagttaaggagtcacctccagccacgggacagaaggcagttttctgaccttatcagattttatcattgccatactttaacttgctgagctaaccagccacagttttgttggaactcaccatggagacagattaattttaactctgagagaacatgggcttttcaacacaagttaaatataggctggcacagaacatcacagaagcattaggtcctcagaaattttctttagctcccaaactttgagctgccactaatttatgctactcatactttctcctggtcatttttatgtttttgtcttcctttgatcactgaaacagagaaggcagtacttaacctgctggaaacaggtcatctatgagcatgtttctcctaaacaattacatggaaaattaatggaaagaataggctatatgtcttaggctcttgggcagaccataagctttcgttcttgtttttttatgttttcttgggtgaaaaacttagcttaaagaaatatgaaatgcatttaaaaattaatttccacaaaaccaaagtgctgagatttgaccaaatgaaaaaacttggaggtaaaaacactgcacggttccatgtgtaatagttttttttttcctggaactaaagagagcacacacatattcacacaattcctacctttagcagatatttcattaaaacaccacacaatttaaatgttgataagaccttttcaaatagagaaattaaaatgataccttattaactttcattatagggcattaataatttttgtatttctgattagaatatggatttttgttaatgtggtgattttcagtggcagtcatgttcagtgcaagtgtgttctacaataatattgagaaataggagatgaaagttaaaatactggtgatgatgggccacatatgacctacacgacgatacacagtagtgtttcaaaataccaataatttaataaattactaatactaacaaatctgtgataagataggaatttttagtgcttcgaatattgacctccctaagttacatttcaatgccagttgtacaatactagtattgaactagtgaggataagagtactagaggccattgcttgtgttacagttcacatcccggctttatgacctttggtgacttacataaactgtcgtctgtttttgttttttgttttttttcgggacacagtcttgctctgtcacccaggctggagtgcagttgggagatcgtggctcactgcaagctccgcctcccggcttcactccattcttctgcctcagcctccggagtagctgggactacaggtgcccgccaccacgcccggctacttttttgtatttttagtagagacggggtttcactgtgttagccaggatggtctcgacctcctgacctcgtgatctgcccgccttggcctcctaaagtgctgagattacaggtatgaggcactgcgcctggccaactgttgtctgtttttttttttttttttttttttttttttttttttacctacaaattgaatgaaattactcatagggttgatattaatattaagagagatcacatatgtaaagagcttagtacagtgtagtatagtgcaagtagttaataagagttaggtattagcaatatattatagtttcataatttttcttctaaaaaccaattgccaaaggatgtattcctttagttgaaatactatagctcgattgtgtatataaacatatacattaatttgtaaaagtcagtttaaaaataagtataatggcatttttgaaacatagccctataaataataaacatgcttccaagttctcaatggatgataaaagccatcaacaggcccttgtcctgctgagtttccctgtgaagccaacagctcagccagcccctcaaaggccatggaagcttgaaggtcagacactgcgtgtaggggtcacctgcagatttaactcttaaatgcgagtcgcttagatctgtggctgcatctatttctgtgaggtaccagacgtcttctacatttggaacattgatgatatgataaaggaagtcatgccaataatcatacccaaagctgcttaatgaaaggaagaatggagagtcacacaaacatcacctcttagtaatagaaacttgactgggagacccaagcgaggccccttctaccaccagcattcaagctgcattaaactaaaatgtcaaaaatacttaaataatagtaataataataattgtgtttaaggccatattcactgatcagtggtcctttattgatttagatctttacagaagtggagctcctgagttcattgcttcatccaattcctcgtttttattatttgagaaaggcactcccccaggggatttgacagattcacatatgtagttcaaaatggttgattagcatgtcatatgaaaacatatcagaaggactaagggctcttggacagattacatttgtagttttcctgatgtctttcaggcctatcattttgtcataaaatgaagttgaaagggtctgaatatgtagacttcttacaggctccatggagacttctcaccacttctgttttctggtacgtgcttagaaaacgactatttgttcctggatttatgtacagatcaaagcatcctggctgatttgttattttctagaatttacatttaaaagcgtgaaggtttctatttgtagaaaaggcatttttctttcttttttttttttttagatggcgtttcactcttgtcacccgggctggagtgcaatggcacgatctcggctcactgcaacctccacctcccaggttcaagggagtctcctgcctcagcctcccaagtagcggggactacaggcgtacgccaccatgcctggctaatttttgtatttttagtagagacggggtttcaccatcttggccaggcttgactcaaactcctgacctcatgatccacccaccttggcctcccaaagtgctgggattacaggcgtgagccaccgcgcccggccagaaaaggcatttttctatttgtatttgggtatttttcataatcccttactcattcatcagtttagaacaatatctaactttaattggaatgaatttcagtgtaaattaaacaattgcagcaaaaaaggagatatccataactaaatccacagtggaagacaactaatgagaatgcatagagagctaaagaatacagaactacatcagtcacagggaagtattcaaaaattgtgaaactttacaagtttgtttttcatatcttggcttcaaatttgtgttgctttcctccacaagggatttcaagagatgtttcagagaactttaaaactttcaataatgttttaaatacctggggaataaaaacaaaaccaacagtaataatgttggaggaggaggcagtggaaaggaacagagaataggagcaaaaagaaaaagatgttaacatccttaggtgctacaatggctgattcatctgtagtctcctattataaaatcttatgtggatttgggagtaagccccttactaccccttcccacccccatgccattcctatcactagtctttttggggaagaggctgtcattgacaagtccctactttcgccatactgttctctacagtttctaaattctattaaaatgaaggattgtatgataattctgttaatatttttattcttgaaatatttcagctctgccatgtattatcaatatggccttatctttaaaatgaggatgataataatactggcatcaaggcatgctttgagaattaaaagagtcaacccaaatatgggacctcaaatatagcctttagcaagcagaggctagctcatagagcatgcttgataaatggcaatcctcattgataaagctcattcaatggaatcacttatttttaaactgtagtttaaccagatatgggatcttactatccaattgaacctaggaaatacaaatgattataggcacagcctttccttggctttgtttagaatagttacagaaatagactaatattttggaatttcatatgttgatagattcaagtaatttgaatgggaaagaggcaggagagaaattattattattttttccagtcttgaaatttttcaaagcattttaatattctcaaagtaggaagcctgattagccttatcttcatcagttctttatacacatccctatatcactaacattttttcttatcccattcaaccttccagtccacttgtaaggctacttaaaagatgctagattaaagaatggtttgtgtcatcctcccatgtctttgacatctccatttttcttgaacctacaggggtaagtgagcactgcatgacaatattgagagaatagatatctttttttcacacctgtctcttcaagtgtatgattctgcttatctctttgtgacatttcagtggtatagtttctgcaaacatgattttatcaggactttgctttctgctttagacttgaaagtgaatttcttttgggatagttacatcttacttgttcaaggtgtgaaacataaaacgatatctgatttttcagtgttctactgatacacaataattctaaactgaagcaatatggtactcttgcctcctgcttttatcttagaagaatgaaaattgaatatttgggttaagttaatatacacaatacgtggattactaaagttattacattttcaatatcttatagtgcagtaatacatattttaacaataaagctcttaggagagtcacagtgtagggaagttatcttatctttacaacaataaccattatgtattgctctaacatgactttggtttaattgtactttctgaccatctgggtaacaaaaattattcttattggattggaccaagtgaatatttgatcaagaacaactttaattttcagcatttttttcaaaattactagggaaatgtaattgtaaacatatttttataaattatattttatttcctattctgagattataaagttaacttttcaatttcttattaacagggtgttgagaagccagattccacattaagccacttaaatattctgtgggtggactacagcaggaggtggaggagctcccatgtttctgaagatagtttgagataatattgtgggtggtgaaggggagggtacttacagtgtgtggagtcacggactcagcaagaatgtaatcctgctggctgcaccttcttttcctcacagggaattccaacaaagcaagaaggggtgaagtggctgagaagggccagtgccagtggtatgtgactccaggatctactcaaagaagtttgcaggttcatttgtagactcaatagttattttactcactaagttaaaggatttatgtatccaattttaacagatgcaataaaagttatttacattaatctttaccatatgtccctcttatcctttacattattctatacatttagaaatttataaaaatggtggtggaaaatacagaacatgatgtaaaatgtcaactcttatctcttttaaagaggttagaataggagatggttgattagtgcatctataaaattgtttacctgaaggccaggcatggtggctcacgcctgtaaccccagcactttgggaggccgagacgagtggatcgcttgagtccaggagttcaagaccagcctgggtaacatggtgaaaccccatctctacaaaaacaaacaaacaaacaaacaaaaattagccggcatagtggcacatgcttgcagtcccagctacttgggaggttgagatgggaggattgctggagcccaggaggcagagattgcagtgggctgagatcacgacactgcattccagcctgggcaacagagtgagaccccgtctccaaaaaaaaaaaaaaaaaaagataaaaaaaattgtttaactgagttgtgccgcacaaataccaatggttgagtgtgtcataatacttacagaatgattttgattgtgtacgtttgcttctctttacatgattcatgcataatttacaataagaactaccatggtgagctaaattaagtttaacattttgaagttttcttatgcagtggttatctgagtctccaagttaacttacattgcatttgttcactgtctccatttcctaagtcatattttagtagatgataccatgtagttttgcatttctatccaaatgcattttgcttgggagattagttgtatgaaatattctaaggggggcataaagaaggttctttgatgaaataactttggaacatgctgcttctatgtctcttacatggatattcacaatgataagtataaccaaaggctctgagaagtcctgcagtttaaaaaaaaaaacactaaagtgttttaacccaggattttgtagacacatttgaccataggcactctctttccataatgctttgttatatcctactgaactttgggaaatgccatcttagacatccagtaagatcatatacacttcaaattgcctaagtatttttacagaaataaatctaagaacataaactaaggtttgccagaaatatattacatttctctgttaaataaacgttttccattgcatgtcaatatctcacatgggaatgcctcttgtctccccagtatagtcaccagacagtcttcctctctggagtcctggtttctttccaagaattaggcccccatctctggtcttgccagattttacacccctcaagcccctcatgtcagggtaatctctttctcctctgggcgatggtgaggaagaattgggacgtgatgaggctctgtgagtctcaagcccattggcattcttacttttctaagatattctgcgtcttccttcagacttttcctctatttctttcaccacggattttgatggctcattaaacccagagcctgatttatccccttttggtttgtattcatagagggcttaatccttcaatgctccaagaaggtgagaaagcagattttcattccatctttccaatctagtacagaggaaaagaaaaacaaattcccatatgaaaagagtctgaaaatatttagaccatgatatagttgaaaaggcatcaacttcatttaccttttgctcttacattattttatcttgggcccagtctatctatctcatatcattgtatatcactctcctctttgcctattaatctccatccagaccagtctttaatccactttctgcttttgggccttttccctagctgtcctctctgcatcttccctgctcttcacattggctgtcccttgaaatacaaggcctcattaagtgtttcttccttggagaagtcttctctaactaccagactaaagtatctgactagtccctcacatgacatcttaattctcttaattctctgcagagcacctattgttatttggtattttattatttgtttatctgtttgtttcttccatcaagaatcaaagttccgtaaaagctcggacactatctttctccttctccattgcttccccagtacctaatacagtgccaggaaaataccacaggctacatagataattgctgaatgaatgattgaatatttgacttttcatgtctgttacttccttggttatttcttggcctttttttactgaaaatttcagtcgctctttggaggcattcgttgcattgtttcaatctcctccctctactcctgaccactctatgccacatttgacatggcaatgcaccttcctctttcttacctcaaattctgtggcacttttgaggctctgacttagtcttttatgtctctttgtattatgctaccttggagaccgcattcttttgcaaacttaaaagtacaaattctatggcaaaaacctttctgtaaattcttctttgacacctgtatcttaatcctgtcactcacttctctgctttactgtttcaatgttagcaaaattgccaactaaatctttagtttcttattgttcattgtggattaatattaagtccttaagcagactaggaatgtctttagggaaggaggcataccatgtccattatttatttatttttaatagcacacaacacatttcttgaacttaccatatttcagtggttcaataaatgcatgcatgtccatagatagacaatgtatactgaaaacacagcatcagtattaatttacgatcttagatgagccacttgtattgtttaatatattattggaattaggaaggaagaggcaggtggcagatccctatcccatactcccttacccccttcttgctttaatgtgctttcttttgccagtcttgcttcctattgtgcctttcccttcacatctaaatatacaacgttaagctagaaaagtactataagaatactaaacctagttgagaaaataaagagaaaaaaatataaaccatgggcaaatcgtcttcttgaatattcttctctcaatattttaaaattaagatgtatgattttgatgatctagaataaaaccaatctccctaacatattttgcatatagtatctgttttggccttttttcagatacagtatcatttcaagttattattgcttaagaaatttatgtttgtggtcacaaattcaaacattaccaaattgcaccaaataaaaaaatgaaatgaccttctctggttagattaaacttgtagcacatttattcctctaatatacaaaggttttattagtgaattgtttttttaaaaaaagaagataaatggaatccaacaacagcaatatatattttccagtaaaattttatctatgtgatcataaaattcatttatgctttttattaatcagtgagagaagtaatgctgtcagcaaaagtgggttatagctctatcacaaagttctaaaagcagccatggaacctatgcattttttcatgttttcagttaacattacttggggtataaaatgctattgtgttgtcaagtgaattgattctaatcacagctgttttctgtgaattaaatcaccaagaaaactcaatcaccaaccaaagacttttaaacaataaaatcccatttgtggttgaagatcaaatttaagaacgctactggatattcatttattttgtcacgtttaattttctactctgactctcagtttcttaaagaaacaaatatttaatatctccccaaagccaatatctgctgtgtagtgggttcatatcttagcactgagagttaaataattgtgtgtagaaaaaaataggatatacagtgattgaattttcacttcatggaaaatggcagaaaagctagctatttgcttgctttcattcctttactatttcagaaacaaacacatctctaacttcaagtgaaattaattagttacttagggagatatatatctatatatctctctatatatacctttgctttttgggttgtggcacttatgctaaagttatcctctgggtttccttatatgggtcatgccataaaaatatccatttgagggctgctcaggtgagactctctgagagagccgttatactgtctgtgcatccttcgtccttgtcacatcataatgttttcattcaacctctttgtacagatcaaggagagaattgttatgtatgtataaagttatgaattgttttgtactagcgaccaaactcagggaatttatcgcaacgggtattccataatggcttggcactaggtcagaagccattgtcagcaaatcaatttatgttacttagggtgtctcttgcagcaggacaggcagattcaggctgaaggtgttgagaaggctaaaaccttctcaaacagcagcgatgtttaaagtgtagctttattacctgcatacgtggcactgtgctggtagaaatgagaatggaagaaaaacagaacattggattattggttaaggaatggcattttattctttccttcataagttttatcttaaaccttgaacatctggctttgtgaaattgagccctgtgtctgaatgacacaacagaagagcaattgcaaagtcctgtgttcagacaagtcctgaatatatatctatttcattgtcatggattgtttatcagtggctggaatgattttatatgtcctttaatttaacaagcagtaccaaaagcaaaacagaaaaaaaaaactctttgaggctgcattttagaaattcttcagtgtcatctggcactggggacatttggtatttctttcatttcttgctgctataccctcttacacaaagtcacaggcttaagctgtttcccttcaactgtgggaaggaaaaaaattaatttgaacatttcatatattttaggaagagtttagaaaatagggtcacatttttcaaatgtgcacgtcagttgcttctcctccttgcctttttctatcttcaaatttgttttcctttagtagtttttagttaattgtgaatgtttacagtatggttagagataaaataattctcttacttttcttttccatcgtcacacctgagacaaatgggggaaagcagacttcaaaccacacacgatgtgtttgatttctgctcctttcaaatatccattttatttaccaagaggtaaaaacactctgaaaactggcaacatcttatgtcccacagcattacttttgatgaaatcctgctgtattttagccaaaacttctttagacaaactataactgagtcacgtcgaccctcagatgacatcaatcttcactcctcttctatccaactaccgactagacacacgtacacatgcgtatgcaccccacagatcaaacttatttcattttctctacctgttggtcacggccttttcttcttatagcttactttattcccattattagacctgtttccatgttactgaaccttttccatcaaacctcaagtcctttatctttgtcaacaactccgtgaagcttttatcaatctgcctgtcagtaatctctctcttatctgaactcggaatctataatctgcaacacggcacagagtatcaaactatgtacttgtttttgttatccttttagctgttttgtgtatgttgatttcccctgtaattcctcacacattttttgtagtccccaatgactctgaaccgacagcagttagtttttaaatatgaataccctatttaaggatcaatttctgcacactttcaaagctttctttaggataattatgtcaccataagtgaattaaggttcctcaccttctccatggagctttgcatagtactttagttggatcataaagaaatgccctgaattataggatgggatcactgcaaagtcctacttgcatgtgagcaaggagcagagtctctacaaggtaacctgttacttggatatctctgaggatattaatgataaaaaggagtggccagaggaaagacttttcgcttctcaattgcagcactgtaactaagtgacttctggtagatcaaatagactattttggggattcctgctcacccatctcctctgtgttttcagagctgctgtagagctgttagaacagtgaactgatgctttttgacttgccaaacagtgggagctttctatttaaatagttatcccttagaagagctatattagggagctcaaaggaaaggatttaagggcccacacagagtagagaggcagcagatcagccacctactgggcccttgttccttcgaatgcttcaaactacatatttgtaaggcagaaggcctcctgctcacagaactgtatgctcctcacctgcccttttgtatttagcaaacacatgggaagggcagctcttccctgctgtctaacttgtctcttgttgttcttcggaagcaatccctcacagcccagtgggcagagagccaggtgtgctgaatgcacctaggggatgtggtcatgggaggagatccttcaggggcaaggggatcaaatttgacttagtatgtggtcattttccaagtgacagatgtgtaaaatgccagtagactaagaacccaaaggagctaatcaaaatgcgtgtgtgtgtgtgtgtgtgtgtgtgtgtgtgttttaccaagaatctatataggtgctttcttatgcctttattaatatctgttcaaattctactaagtcatactgccaagcttattttgataagggaatcagtttatttatttcaccaaggttataactatattggatagagaaattgggattattttcttagcttttaagcccataataactttattaagtccacagagaatagtttatgctctattgttgctgtaataatttatttttcttgtacccattccatggggaaacatacaaacaccaggaagatacagaaaatatgagttagagttgggagactcactgtcctgccagataaaggtctctttctaaatctcattgaaacctgacattcagaagtaggccagaaaataggcctagctatctacacagatatctctttttgtattatcattaaacatctcctaggaggcagcaagctctgtggtgggctgacataaattctgccattacatttttgtttcttttttattatatgtgtattattatgaactattttaaacataaagaaaagctagaaaaatatgacaaaatcatttcaacacccagatttagcatatgttaatgtgttgtcaaatcttctccaactttctttttctctctttttttaaagcaaatgaatgttaaagatacagctaaagcctccctctccatcccctctttatgccactgtgtttcttatataattattacatataaggttgctaactcttaggagtgaatttctttcttaagtccaaggaccatctcctgtcttaggtttttcacaaaggggcaaatcagaacagtactactctactgagtgtcaaatttaattgtctcctcctctggtgtcactggtgtgcaaatactttcccccttgggaaggatatctggggttgtctaaagggcagcaatctctatctagcataacagtttcaaagtgcaagagctgtttatgacctacctgaaaccatgcaccactgtcattcagaccttcgccttttgttctgagccgccctgatgtgatcattcattttgctctgtgcctttttctttttagcatcctatcatgaatagcttgattgactcttctcatctcttgggtcctggatctacagaataatttaataaaatgaggtaaggtagattaataactggcttaaaatcagacttttggctatccctattttgtaactgatgctatactctccccactccctgggatacatcatgttctcttagctttgtgtcttcccaaatcaaaatatagaacaaaagtgaagaagtggaagttggcagctatgtggtttgggtattgaattgttcccacatcaaaagatttatgaactgtgcattttaaacagttctcagttcatggctccctttaactaaattgagaaaacaggtaaggaaagtgaggcaaatgctaaagaaaatggccttgactgttcaatctagcattaaagataaagatttaatgaaggtaggtttaggacttataattttgagtcttgaaaacccaacttttaaaggattaaacgggagggtggggagtaaattcaagtttatgtggtggttctcctcctctgtcgctcgctaatgcagctcttctgaaggatagaaatttaaatagaaagctctcactgcttaggaagcaaaaacattaagaaattgctttaacagctttacggaatctgccattttcatcctgactacagtgctacaaagtgagcagtaatctctggggtaggagcacggcccacagtcaacacctatgctcactctgtgctttttacacttttagttttcattttccttaatcaatatttaccaggcgacagtcacagctttagcagcttctgttttctaccaatctttctgttgctgatacttcagacatttaataatttccttgtctataataatttctgtgctagttccttttataaatatctgcagtatgtgtacctaatttctgggatcaggtgcacatctgaaaaattgggattccttaatgaatgttggcattcaaaaatctcctccagtactcttactttattgggtcacatcattttctttctttttttttttgacatcattttctttgttgtttattttaagcaatcctctttcagacaattgtcacttacaaggttagctactgctgtgaagcaaaccatcacaaaatgtagtggataaaacaataaggtcgcccgtctgagcagttcttctgatttgggctgggctaaactggatctcgctggagcatgtccaagtgtctgtagtcagttatagaggggctgcgggctggctcatctggctgtcacctgggtcatgtagctctgataatccagcaggtcagcctgggtttgcttttatctgatggtcacaatgttctgagtgagagaagaagaaacatgaaaggtctcttaaagggtaggctcaggactggcagattgtgatgtctgctgcaatctattaaccaaaagaagtcacaaggccagtacagatgtaagggcaggggaaatggactctgcctctttagtgagaagaatttcaaaatcacattgcaaagtgtgtggacacagggaggggcaaagaattgtggtgtttttgccatctgcctcttgcacttaaccttctcccatgacatagttgtctcaagtaatttcccttctgggagcagctgttttgatatacaggaaatattgatccatcatactctgaagaaaattgcagcacagaaaggattatttaggcatcataggtggtcatgagaataagaaatgctgaagccttaagcagatgagctttaagcagctgagccctttatgttcttaagtgaagcatttttattcttccaagcatcaactgtagtcttgttttcaccagatgaaagcaactccaagtcaaatgcatgaaactgcactaaaattgtgatgcatttggttactctgtatcatgtgtggacaaaataaataccctgatatggagcacagattatacacacatcgtttctctgaattcatagctatgcaaacagttccttacggttgacgggttttattttttatctactgtgattaagttgcagtttagccttgcattatctcatctaaaacattttagcttttctttttaattcttattctctaactcattaaaacttttttagggctttgctagccgattccatttcttcattttatcctaggaagaagaccagcaaaataaatgtggatattaaataatatgtattatcattttgcaaaatcaaaatgttttacatgagactactaaatagcaagttcatagtttgagggacgatgattttgccaatgagacagaattctctcataacacacttagggggcatatcacatgagggtaccttgcatagtacacaattggaaagtaggagaataaatagtgtgagtaggagacatttatgcaaagaaaaggcgcccttgtttcttgactttgctttagtatagaaatataaagtttgtggcttgaagggaccttaattatttcatggtttattcctgctaaaacttctaatgatgggaaactcactatacctaaagaagcaaagtccatttatctaagtggacgattgggtggtcatcactgggggaccttactatgtgtcattgtttttatcttcatgaaagacatgatctattaaagagatggacatggaaagtatcacagcaaaatatgctatgtaccaaaatataatacacacttaccttggggaccaaacggaaagtgaatttattatccagtttactagtcagaacttgataattctctaaataggtaggatagtggagatggaagagctaaagatggtagatgctgtctactgaaattgggactatctaataagcatgattaccgggagcatgtcagaacattctgtgtatccatggtggtcaatgacttaaatctacatccattttcagagatcaaattccattcctggcccattacagaaacactacctgggcctcgagtgagcaaatgccaagaagctatttaacaataggcaagcacggcaaagagaggcttaaaattggcgaaaagtgcttcctttgcagtcatcctattcaacttgtggcagctttgaaacagcatcatgaattattattttaatattacaaataaactttattcttctcagcaacttgcctcctgatatgttaaaaatatacaaaactcagtttgtcaattcctgggaaattattgtcatagcggggagccataccaaggaagtttaaaagaacaatgataacaatataaaaaactgcaggagaaaagccataaagataggtttcaaggcacacttttctatcttccttttcactgttgatttgcagtcagtgatagatcgactttttttttgtttgtttcatttgtcctcttcctttcactaatctgggctttatttttgtttcaattttccctagctttcttcccagataataactatttccttttcccaagccctaattcacactttatcattctctcactgaagtgcctttcacagcaatccaatcaggacacttctgttcagtttgttccaaggggcttatttgatcatcatcaagaagataattgtctatccttagagctgggctaaacaaaagggtgaagcaggttgtgcacaaattcacaagactccattatcattcccctgcagactcccagctgcacttttactcaacccgtctgccttcttccccttcaggccaccttggttgagcttcttcagctgtccctgcttctatttcatccacctgttttcatccttcatgctttcctaattcaggttttctattcgtctactgcaactgatattttctagcaattttaaggaggataaaaataattcttgagtgaaataattcatactaggctgagagtgaatgatttcagatgtataggaggtgtgttataaaatgatttattaaatgtgaagaaattcctagtgaaaatatacatcgatatattatgtggggatcatgggtgcctctatgaattaattcattcagaaatgttcattaaatgcctaactcattgctaacggtgaagaagccaaacatattccctttcccacctcttctcatggagcttacattcaaatgggcaagataggtagtgtcttagcctggatttccctgtaataagcagcgctaagacaaggctttagatgcaggtttatattgggaaaagaaaccaaaggatcaggagtagaagatggataacagtgagagaaacagaaggaaggaagggtatgtcactgagctagactcaatcccatcaggagcctcttgagaagccatacagagtgtacagtgggcttgtctgccacagatacctattggctccatcccccattggtcacaggctgccccacacatggttcactgtcttgtgcctgtgctttttggaatgtgtcagttggttcctgaaattgtcccactaagatatggcagagaaataaatagtataggtgaggagagacattttcagaataatctgcacaaagctgatggttgcaccaacagctggaatataaaggtaaatgaagaagatataagaaagggctcaagaggtgtccgatacaaagagcaataaaataaaataaatatctaattgcacactgtaataagtgctctagggtaaagggtaccaggagagcatatgcacaacacaatccaaaatagtggtatagaccataggggtgaaaaattccttcaaaccgtcatggttccttgacatgaccaaatgtttgtagtgctactaagtaaaatgtgttgaagattaaagcccatttttaattttactatttagctatcctgttcctaggtaaacgtcaaatcccccaaatctttaagcttttctccaaagtagattttcttccaaagattaagaaggtttcaacactattttagacaaaggacttctgactatcctaatacctccccaaactactacattgaaaaccttattgggagacataagtactcctagctttgtttaacgttaagtggaaaaaatgtaatatagttgagaggtcaagagcctgtgctcaaaagactccgatttaatattggcaagactcatgagctatacctctttgtatctgaattccttatttgtgaaaggggaataacattatcacttgctcgcataggttaaaaggtgattaagtaaggaaacacagataaaacttatagaaaaatgccaggcatatggtataatctcacttattagcaaatgtattaatttactagggctgccataataaaataccacagaatgggtagtttaagcatcagaaatttatttctgtacagttttggagtctagaaacccacaatcaaggtgtcgttaatggtggtttctggtgaggcctcacttcctggttagtggatatctatctgccttctcactgtgtctttatatgatctttactgtgtgtgtgcatcctttggtatctcttcctcctcttataaggacatcagtcctattgtattagatcttcacccttacaacctcatttaaccttaattacctctttaaaagccctgtttccaaatacagttacattggtgggtagggcttcaacatgtgattattatgggcccacaatttagtcaataacagcaagtggtgtaatttttacatgaaaatgtcatttcctagaagggggcttttaaaaactttttagtctcaggattcctgttatacttccaaaaattcttgaaaatgccaaaaagcttttgtttatgtgggttatatctatcgatatttaccatgtcaaacattaaaattgagaaatttaaaatatatgtatttatttatttgaaaataccaataagacctcccattacaaattaacattattttagggaaaataactacattttccaaaacaaaataaatttagtgaagagtggcattgttttccagttttgtaaatctctttaatatctatctttatacaagctgctgaatttgcatatctgcaactatagccaacttgttatgatacctcatgaaatgtaacctctagaaaacttcactgtatgcttttttttttttttttttttttgacggagtctcactctgtcaaccaggctggagtgtggtggtgcattgtctgctcactgcagccttcgcctcctgggttcaagtgattctcctgcctcaacctcttgagtagctgggactacaggtgcccgccaccacacctggctaatttttgtatttttagtagagacgggttttcgccatgttggccagaatggtctcgaactcctggcctcaggtgtcgtgcccaccttgacctctcaaagtgctgggattacaggcatgaaccaccacactttgctacactgtactcttttgaaagaatgagagcaaaaaaggcaaatagcattttggtattattatgaaaatagtacagactttgcagagcctccaaaatctcctgaggaccattggtggtccctgtagcacacatttgagaaccactgccttaaagcttaagaacactcccaaatcaatgaggtttgtaattttggcatcctacttttgaaaggctccccaactcctttaagttcaataccacattttagtgttttgtgctaataatagtaaatattgacttttttccacttgcagagaaataccaaaccatggcatacagatggatttcacttgcaagttatatttgatgatatttttcactttatacttcttcattgtccacaatgagaatgagacagaactatttttgtgatatctgttgggcaatccttcagtgaactggttcaaataatgtgttttcttgaaaactgctgctgtaacatatctgttttgctactaaagaaattcagcctatgaatattattacatctttgaagtgaacttcatcctaatggtcaaaaagttgggagccaactgtattgaacatttattttttaccattatgtaaaacagaccattcatttactcttttgaagatgacaatttaatttgttaaagttttattttatttttaatcgaaaaataattgtgtatatttatgggatgcaatgttattttaatgaccacattaggccacatttcaatagctgataaaaaagttcccaacacttaattgcttttactaaaaatactaaatatttaaagattgattatatcatagaatttttttttttaactgagacgcaatctcattctgtctccctggctggagcgcagtggtgctatctatctgggctcattgcaaccttcacctcccaggttcaagagattctcctgcctcagcttccctagtagctgggaccacaggtgtgcaccacaatgcctggctagtttttgtatttttagtagagatcatgttggccaggctggtcttgaactcctgcaacctcaagccatctgcctgcctaggcctcttaacatgccgggattacaggcatgagccaccacgccaggtctggttttggttatttatatatatatgtgtgtgtgtgtgtgtgtgtatatgtatatatgtgtatatatacatatacacgtatgtacacgtatatacgtatacacgtatgtatacatatatacgtatgtatatatacacgtatttatatatgtatatatgtgtatatatgtatatatgtgtgtatatatgtatatatatgtgtatatatatatgagctcctcaagcacagaaataagtcataaatactgtttttattttccccaactcctgccaggttgaatttcagagttgatgcttaataagtaattttgaaattaagtttaatagaatatatgtaattattattttgtgtcacaatgattctaccatattccctgtctttctaattttttagtccttcttttgttttattttcccctcattttatcacgtttttctcttacttttattctttctattttttttaacctcttatcaatcactttggactcaaactttctgaaatcacgttctttactttttaattaatatttgttcctggttttacaattattttaattatatcatttatacctacttttctcagatattttcaaatgatatttggagacaattctccatatggcttagcttttctgtatgtcttgttagaagaggcaccgaatgccttttttatgaactctttgcactatcttgggagatagaaataatatctccctttggagcaagaggaagacatgtttattgtttactgtgaaagatttgagttctctaagatcaaagtttctctcctataatgtacctattgcatgtgcaaatatcatccatctctcttcatgtcaacctgtaggaattagaccttgggaaactggcacaaaatgtgagtactctggctactgtttttgctgtgagtaatgtttaagccattttttgtttctgactcaagagtttcatgtcttctgttggcatccatgaaactgtggcaggctaacccattaccttgcaagtagggtacaatctcagattttgttatagacatcaatgacttacgatgatttgatctttgacttatgatggttcaacttcgatgtttttactttaccatggtgtgaaagtgccacacattcagtagaaactgtacttcaagtacccatacaaccattctatccttcgctttcagtacatgaggtaatcaataagttgcatgagatagtcaacactatttttttatatataaaataggctttgtgtcagattattttgcccaactgtaggctaatgtgttctaagcatgtttaagataggctaggctaagctatgatgtttggtaggttaggtgtattaaatatatttttgacttactatattttcaacttacaatgagtttattgggacacaaccccattgtaagttgagttatacatgagttaaacatggttggagtttgcggctaaagcttttggattacttttaccccatcgtaactttatcatggcgtgtgtgtgtgtgtatgtgtagcccggcaggcatggccatccactgaatactttgtcttgtattataattgctcttatttttcatattacataggcaagtttccttcacaagtacagtgttttcttgtcttcctccaagaactttttactctcctttcattgtcaggtctcattataaggcttagcagattcattttaaaaagcaaacctattattttttgtatatttatctagtctattggtctatccgtatttttccatatctccaaaagcatcagcatagccattcttacccacaaagcactgttgaccaacttatgtttagatgtggcattattttcccacctggaatgtcatctctttcttttatctatgtttcttccatttcttttaaaacttactttctctacagaggcttttgtgagtaatcccaaataagtttactcattaagcatttattttttgataattatattactaatattcattgattgcctactataattccaggcagagtgagcaaaccaccacagaacttgaataccatcttggaagttagtatcttataaatcaacatacattcaatttgatctatgttatttggatttaaagatacataattttttatttttcatgttgcctccctgatttcattggaaattcttccaaggcaggcaactgtgtctttttccttaactaataatagtttaagcccataaaaccttttctctctcttcaagcaataagaaaaaatcaggctgtccagcagtgcagtgcaatgattccatcagggacttgactaccatctggctttctgctccaccatggttagtgtgtggctttcagcttcatgattgtaattgggctgatatacctctggacctcatggccatgttcaagggaggaagaaggaataagggatagagcaaaaggggattgtctggggtcaaaatccttccaacctgagacatcaatttcagaagttttccccaaaatgctatataacattgtctcactgatcacaactgggtcaatcaccacccctagctacaaggaagtttgagaaggtgaatacgcttaactaagcatatggacactttacacaaaatcagaggtttttttaaataagaatgggacaagatatgttggttagagactaacaatgtttgccgtaccaccaaactcaacagtggcataaggatccttaaagctacaggataaataaaaagcatcttcttagagcatcttattagaaaatttgaaggaaaacttctccctaaaacaaacatggggtagaatacagataagatatgaatatttaaggttgaaattgggtgagataaaaaaattctcaccttttgccatgtcccccacctccttcatgtgccacagccacactggtgtctttcatttcttattctaatcatagccctttctaatctctgatttttctgccagaaatgctcttccctccaaattttaaataaatgggcagatctcaactttaaacttaacaacaacaacaaaaaaggttctcagagagatattccctgtccaaccagatataaaatcccagtcactttctgtgatattttcaatttagtatttatcactacatgtttattgtgtgccctccaccccacccccagaataatgtaagcttcatgcaagcaaatgcagttaggtgctgtttatcctagcaaagggcacaggaaaaggtaggctctcagtatgaagcagggcacaagaagtattcaatacactgttagattttcactgagatatttatgcttgaaactaatctggagtctttcttctcctctcttagaacattgcatcaaagaatatcaagtcaataggatattggatattttcagggaaaaaagacaaagactaggctgattgaaaatcactgtaacatttgttgtaaaacattgtgtttgcgtcctactgttgctgtataaatatattttcaagctctttttgtgaatatcaaatgaggaacaatagacaaaccactagcttgtgaaaacattttgatcccattttagtcaatgattaattttgtaagacataaggctttgcctctgtcttctcactgccaggccattattttagtgttcatccccaaaaccatactttttaaaaactggatattaatgccatgtaaatgttaagaaaatatttagctcaggaattcatagacaagattcttgttgtatatatcttggaatttttcttgggacacaactggaagtttctctatttattcaggacataaaataacccacttcttagggggaaggttccaggtcaacaatttaatgatttttaaacaaatatcctacagggaaagggaagatttagaagaattttttacatccctttatacttcattaaagcctttttggtgtatattgtgaaattatatgcctagtccagaattaaggacctggaataggctaaacaagaaaatacaggttagtagagttataattaatcctcataagtcagagaataaaatgggcaagaagagtagtcaagtacattgaatagagtcttccattaacgtaattcagaattgccctggcttcccaagagcattttcatgtttcactggtcaagtgaaatacctaccctgtcttatctcgatcttcccacattacttacttccttattaggttcctctgtaattctattgactgaaaattcactgctgtggaaatatatctactagtggagttaatccaaacaatttgggcaataggaaaaatacatgcttaatgatgtgtttgccttctcacttaattttatttcagacctactagatagtcaataagggatgggaaatgacattcttgtgaaggagagatgaaaatattaatatattaatattatgtatttaagcgtagggatgatctcgatataggcatatcataaagtaccttaatatttcattggctgattcatcagagtgaatctatgtggtcgtaaatgaatgggaagcatgtaaaaatcttgtttatctaacatgcacactaaaaagggtcctccaggaattagaatcactcaaaattgtaagttgtgccgcaatttgttgatgtaattatatcaacatttttcttgacgtcagaccattgtgggtgggaagattatggttttgatgatcacacagacataggcttgaatatattctcttattgctggctgtgtgaccacagacaagttacataaacactctgactctcagattcttttgtaaagtgggactcctttcctttgaagcatgagcacaaagattgaaagatacataaaacactttaacatgttgcctggcatgaaacaagtgctcattatgtattaatcttcttcccattctccctctgggagcaatgagtgatttagagtttgtaattcagttgagaagaaatttcagaattgtataaaaggcagtgtgcttatatattcattcattagtccccttattatcagagtgtgttatttgcattacatagtttagccatggtgtgtataatttgaatttaactggaaacaacattcctttcacaaatgttgtttccaactcaattacctgaccttcagctaggttagaagcattggcatttctagtaattttgaaattccaaaaatgtaacccccatactctatgctaattttcaaatcagcagttgaattggctgctcagtcacatttgttcctaaagacggaaaataaaagtgtctgtgagagggcaggcctggcttaaattctgtcttaacttgaaggatctcagaagcagactctgagccagggattccagcgcaagtaatttattaaggaagtactcacaggaaataccagtgaaggatcaaagaagcagaataaaaaagggaagaagccaagcaagggttcaatttcaggtgaagtctctgactcagtctgatcctgtggtgagccctggaacaaaaattgtacctctgagtttgtcttgtctcaagacataggaactgtcttcttataatccagagctagtcaatcatgaactgtagtctgtcccaaggaacataaactctcaggaacttctggttctaaattagggtgagacaactctagtatccaaggtcaagttttagaagtttctgctgtaagcccttatcatgaattacagaacatatgggataaaacaaagcactggtaaaggaaatgaagggtataggagcagatcactaattgtgtccagtacactcttctaggtcccttgcattttctgaaccaggaacatatagtggccatcatagcattactagttcccagtaaggtaaattgttttagtaagtgaacagtgcccaaatatttaggacttacttgaactgaacgttgcatactatgaataggctatttcattgtaccttaagggtttccaaggataatgtaaatatatgaacaattagtactgttatgatgaccaacatttattaaacacataggatatgccaagccatatattagatggtgtatatagtttcctatggtctgttttttgtttgtttgttttgttttgttttttgagacagagtcttgctctgtcacccaggctggagtgcagtggtgtcatctcggctcattgcaacctctgccccccaggttcatgcgatcttcctgcctcagcctcctgagtagctgggatgacaggtgtgcaccaccacacccggctaatttttgtattttttttttagtagagatgaggtgtcaacatgttggccaggctggtctcaaactcctgacctcaagtgatccacccaccttggcgtcccaaagtgctaggatcataggcatgagccaccccgtccagccatatatactttattatcttatcaaacattagaagcctcattttagtgatgaagaaactgagcctcaggaaattaaaaaaaaaaaactcataactagtaagtggttaaactaaaactatattcctggtgtaatccaaaaccctagatccttccaataagcaaaattttgccctttaattgcagtaatagaatctgtgaaacactaggaagctaccagtattacttatctatgctgcatatcaaatccccaaacttaaaacaacaacaaacatttatcatcctcacagtttctttgggtcagagatttaagaacagcttatctgggtagctctgacttggtgtctctaataagatggccataaagattttggctagggctgcaatcctctgaaggcttgactagaaatgtaggattttttttttttttaattatactttaagtactgggatacatgtgcagaacatgtaggtttcttacataggtatacacatgccgtggtggtttgctgcacccgtcaacctgtcatctacattaggtatttctcctaatgctatccctcccccagcccaccactccccaacaggccccagtgtgtgacgttcccctccctgtgttcatatgttctcattgttcaactcccacttataagtgggaacatgtggtgtttggttttctgttcctgtgttagtttgctgagaatgatgatttccagcttcatccatgtccctgcaaaggacatgacctcattcttttttatggctgcatagtattccatggtgtgtatgtgccacagtttctttatccagtctgtcattgatgggcatttgggttggttccaagtctttgctagtgtgaatagtgcgtgctgcaataaacatatgtgtgtaagtgtctttatagtagaatgatttataatcctttgggtatatactcagtaatgggattgctgggtcaaatggtatttctggttctacatctttgaggaatcgccgcactgtcttcctcattggttgaactaatttacactcccaccaacagtgtaaaagcattcctatttctccatatcctttccagcatctgttgtttcctgactttttaatgatcgccgttctaactggtgtgagatggtacctcattgtggttttgatttgcacttctctaatgaccagtgatgatgagtgttttttttcatatgcttattggccgcgtaaatgtcttcttttgcgaagtgtctgttcatatcgatgtgctgtattcaggagacccatctcatgtgcaaagacacacataggctcaaaataaagggatggaggaatatttaccaagcaaatggaaagcaaaaaagagctggagttgcaaacctagtctctgataaaacagactttaaaccaacaaagataaaaaaagacaaagaagggcattacataatggtaaagagatcaatgcaacaagaagagctaattatcctaaatatatatgcacccgatacaggagcacccagattcataaagcaagttcttagagacctacaaggagacttacactcccacacaatagtagtgggagactttaacaccccactgtcaatattagacagatcatcgagatggaaaattaacaaggatattcaggacttgaattcagctctggaacaagcagacctaatagacatctacagaactctccaacccaaatcaacagaatatacattcttctcagtaccacatcgcagttattctaaaatttaccacataattggaagtaaaacactcctcagcaaatgcaaaagaacagaaattataacagtctctcagaccacagtgcaatcaaattagaactcaggattaagaaactcactcataactgcatagctacatggaagcagaacaatcctctcctgaatgactactgggtaaataatgaaattaaggcagaaataaataagttgtttgaaaccaatgagaacaaagacacaacttactagaatctctgggacacagctaaagcattgtttagagggaaatttatagcactaaatgtccacaggagaaagtgggaaagatctaaaattgacaccctaacatcacaattaaaagaactagagaagcaagagcaaacaaattcgaaagctagcagaagacaagaaataactaagatcagaggagaactgaaggagacagagacacgaaacacgaaaaaccctttaaaaaatcaatgaatccaggagctggttttttgaaaagatttttttttttttagactgagtctcactctgtcatccaggctggagtgcagtggtgtgatcttggctcaatgcaacctccatctcccaggttcaagtgattctcctctctcagcctcccaagtagctgggattacaggcgtgtgccaccatacccacctaatttttgtatttttagtagagatggggtttcaccatgttggccaggctggtctcaaactcctgacctaagatgatccgcccgccttggcctcccaaaatgttggaattacaggtgtgagccaccgcacccggcagtatgtattataggatctcctatcagggtgtcccactcatagcattggcaaattaatgctggctattagcaggaagcctcagtttcttgccacacggacctccccatagtactgcttgagcatgctcaagaaatggaagttgtttgatttttttccccagagtgagtggttaagagaggacttttggaagccaccatgcattctgtgacttagccttggaagtcacataccatcacgtctacaatatcctattagttacaagatgaaacctattcaatgtgtgagaaaactacataagggcatgaatagcaggtggtaaggatcattaggagccatcttgaagaatggttaccacactaccattcctttcttcttaatcctaagtatagaactcctgctgtctcctgaggatttgttaagcactttgttgctcccacatccccctcaaaaaaaaaacttaattaaaagtagctaagtagaaacaaatattcaacacactagtaataaatgtagatgttactgaatatttagaaaggagatcaagaagaggactgacatcacacatcacttgatagaaacaaaattaatttttcttttacatctgcctgctttcccttcccaaatccctctcttcagctgccagctgtctcattcctctttatctctttcccacatagcctcaaaactctcctttgttgtgccaaataattcagctctggtcctgagtttacaaacacattcttggcaaaacaaaatcctgatggccattctcactttctttagaatgcaaacatctttgccctattatggaaaatagggatcaaagtagcttattgatatttactcaacaaaaagtcctatttcctaaggtggagggagagagacaaatatgttctcttgttcagaaaataagtttttttctcctaagtgttatatatatatataatatactcttctagcttccagatccagggaggacagtgatccttctgtttcttgctgattggttgctatacctgtttgaaattatagctcttacatttttgtcattgagttagttgctgatcagttgctatacctgtttgaagttacagatcttatgtttttgccattgagttagttacatcctttcttattttgtcactgagctcttaaccagctagcctacatctcatcttgtttagaaatattcttatgatttctgtttttcagttcacctgattctggaaaagaaaagaaaactttgcccctgaaggacgcaagcaattatgagtggatactacataagggccctagctttgtcatgctcgttgatacacactcccacctagcgccttgcactcagaagattcagttcatatatctgttaattgactctaactgactgaggttccctggatgaggagagcaatgagaacagaggcttgtcagcctgcataatccctactaataagctctactatactttgatgcttatcttcattttcttaaactgaaaaaaaaaatcttttggcaaattccaaaggagatcatcactgaaatcttgctgagttcaacttataagcttgtgggcattaaaaattatatcaatgaggtcgctgccctgtaactgttcacacttttatttagaggggaccagcaagttatgactgtagaatgttgataccagttttgagaggacaggtttaatgaagcacatcttatgcctcttcatccttttcatactcatccataaaatatgagctctattggctatgtagtaattaaaggctgaaaacaagaaggggctattatgagctaagaagaacggtaagacatttatttttgagggtggcataatctctttggggaaaaaaagtatggataaaagggagaggggccaggcgcagtggctcacacctgtaatcccagcactttgggaggccgaggtgggtggatcacctgaggttgggagttcgagaccagcctgacctacatggagtgaccctgtctctactaaaaatacaaaattagtcgggtatggtggcgtgctcctgtaatcccagctactcgggaggctgaggcaggagaattgcttgaacccaggaggtggaggtcgtggtgggctgagattgtgccattgcactccagcctgggcaacaagagtgaaattccgcctcaaaaaaaaaaaaaaaaaaaaaaaaaaggaaaagaaagagagagggaggtagaaatgaaagggtctattcagaggtgattgcaaagataaatctagatgtcatagagggaaaagtagtgagagggaaggctggaaaaggaggtttctctggattctagaggctcttgagttgcagatcaaagcttggattttatgctattggcgatgagcagtcattgatgacctaaagtgacataataatgaaaatactgctttgggaaaggtaacccgggtcaccatgtatatgaaagattaatgtaaggagaaattgaaagcaggaagagtaacaggaaaatttcagaaatttagaaatgagagagaagaattgagcctatgaatattccaatgcaaattaatgttctattttttctttgcagtttctagtttctcaaatttaggcttcatgcaatatgctttgaaaatatgatgattatattaattcatagaatcactgattcctcttctaccccaccaatgtttgtaaggtgcattctgataattttattaaccatacctcttcgtaaaggtggtaaaatattgaagctcttaaagtggccttggcaaatgcatataacctgtgagtgtattgtgcttagaattattataaaatgatttttaaaggatcttcacccaggcacagctaatatgagtaagaatcctaaatgtaagttacttctagaccagtggtccccaaccttttaggcacccgggacaggtttcgtggaagacaatttttccatggacggggtctggggggtgatttaaggattaaaccgttccacctcagaacatcaggcgttagttggattctcgtaaggaggatgcaacatagatcccttgcatgcatgtgcagttcacaatagggttcatacacctatgagaatgtagggcctcccatgatctgacagtaggcggagctcagactgtaatgcttaatactggctggccagccactcatctcctgctatgcagcccagttctgacccaggctgcagcccaggggttgaggacccctgttctagacatattattgcacttgtatcattttactgctaatatattactgtatcattttactacgaatatattgtcacattataataaattccagatgatagcgcaatcacagcacaaatacttatcttttctaaaaaaaattccagttgtagatttgttcaatgcaatgtggtatattttatctttctaaagagcagagcagtgtggcaattctgaatatacacgtgcttgctgaaagcgataaattggtgattttctccttcgtgggacagaaacaagtgagatggatataaagagaaaatcctacaagtaataattttagagcacttcttagtagcaatttcaatttgtcactagcactctatgtattcccaactgttactcctttcattccataatttttattctcagatctttccatttcatatcccaaagataacatttgctcaaacataaaaataacatttagctgcctttgcatggcccttgcaaatttatctctcacttcttgtttcccttagttccccagtagccttgaaaaacacccaagttggctgaattctaagccgaatgactgtgatagctccacagtagcataattccaaatgcttatttgatagctccaattgatggctaattggcccttcaaatttaacatacttaaaaggaaatttctgtttatcctctactctcagaattgattcttcttcaacttctcctcctagtacatggcactaccattagttggctgcccaggttaagaaaatcatgctaattttaaaaattaataataaataaaaatctagataacatttatttttcttctcattccctaaacctctacctacaagtatacaatcttccagaaacttcaaactgcaaaatatattccaaatctaatcacttgtctccttttctgctgcccccaaccttagtttacatctctcttcagctgtccttcaggtgtttcctcatgggtctctgttctcttgtttggcctttgatccacactcttcacacagtagtgttgactgtaggctccccaaatgaacaacagaaaaaccttttgatcatacatatttaagtttttggaccttctgctgtaagaaaaaaacataattctacagagtcttagtaggatctcaaaatgggaaaattagaataggttatttattatattttacagcttggtctgggttatttcaaggtgggtcttgttaggcagggattggttaagtttggacaaatttcattgcatagttttgaattgtcggatacatttgagtgaatggatttggattggtgggtactgtgagacaatggttttgaaatgagttgtgacaaatatgtcactgagtcagttcatagtcatcttttaggagcaggtgtttcttggaccaagcatctaggttattttggcttggagtaaatattctttaatatggagcagaaatgtatgcctggttctagtttcatagagagagaaaattatgcttcataggtatttaaacttaaaacatctcttcatatccctgcttataatccttggaaagcttcatgctatgatcagaataaaatttaaactcaaattagaagatcctaaataggctgtcccttgtctcctcactgacttcagttcttaccactcttccccttactctccacattccagccacactagcctttcctttccttgagtaaaccaggctcgttcctgcacttgcgaattgcctctgcctggaatgggtctttctctttcatcatttgaagtctcccacaaatatcatctcttcagagaagacttcttaaggctacccatctaaatcagctcatgactcccatatctcttcactttagagttcatggcactcatccctacctatacaaaattatggtcttttaagcctgatatcctctattcaaatctttcttctgctacttattagcagtagaaccatgactatgttactttgactatctgtgcctcaatttcctcatacattaaaaaaggacaatgatgatacatatgtcatagggttgtcatgagccataaatgaatttagctttgtaaaatgttgactctctaaatattagcaatacaacttgttggtaaaataactgtgataaggaagaccactacctcaggagaactactttggttttgtctcccaaaggtgaaggcaaggtcgggatttattgagaattggaagtttggtttaaggtggggttttttcaaaaagaggattttattaagattgggtatgaatcaggatataacagtctaggattggtgaaaacaggaaagccaggattttgagacaggatttcaaaaaattgtactttgtaagttctctgttgattctattgaaaagttgggaagagatgggtcttttggaaagtccctgtaacgaacaatcaaaccacttgcttcagccagaaactcagggaaagtaatgacagtgggatacaaagttacattatcgtggaggtatgaggttagggagctttagtcctcaatatccaagctgaatatacaggtagatggttttggtgctcagcatgtaaagcatatagaacagtgcctggcacataataagagcttaagtaaggtgaatttcatcattaacttattattgtcatggaagccacaagggtggtcatttgtctgtatctccatttcctggcacaaacattgcttagcacaaagtaggtactcaataaatcattgtggaatggataaatttatttatttactggttttctgtttgtctccctaattaggatataaactctgcgagagagaaaaacatgcctttattgttcatcaaagtattccaagggcctgcggcggtatttggcccacagtaatcacacaaagtgtatttgttgagtaaattaataagcttttaagtatcacaaaagaatcttgagtgtaaaaccagctcccagtttctttcacctccactgaaaggtgtgagtccagaaaacgagaacaaaatgaagaacagaagaataaaaaacccagttacattctaaaataaattgggggaaatgctggtttaaaaagttaagtaagatcctttcctgtaaggtttctcagatcctttaatctgccaatgtgcattgttgattactaatgggaaatagtgtgtatacttgtttgatcagggaacttgtttttcccctttttgatttgagaacacttatttgcatctctggaaatacaacattagcgttatttgagatgttctttgggaaatgctgtattaagcagttttatccaaagtcagggatgccatcataggaagccgaatgagactccttggcagtgatctggtgttgagtcacttcagggtgatgggagaagcacagatgaaggcagtcccatcctgatagggctagggctcctccagagactgcacataagtgccctgtttgctaccagaaagcactcacatgtgagggagagtctggtttaatgtccccctagttggtgaacactctccaatcttaaccacaagtttcccacgtgtctctgacatggagtgccatgagagaagagttttctactagatactcaggcagcattttgttcttttacttggccctcacgtgtaccttcaacttgggttttacccctaaaaacttatgttgttgtgtttgggggaagtcaaaaccaggacacatgaaggattcatattctggagcttgtctacttaaaatgaccaatgctttcaaacaattatttcatattcgtatgcctcagattcttcaggaagaaactgagtagcttgaatgatagtcatgggttctgaattgtacattgtattagtccattttcacattgctgatgaagacatacctgagactgggcaaattacaaaaggaaaaggtttaatggactcacagttccacatggctggggaggcctcacaatcatggcgggaggcaaggaggaacaagtcacgttttacatggatgacagcaggcaaaaagagagcttgtgcagggaaactccaccttataaagccatcagatttcatgagacttcttcactatcacaagaacagcatgggaaagacctgcccccatgattcaattacctcccaccatgtccctccgacaacgtgggaattcaagatgagatttgggtggggacacagacaaaccatatcatacattgaggaattttagtttgggcaaggcagggaggtgggcctctgggagcagcaaataggcaactcctgttagtgcctctaagtcaatgcaatcttgctcttatttgctctatgcaactttattagaagagaggaagttcctacttaaaaggtagtttttattagccccacctgtgcaatttcacttgaagacatctgctactaaaagtagtttgaaaactactgtactaaaaaatggagtccactgtctttttttgtatggtctccaagctaacaaaggttttgatatttatagatggttaaaaatgtcagaaaagaggaatacaaattaagcattcctaatctgaaaatccaaaaatctaaaatgctccaaaatccaaaactttcctggtgctaacatgacttcataagcggataattccatacttggcctcatgtgactgggtttcagtgaaaatgcagtcaaaatttcattttgtgcacacaattattaaaaatactgtataaaactaccctcatgctatgtgtataagcggtatatgaaacataaaggaatttcttctttagacttgagtcccatttctgagatatctctctatgtaaatgcaaatattcaaaaatcagaataaatcagaaatttgaaacacagtctcaagcatttcagataagggatactcaacctatattccattatgcacataaattatatgagattcggattttagtgtccataaatatagtcttattggaacacagccacacccatttgtttacatattgttaatggctgctttttattgtctatggtgcttcagcagcagagctgactatttaccacaatgactatatgattcacaaagcctacaatttttactacctagtcctttacaaggaaagtttgctaagccctgacctagatgattattaggatccttttctacccccaacatttgatttttgttcatctttgtggaaccatattgactggctatgtaagattcttctcaaagcaaattgaatcaagccaggactctttcactatgttataaaatcgatttaattatgttacaacaatccttctcatttgagaacatacactacctaactaatccatgtctttcaatctgccttcaccttcattctgaatggcgtttggtatattctactttgttatgttgaacatttctttttttatagtattttaacggggcagcataaaattgcatggctcctctgcaatgtaagtactttagcacgacagagttatagggttgtaaggaagcttgagatgccatctaatctctcctactccttctggacagaattatacttaaagtaccctggaaaggttttggtttactgtagtctttaaaaatccctccacaagaacatttccaaatactcactttgtagcacatcagctgtcaaatgatttgtaacttgggtgcctatgtctgaccaaaagtatatttagagttgttccattttaaggctttaaaatggtttattaatagggcagtacttccagctactcaaaccttgatttttattccagccctgagtcttaaatctgggcaagcacggcttctcagacatggtatcttctaagggcagtgattaagaggcaggacctgggagactactctgttgttgcatgctctattctcccctccacactgtaaaatcctcgcggataggagcaggatttcttttttttcctaactcccatagcacacacagagtgtattgaagaatgttcagcccaacctctttgcaagcatctttattacaaaagatgaagggagggtggatgtaatcaaatatgtactttatattggaaagcaaccaagcctctctgtgcatgcactaccctcatacaatcgataataaattagcattttatttatactgtataatgccgttcttttcaggagtctgatttggaagccaactactgtttgtgttctccaaagtggtttttgatggagtgctaattatgtttcacctcaagagcaatgctgacgggggaccacaatcgccttattgtagtagatccagctgatgaatctccaaggatagcctcatgctatattctggggggcaagtaaatataaaaatacatttttgatcaagaaaatgataccatttacacaacagtagcaggattcagcctttgtaaaacagctgcatagctgcataactgtgacgtgattttttttttttttagtagagaaaaaaacatggaggaaaatatatatcaactcaggaccctagctgaatctggggtttagtagttcatggtgggggcaggggactatattttcaaataaatctagcctaagtgaatttttgttccagatagaagaccaacttaataaatgagtcctgcgtagagaagtatgtcacatttagcaaaagaagacacgcgcaggtagagccaatcttttcacttgtgcgaacctcattaatcctgtcacataaagttttgcacttgtattttagctcaactcaaggaagcttgatccagatattttttcagtatatttttcaatacaacataataaagattggagaatattttaactccacctttttttctttaaagctttcttggccaggtgtggtggctcatgcctgtaatcccagcactttgggaggccaaggtgggcagatcatctgaggtcaggagttgatgaccagcctggccaacatggtgaaaccctgtctctactaaaaatacaaaaattagccaggcgtggtggcaggcacctgtaatcccagctacttgggaggctaaggcaggagaattacttgaacccgggaggcggaggttgcagtgagctgatatcatgccactgcactccagcctgggcgacagagagagactgggtctcaaaaaaaaaaaggctttctttgggtcaggctgccctttgcaaacaccatttttaccaccaaagtccctgcagctcatatactaggctgagatatatgtatgtatgtatatagtatataaaaatggacgtgctctcacattgctagaggtacatagactctctgcatgacttgggattcagaaagtgtgtaaaattaagtaagatgacaatagcaatccattaattattctacatctaccagagcacacttccatgtttggtcctgtgcttttaaggaaagacctgccttttagtgtcatgagggctctcaggaatggcatcttgatgatcacaacattaaatccaactcctctgtcaggcagctaaagtgttaatttattttgtaattagatctctcaccaaagctcacaggaacctgcatttggatctcatttgattatgtatagacccttttatatatgccatcatattaaaggttcattctatgtggcctgccttatgtgctcagtaaacatttgttgaatgctgaaacaaatcaccctggggttaaaggaaagcgttgagggtcacagaggttgacttgccaaacgttactaagctactatggggctaaggcaggagtgaatagttgctgctttaggcaactccacccacccccgaccccgtttgtgctctttctttttttctaaattgttctagcagtctatgatttggtgtacttctttggttaaaaaaaaaaacacacacgaacaaacaaacaaaaccttaagggtctttaaaaaataataagttatctgttattgaggacttaattttgtgcactacactgtaccaaatgctttatatttattaacctatttctttttaagcaataaatctaaaagcttggtattcttatccccattgaaaaattactttaaataaaaaaaacctctccaatgacttttattatattcacataaagctaatggggccgattaaatgtttattgttaaatatccatgaatcatttcaaatatatatgtatttttataattgtaactcatagataataatacagttgggctacaaaagctatttggaggaagacaacaattctaaatggaatgtgatttgtgtttgtcaagattatgtcagcaatctatgattttagcaatttatttggtccatacgtggatagaaaatatcaagcacagggaaggaaagtataaacatttgttcagcaactactatgtgtcagacatcattgatgtttgccatatttagatgtcacaaggaccctgtgagatcctttaaacattttctgtaattaaagatgaagcaactgagtctcatggaaattgggaaatttgctcaaatactttactttgacccaaaggaaaatgcaagtaaacccataccactggctgaatattgggttttaagggtttatagggagaaatatttttcaaaatgtatctgacttgggtgggtcttgagtctagatagaataaagcactctatcttctgtgacctgggaaaggggtgccgttgggggtgggaggagtcgggatggaaaatcaggtctgtttaggaccaaatttagttcccatttaaaacactgaactgcttccaaagaaattaaactcatgaccttggtctacatgaaatgaagccagataaattaacctgacatacacacttatataagaaatccttgaaaaggaagagctgatgaaaccagggaatcatatttcctgtaagaaaagttggtaaaaataccagtgaggtactttggtgtatcatattataatactatcagtagtataaatgaaacgaacaaaaatggtaaaaaaaaaaaattgatctagaataatgtcatcaacaaagtatgcaaccatttcttttttcttctttccaacttttattttaggttcaaggcatacatgtgcaggttgttatatgggtaaattgcatgttccaggggtttggtgtacaaatattacatatcctattctaagtgctgaaaaactaaagtttttaatgctcctatcagcaaaaagagcaccaagcaaataaacatgtcctaatcatttgccatggtagtagatcattaaaaaaatacatttatcttaattacagaatacatgctaagcagaggttcagaaataaaatttctaatgggaactgacagatcgacaaaaggctaacataatatttgcttcatttgtaacaagtattggttgaagggtccaggtaactcaactagcctcagaataaaggatgtaaaactgaaaaggagattttaaacattcttttttagtagcaaaattacacacatgttttatattaaaaaggtaatgaaagaaaaggtggaattttaaaattacgtgaatttctttgggatgaaagcttctggaggcctagtgactgctgaacatttctagaaaagaagacaggtgaccaaaaagcaaattggaaacaaaagacagaatgtttgaagatgaaggccagaggtaatcgatttcattattatattacatcatgtaaaaaatttcttatttcattttaaacagatacacggccatgatgtagaattagattttcttaaaactccaaagaaaaagaaatagcaatttagaaaagcaaattgtaggataagatatcaaactagttagtcatccagttgcttctaatgtcaagtgttttctactttctggcacacacccttgctattgcttttccatttctccctggtcattctcctcctttagtgtccaactcagacttcagccacccagacaaagtattttcttctcctactcttctgattgtgctgagccactttgctgcctctagccctgccacagcacctgttgaatttgcatttcaggtggccgttgaaattgcatttcagttctgagctctggtggataggaaccaggtgccattgatgtttttcactttttcatatattctcagtgccttcccagttgtttagccttcacctgtcttgcccttctctgaattccagtcccatcagctttctttctgtccccatccttgtcataaagccccatccttgtcataaagccccatcacagcatttgccctatgcctgggctactcttacttctctttgcctaattatttcctgcgtgtccttcacatcccatctcagagaggccttcggtgacctcttcatttagatcaaattgccttgcgttgatagtgttgtgtacctagcattgggcacatttgcaattataaatttgtttattaagattttacggccgggcgtggtggctcacgcctgtaatcccagcactttgggaggcctaggcgggaggatcacgaggtcaggagatcaagaccatcctggctaacacggtgaaaccccctctctactaaaaatacaaaaaattagccgggcgtggtggcgggcgcctgtagtcccagctactcgggaggctgaggcaggagaatggcatgaaccccgggaggcggagcttgcagtgagctgagatcgcgccattgcattccagcctgggcaacagatcgagactctacctcaaaaaaaaaaaaaaaaaaaagattttacacccctaccagactataaatgtaatgggggcatatactatgtccatatttcacttaaggttatatccgtagctcatttcatagggctgtacgtatagtagatggccaataaacatttgtgaaatacattgataatatggggtgtgtaacatttgtacttttgaatctaataaatactcatggtttaagtcaattatcagtggtttatggttcaagatgtttgctcttaatttttcttcactgtatcaaatagagatattgaaatttcacttttaccattttccacatttttttccagttccagtaaaattcagatttagtaaccctttcctacattatttctttccccagttattttaagagcatttcagtagataagctggtaacaggggagaaggaaaagaaactaaagggaaggaaaagatattcctgataaaaaaggtttaactatcttgccaaaatgaggttctaagggaatttgattaaagaagtattaaatatatggacatttgtatatttgatactcaattttcaaagaccttttccctttaataaagtagtcaagtgcttttacatgtgggctgtctgaccccagtaggggcataaaaaggctaagaattctggcttgttggattatggcagttggacatttgaaacctacaattttgatgtgcatccaaaatgccactggctaaagagacccccctctaaccctgtccttgcttgtgctacagctagaagcacacaggtgagagcagaatgaaacacctaagaaatctaaagaattggagtttaggaccagaaaatgaaggttggtgttcgagaggctaactggagattttataatgtctggcactctggggaagagaacccacagtgtaaagtttaaggaagtaaaatgtatctactcctttatattaggcggtagtgtattttgcctgtgtttttgttataatcaacaacattgtgttatgattgatccattttaggtctctcttttgcaagactctctgggttccttggatgatgaaaaggttgttttgtattttcatatgtccagcactgagcaatgtgcttaacacttaatagatgctccagagatatttgctgaatgaattcccatgtcctccaaatttgtcctatcctctctgattagtttatttaattaatttatttatttttgagacggagtctcactctgttgcccaggctggagtgcagaggtgtgatctcggctcactgcaaccttcgcctcctgggttcaagtgattcttgtgcctcagcctcctgagtagctgggactacaggtgcttgccaccacgcctagctaatttttgtgttttagtagaaacggggtttcaccatggtgatcaggctggtcttaaactcctgacctcaaatgatccgcctgccttggcctcccaaagtgctgggattacaggcatgagccaccatgcctggccctccccaattagtttttgtctttttttttttttagtttaatgtattttaatagcaaacttacaggaacagcacagaagacagacaacattcaaaacatgtacttggatgtaggacaactcagtcagaaaagtatagtgaatggatggaatctactgtatgataaaaatgctacaaacaccatttagttgccgtcaataagaaatgtacttgttttgaaaaaatccaaatgccggcattgtccagaaaaatttaacgggtttatttataattattttaaagttgaaccgctgaaacttgttcactgaaacattttaacttgcattaatgctttatgactccacatttatattaaaaattcacacacaaatgaaaatggaaaaactgccaatacctaattactgtcccctatttttccacttgcaatcacatacttaggtacattttgaccccatggaaaaaaattaacgttcagaactaccagtaacaggaagaagagactttttttttttattgagaatgaaatgtttcccatcatagtggattcttaagcacgttctccacgtatgcagcctgctagcttgatgtcttttggcataattgttacacgtttggcatggatagcacacaggttggtgtcttcaaaaaggccaaccagctaggcctcagttgcctcctgcaaagcaccgatagctgcactctggaagcgcagatctgttttaaagtcctgagcaatttcttgcaccaaacgctggacgggaagtttgtgaatcagaagttcagtggacttctgatgactaatttcacgaagtgccacagtaccaggcctgtaacgatgaggtttctccacccctccagtagagggcgcactcttgcaagcggcttttgtagccagttgcttcccgggtgttttaccaccagtcgatttgcgggaagtcagctttgtaggagccatgatatagagacctccttgcttaaccacccttctccttcggctggagctcggcgagctagaggcggcgctggctagaggcgagctagagactggctagctggcgagctagagagcgacggtggcggtggcgcggcggcggctgcgaacacaattgctccaattagttgtaagcatattttttaaaccatgcttacctatgttatactatagttgtgtaaagataatttaaagcattaacaaaggatttaaccatttagtaatcagagaaggaaaaacgtgttagaaaaaaatgaagagattaatctttgtactttagctcaagaaaacctgggtttcttggtaaaaaaaaaaaaaatgtagattcttgggtctaatcctggatctaatgaacaagaattttttggatgatgcccaggaatctgcctttaaaaagtcagttacttttggggaccagtgttttgagatataaatgttaaggagatgggcaggaaaacaaatattcttactagcattgttttatcttgactttttcatgtctgagtgtgggaaaatcactctataacacttcacttgtgataaaccgctccagattccaaagcagaagcagagtgaggatggtgtgtgtgtgtgtgtgtgtgtgtgtgtgtgtgtgtgtgtgtgtgtgtgtgtgttggagttactgggttgccattaaacttaattgactctagttatttctgttttctcatgtcatgcccaggataaataatgagtctcaaaagcattgaaatacttttgacccctaaaaaacaatctattagtgttttgattttataatacatgtaagagttatttgttacacctgtttcttctcttttttatcctccactcttgtcaaaatgtcagtcattaaataataggtattttagataagaattaaatatgtagatatttattcacaaagaccctgcaattttccccaaaatagaaaaagccaacttttgtcttcagtgaaagacagaaagggtaacatatgatatgaattattagatataggatactcaaattcaaatttgtttattataaatttgttattttagaaatgacagctaggacatggaatgactaaaaatatgtacattcaataacacatttagaaatacaggaaattttagaactaggtactttgagaattaagagattaagaagggattattttctatctgcacagttctcagggaatagatatgatgagtgatcctaactatttgagtaaatgtcaactgccagcagacaccaccagcttatatcgaagaaaagtcacaaaaaatatgaagagattcatcacactgggaatggaaaacatcgaataagtcagcaagtccagcaaaagaagaaagtattacaagtataatttaaaaatagttttggcaagaggaggttggggagaaagcagagtaggctataataataattataactcaaagatgggccagacctaaatgtacaccttggcctctttccatcctaaaatgttctatattagcaaaagaggtgttatgatttatactcagctccaagtctagactggtttaggtttcctgtgtttaattctgcttctttcttaacaaaaaaatctagtcatctagatctcaagtgaaatgtgcaattgaaggtataaaaataaaattcaattgaggaaggcaagtttgtccttaaaataaaatttaaaataccagcatttatttttaaaaaactacctaattacatctagtcccatacatatgttcaagattaatatgcaactgatgcatgaaaataaaattcagctgagggtaactactgtctcattaaaaagaaaatagaaaactagcatttctatgaaaacgtctagctaatcatataaaaactcatatacatgtgcattgacaagtaaatgctggtgatatattatttgattgaggtcaatttttattctaaatatttttgcatagtgggaatttgttatgttaaataattttgggattggatctctgagagggcttagtaatatattttatattaaattaatcacagtgaaaaaatctttgaaataggcttgatgtttataattatagtattctgtgtttaaacgtgaaaacattgtctccttttaaaaatggtattaactctaggagacaggatatataatgatcaattctttctaccatgaaactctattaattactaaaagtgttagtatgcaaaatacaatataagttgataagaaaaaccaattcacatttgatacccagtggacaaattagaataaaatattataatgttcaaagaacactctatattccataatgttctctgttaagcctgtgtccttctgagtatggtgagtggcaattctggccttaccttcaaacatctgcttcatgtttaaattaaattatgctacgtgcttgtccctgcataagagtagcaaatactgaaagtacagtgaaagggatagtaaaagacttctaagtaggagaagtattaaaaatattctccagctggtaaggctggaacactgatgatcaagacagttctgttgaagggtgggaggcgccctcttctttgctccttcaggtgttaaccttttttttttagatggtggttgattgcagggcctggaggagggcttgagtgtggcctgtgtggcctgggtctagagaagctgttatttaccaaccaatttggaaagagtttaactacggtatttaaaactgtggcagctgtatctgaccaaaagttaagcttctgaacttttccccatagatcacagagggcgggcctccagggaaggtttcaagcaggaggctgacttgaggaggtttttgttttagaaagagccttcaggtagcaatgttgaagatgatggattgcatgagtttgagaaaacattcaggaggattggttttaaaacctaagaaaagaattgaggtagtggctagggagcagaagtgaagaaatggatgtgagaactactttggaggaataattttacagagtcagtgacagttttagaattggatagggtgtgagtttgactcccaggattctggcttggaccactgtggaaaatagtaccattacctgggagaggataaagatgtagtggtgtctgttacttgtttgtctggtttgctggctgattggttggctttatttaattaattttctgagaagagccatgtttataagctgcaggcacaactgcaaatacattaatttaaacatataatagtgcggctttctctgtcggacaacaaaaaagaaccagaaaaggaagggggtgaggggctgaataacattccatgatcacctattatactcttttaactaattttggaatcacattcatgccatacagaggatagtactgttgccatttcacagatgagaattctgacttaccaggtttgaatgactggcctactttctcatagtcagaatgtggcagcgtcacaatttaaatccatttctgtccatcttcagggtctcagtctttaactgtatgaaaatacctccaaaatggaaaagagtgaaaaagaatgaaagggaagaaaagaaaagaaaagggaaagaacgaagaaaaaagtatttagagtgaccaaagaagaagaaagcaaattccaattgaaagggaccaagcagagatgctcatccatgagcaggtcttacccccgcctagacaagttcatagtcctccctaaaggtggcaggaagtttacacagaatattagttcctcataggtgtccctagccttcaggtgacctgaacatgcagccagtaagtgaactggtatcagtttatggccaaaccactgctctctagacttctgcttttagagtggtgcttttcaacctgggctgctgcagatcctcacattctttccggtctgtggagtaattgagagtaggctattagaaacttttataggaatctgactgagtactgttgtatctgctggatccagtaattttaaaacgggattgtattttgtatgtctgtttcatttttcaagtcattggcattgcgttttatgaaataatatatctgtgatgaatcagaaacaaaggaacaaaaactggcccttcaccacagataatttgagaagtaagctttagagcatcaaaagaaaaaaagatgatgagaacctgataggtgtttttgtgctcttggtaacagagactttctcttataaatgtgatggtttagtgaactgcctttacatagcgatctattggccccatatacaaatataatcaaatgatttgtgtcatttgaagctacacaatagatgaacctggtttttgtaatttaacaaaaaatccaatttatgtaacatattaaaagaagcattatcaacttgttttctcctcaaaagactgtagctgttaaactccttaattacttcattttcactctcagtgtaacattagcagtttagcacttcaagtacaaaaatgattaatgagcctgagaattcattcgcatacatatcactttgcatcttgacataaccctggagcctgttctctattctagccatagacatacttccctagcaaatatcttattgcatattaaatgcctaatcattgcaaagtatgcataattatagtcatctttcctgtttttttctacgcaaacaaaaaagacaacaaatcaaatgcattcaaatgtaactaacattttaaaccaaagtataaatccatagggagcatcatgatttttgcattgtaactgtccccgaaaattcaattgtgatttgagctgaagtgtcattcatctaaaaatgtatctttaaaatttttttgaacatgaaggaaaagactttcaatttctatatttatatgtatgtgagtactgtgacttgggaaaatatgacgagagtaaagactgcattgtggattcagagaataagattttatttggagttactgtaagaaatatctgcagggggctatttctgtctaaccatccttggcttgcattggtgacatgtgcctacatgtttcttttagctttagtgaatttcttttttgatctcctccaaggtgatcccacagtgctgactttgtccaatcattcccgaggcttaatcttttaagtatgatcaatggttctttgtgtctttgccttcccttgttttttctactgtattctgtggagttcagccacagctctgtgctgtccctacctaataatcctcttttccctacatgctgatcacctctaagctacactctactacattcagtatggaatcaggaagactaaatgaactttttctcagaactcagagaactgcacttgtcaggcttgttgccattacacaacattgtagttactggaaggtgaaccaaacaacttccaggggcctttcatgtgcaagggaagagcagaactgtagactacttgctagactctaaatctggtctccaattgtttttgttcatgtaggtaaagctatatgctctaaatttgtacctgtttccatttgcttttagagggagacatttagttcggggacaaaataaataatgtccattgaactggacatagtcaaatatttccaataaatttttaaaaccatgtgtgtactccggtaaagcacaggtatcattttctcactgcacaagtgtatactacaaatgcagtcttgcggctggacatctctgaccaacaactagaccactgaaattgcaaggcaatgcagtcaactaaggcactgaggcactgttcccaggaaagatcgtttgattatgatacaatcaggactccttatctagacccatacttgataaatagggttggcagataagttacaggacgcccagatataaaaacaaggaatttaaaaaagtgtaagtatgtcccaaatattacatgaaatatatttatattaaaataaaattactccttatctgaaatacaaattacactgggtgtcctgtatttttatttactaaatatggcagttctatttataagtggtactttttttttgtttgtttgtttttgagacagagtcttgccctgtcacccaggctggagtgcagtggtgtgatcttggctcactgcaacctccacctcccaggttcgaacaattctcatgccttagcctcctgtggaactgggattacaggcatgcaccaccatgcctggctaatttttgtattttcagtagagacagggtttcaccatgttggccaggctggtctcgaactcctgacctcaggtgatccacctgcctaagcctcccacagtgctgggattacaagcgtgagccaccatgcccggctataagtggtactttataagcagcaaagatcatttgaaacagtacacttcctgaggttagtgactaatgagattattcctatatccctaaatgtcatagaagtgggaggaaatgtgaaaaaacagagactcaagagtgggtgtcagctatggagcacgcacgcgcactctggtgcttgcccacgctgcactggcctacactggcccacgcaggcccacacagacccacacaggatcactcagaccgacactctccaggttagagcacttatccagtggatggttcagctttctggaggataggtggagcgttcttaatgccagcccttttctggtccccactaggctgtggtaccctcagaagtcggaaggcgatgttacatactaaggattgcttcctttgtgctgctgcaggatgcccggtgaaaaaaatctgtaaaatgacatccaaataacccaacccttacctgtgtggattttgaacttgctaaaagacacagtggaccccacctatttgtggattgagctaataaaaataatttaacaaacaatgtgataaatatgatggatatgggaaagctgatagtgaagatctttgggtcttataagactgtcaaagaggatatccaagaagaaacgggacaaagaagaaagatgaattgcatttctaagaaggtatttaaatccagtacctccaaaatattaatataaagataaatgcattactaggcggtttttgaataaattttttttgtttacaaactaaactattattctgtaagtaggactatattaaagtgaaaaagagtagcaaagtatgaatgaatacacaaacacacataaaactttctaattagaacaaaaaaaccatatttcttttggtccttttgctttgtttgtttaaggtacataattgaaaaatcagctattctgaatgaaagctttctatcaagtagatgatacttagatttatttttgctgtcacctggcttagttggctatataaacataacaaattgctaattgatattagtaaatatacagtatttgtgacttccttcagtcattatacctttcctcgagaaagtagacttaattgcaccacgtattgggggctgaattttactagtactactaatttatccagcagtggctttctatttgctatatattaacaatttgcatcttgaattagacagttttcttgtagtgtggagatatttattacttctaatgacatgtcaattctactttacttttaggcctaattttaaattcacttaagaaaaccattttttattgaagagatgtgtacatattttcaggatggtcatttaaaaaaaattccaagcaagtgaatgaaatcattcttgggctgtgaattaccttaaaaaatacatttgggaaatatacagtgcctactacccaagatagttatggtgactaattagcttcttacctagatttacagcaccgttaccctgtaaaataatctttgtaaaataggtcacaaactgggtctgcctgaatcttaagtataaatttcatgtttcatggttttgtactgcagctctaaagtaaaacaaaacttattgtcaatcgaatcactttggaggttcatgttgcctcgcatgtcttttgcttaaattcttgtctacagctgcctgcctgatttggatcttgtgccctaatcctagtaactggactcctgttttgctactgtgaacacatttttgtctgttcgcctcatgctagtaactccctttctcattcttccacatgtctggttctgaacacccttctgatgactacagctctgatccctcctctcctggtgaatgatgttctgaacctgtcttaggctgttgtataacaaagtgccatagactggatggtttgtaaacaacagaaacttatttctcccagttatgtaggcttgaagttagagaacaggatgctagcatggtggggttctggtgagaaccctcttcttgtctgcagaatgctatcttcttatatcctcacatggtggagagcagagagcaagttctctggggtctcttttgtaagggcactaatcccattcatgagggttctacccttatgtcctaattacctcccaaaggccccaccctctaataccatcacattctggattcagatttcatcatatgaattttagagggacacaaacattcagtccatagcagatcacagccttcagcggtggcagccttagaatttctatgtagcaattaggcggtgcttggagctgagctgtttgggtatgggagaaaagcagcttgttttaaagccatgtgtgcattgcaattaccctttttttagtaaaagttgcatatttagttgtggtggcttgggggtagtaataaaaattcatgaaggagcaggtttctttgtagccaatcataggcaatgccactgaattcaaggctgggaatccaaaagaattgttttttttttcttttttgagacggagtctcaccctgtcgcccaggctggagtgcaatggcgtgatgtcggctctctgcaacctctgcctcctgggttcaagtgattctcctgcctcagcctccagagtagctggtattacaggcacacaccaccatacccggctaattttttgtatctttagtagagacagggttacgccgtgttggccaggcttgtctcgaactcctgacctctgcatccgcccacctcggcctcccgaagtgctcgggctataggcgtgagccaccgcacccggccaagaattgttttcttacttagttttgtgtctgcagctttgtatataaatagcatatagctgtagtaaataaatatctttgatgattgatctaatgtcatgaatttctagtcctggattccaaatagccacatctattcaactgtaactcttgggataccctatttctcctccttgaagttttctgttggaaaacgcttgctttagccactgtctatggcctctcatgatatcctccagttatgaaggtgtttaatgtactgtgagccatggatagcataatatagtcatgagatttatcataaaacagacctggaactgaatttgtgtcataccaatggtctggttacttctctttgcctgttttacatttcaataaaataaggataataataatattcattctttctcacagtggttaagaggattaaattaggaaacttaagtgtttgacacgtatttgataatcaggaaaattgccctcatctgatatgttgaacttataaaaattgccctcatctgatatgttgaacaaagatggactttgttcaacatactttatccgtgttttagataaatatagatattcaaagtgctgagtcattcattcaacaaactgtctcttaggtgctactttatttcaggctctttgctaagatgaactggaccagaaatttatcagaaaaagtaacagggcatatgacatattagagttaaggatggctagaagagaaatggggatggttcaggtagaacaacacaattaaaaatgtagccccaaggccgggcgcagtggctcacacctgtaatctcagcactttgggaagctgaggcgggtggatcacttgatgtcaggagttcaagaccagactggccaacatggtgaaaccgtgtttctactaaaaataaaaaaactagccccttgtggtggcgcatgcctgtaatcccggctactcaggaagctgaggcaggagaatcgcttgaaccaggaggcagaggttgcagtgaacggagattgcactactgcactccagcctgggtgacagagtgagaggctctatctcaaaaaatattatatatatatatataacttatatatataaattatttatataatttataatataatataattttatatataaattatatataattatatcatttataatataatttataattatatcatatcatatataatttatatatataatcatatataaattgtatatatatatatcccctccaaaattgaagagaatggagaaataataacaattcgagttaatttcggtgatcttggagacattgctgaggctggaaaggatagaactttaagagacttgtagttatgtggactttatggataaatacaaaagttttctcaggcaaatgtagagaatctctgctttgtttccactgactttaagtatatcaccatgataaacactttggtgctattctaattgcatataaacatgcacaactcccatcctgaaggtaggatgaccaattatcccatttgcccaagcctgaggactttcccaagaaacaggactttctttgctaaagctgggagtgtcctaggcaaactgggacaagttggtcacccgctttaaagcaaagacaagactgtgtcttaatctttatgcatcccagaactttgtgtaattccttgtatagtgctttggaggggatcaatacatacttttgctgactcatcagttttaaaccagacccttgtgattttgtctggatagttaaccagaatagacgttggttgaggctgataaattagggaaaatagagctgtttggctaaaagtaaaactaagaagaagaaagccagcctcatctgcaatattgaaaaaaatatgtgttctttctctagtctgcacctgtaattttatgtttcaggtttatttggactctcagaattttcacaatatagcagaattgttccttgcactcagttaaggagtaatgcaatcagaacaggggttggaatggtaataaccaaattcctgccacagctctaccaccctctaataatataaacttaagtaagtcacttaaactctcaaagcattattgctttcaaccaaaggcatgtgtataataacaacttccttataagaaacagctccatatgataacttttataaaatagacttaggaacttcaaaggatgagataaattcgaattattctaatgaccagtcatgccataatgatagtgatatgctgatttaaatgattcagattatggttgtcaacatgtgatagtgaaaataactaaactaccaaagttgaatttccatgtacacactgaaaggacaatatctataaatatctatagcacacctcaatggtcacaatttccagtgagtaacattgattaagtaaaattaaattcttctgaagtttaagtctgtagtctcctaaaatgcccacactggctcaattattcatgaattacagttatattctttttctcaagtctttcaaaaggactaatttaaaaaccagaaaaggtattaacaaatcaaaagaacaaagggacatgttcatttcaagttatgccttgaaattgtaatgaaaacttaatctcaagggccccacatattttctaactgctaaatggaatatcctagttgtacttttgtatctagactgaacaaaacttataaaattcattccaacacacttgccagctaatggatctgagtacatttaatagtaaaaataatgctactgattacattcagtaatgcattttgttttttgcatttttttctattccgaagattgactgagttagtagtccaatgctgatgtgttacttatcagctatgatgaaattactagagtttttcccagttagctatgatgtctaccaagaaactatgatgacaaagaagtctggatttctagtccagctgggcagcacaataataagaatcattcaggagcgctgtatggactgaatttattgagcaagaagaaaactgcatgaacaaactgtggaagcttaacacatctggttagcaaagaaatttattttggccggagagattaaaaacctctttttccagtaacttattctgccagaggtactagaccagaatctgggccatcccacagatcttagcatatgggcatttttcagtagaaggagcattgaagttactgaactgttttctctgcctagccaatttaatatgaaatatgattgaaaccagtaggtccgcactggtatttatttatttcccagtgctttcctaaacgagttttatagtattcagagcatagtgttaaattgattcacctttctccatgtgagaattgtaagcaatttgattagcttttctctattttcatcttctgacatatactgttataactaagaaaaattataacccttttttcttactgaaaataatttatattcagtagtgtttttgtgcctgcacagaatataatctctacaggcttaaatatcaacatttgtaactgtatgggtatgatggtattaagaacaattccaaagacaaattacacttttaaatgttcatgatactgaatttatccctcagaccttataattgaacgttgcaaaccagacacattcctgtgtgttttatttagtgaaggaaggaaagaatgttaaaaaaaaaataaaattagggttttttatatgactgctaaacatgataaattaagggagtcttgttaccctgagagatgtaactttattgatctctcagttaaaagctgctaaatgagtgaatgaaaagatagaagctgggggagggggactgctatctttgctcttcaagaaatggtttatgctaaaatttaatgaccacctactaagagcagtgatgcatgcggaggcttgggtcctttttttcttcctttccatgcctttcacagcggagtctaccactgctgctcatccttagtttcacctgccttactttctgtccagttttcttcctggatcagggccctggcaccctatctaacttctattaattctgtttcctggctgtgggtcatgttcctcatatctaccacctgctttctagtggcagtacaacaattacagctacctgccagccccatcaccccacttgaaaggaatccattatttccagggtcctgcttggattgccttatttcaatcctttaaaaaaaatattcattcttgtgggcttttgactttctcatttccaaggtcttctttttttaacctttaaattcaggggtacaagtgcaggtttgttacataggtgaacttgtgtcatagaagtttgttgtacagattatttcctcacccaggtattaagcctagaacccagtaattatttttcctgatcctctccctcctcccaccctccaccttctgaaatgccccagtgtgtgttgttcccttctatgtgttcatgtgttctcatcatttagctcccactaatacgtgagaacatgtggtatttggttttctgttcctgtgttagtttgctaaggataatggcctcctgctccatccatgtccctgcaaagcatggtactggtacaaaaacagacacatagaccaatggaacagaatagaggacccggaaataaggctgcacagctacatctatgtgatctttgacaaacctgacaaaaacaagcaatggaaaaaggattatctattcaatgaatggtgctgggataactggctagccacatgcagaagattgaaactggaccccttccttacaccatatacaaaagttaactcaaaatggattaaagacttaagtgtaaaacccaaaactataaaaaccctggaagacaacctaggcagtaccattcaggacataggcacgggcaaagatttcataatgaagacaccaaaagtaattgcaactaaagcaaaaattgacaaatgggatctaattaaactaaagtcttcccttaaaaggtcactactttccaggtgggtagcacattcagtggctaatatcttagtttgaagggcatttccctggccagtgtcctctggagttagaaagagctgagcagcatggcagcactggtcctctgaaaggggaaaacatggagtgggatgtgattaactgagatataaaatctcggagggtgtgatccatgacccttgttgacccatgtcttcctcacacctaggagtgcctgcaacaatgtagatcctcagtgttgaatatatgaatgtgtaaatgaaggtacctatttcacaaatcgtctaggattgacatcaccctaaggatggatgttgtttatttcaccagcagtttgggattgtgaaagccctgtgtatggtcacaggctttgaaatgtgtgatgaatctgcatctttaattgggtctctatagtcaaatgagagtcttcatttttctaaaggttcatactgagaagcacaggctttctttcagtgtattgaaggtgcattgtattagattaacactgaaccaaaccattgtcctttgaattgcatgttgtaatcaaacaatgcgattgttttgttaaatactttaaaaattgtattgacttctcaaactaaatagaaacttacttagcttaatagtcagcttatatcatattttatctcatcacatttttcttttctaatgactgtatttgctttattattctgtggctaagtaagatttaaaaaaaaaacccaaaacaacattaaaatgctcccttttgaccaaggtacttccttctcattgtggaaaatgtggaaaactctcacatcaattgcaccaccaccccccttccctatgcactcaatgaaacaatttaaattaagtatctattttgtgtcagctatggagatagactttggggaaataccgttccttttttcattcttcattttgtgccaacaaaatattttgagggaggaatatttttatatcaattattttcattatctaagttaaaataggtacaatggccatttaccctagatttgttttaactgtcctaattttcaaatagtctgaattatttacctgcatttaaagctatgagtcctaatgttggttttggaacatatggtcctcttggagatatatttattttcagagaaactacctgagaatttttacgttttttcttgagtcaaagtagacttatgttttaatagcttgaatagaagaaaatttcaaaactcttagcccattgtaaagttaaagagtacataagtttatgtagtattcatgatttacgaataattggatttttagatcaaaattaactaattgaacttgaaaaatatccaactctatttttatgtcatgtattcaatgcatacacattttatatacccaaatctctagacactgtgcctggcaatatgaatttaaaataataagtaaatatttcttgattttagttttaatgcacaataaaacactaagaataaatagcctagttggtgtatatagaaaaatccataagtaatgattcaaaattatttgaagatggacatattatttttagtagtgagtatatatgggatgtggctgaaattactagacatataaccataatattatgtgaccatttggtgtagataatgcctgactgacaatagcagcaatgtatggttgttttttggtgtttctaccttttagacttacacattttaaatgcttaagatgagtaatctcattcatctttcctgttgcttgcactgaatatttgttgctgctaatccttcttatttccatagtattgttcaaaggtacattccagggcatctttgaagcatattttttaacccccgctgtgtctctaacttgtcatgtaatggttgcttgagcatgtcagccattctgtgtgtgtttgccaagccccagtgtgctggtataagtaggcattgcaattaggctgagagacaagctgcattacaagaactatttgctgcttatattgtcccaatattttaacccaagccaatacagatagcattgagcataatactttacatatagtattaaatatagcatacattacataaagcataatacaatatatataacattgcgcataatatattgagcatgtaccatatgtccagcttttgctaactactgtggagaaatatgggggtgggatgaggaaggcagtattggatgggaggctggtaagaagtataaaggagacctgctcttagtaaactgcagttttgttgaggataacagtgatatacaaaaataattagaaatcatataaggaaaatatacaaacagcgatgcttaggttgtgctgatttaactctttatgatgcagaacatgtaactgggcagctccaagtcctaaagtcttgtaggagttcagttgtttggggtaactacatttcattcatgagttgtatgagtgtagctatcttcgtgtcatgtcttactaccttttgaatcattggtaatcattgttaaacacaatactttggtagaagagatcagtgacaattcacctctatgattgttaatgaaaacgtttgactactgaaataccttcagtggtaatagcttcactattcttaatttttttttaccacaacacttaatttttaatctacgatatgatcattttattgctccatcctctaaatttagccactgagatgattttaaagcatccttaaattccttaagaaaatttaaaaatcaggaatagacagaaggaaggattcacatctatatttatcccaatatactttcctggtgttttggaggatgtcagcttcatcacagattaaacaccaagaaaaggagaggtttaaaagttcacatggatgtgctgcactatgcaatatttttttattttctgtgtgcatattagtaacacttattttatggctgggtgtggtggctcacgcctgtaatcccagcactttgggaggctgaggctggtggatcacctgaggtcaggagtttgagaccagcctggccaacgtggcgaaaccccgtctctactaaaaatacaaaagttaactgggcatggtggcgctcgcctatcctctcagctactcgggaggctgaggcaggagaatcgcttgaaccagggaggcagaggttgcagtgagtcaagattgcaccactgcactccagcctgggtgacagcctgagagtctgactgaaaaaaaaaaaaaccaacaaaacaaaacccgctttctttaggattttgccttttcttgaggacttatattgtttttgaggattttactagcattttctaggtctaaggactcaaaaatcctgaccccaattctttttctcttatacgtagtgacagactgatattattgtaccaattatataactcagcttctcatcattttgatgtgcagaggttagttaatttttagaagctacacagctaataaatagtgtatttattttttacaaaggaaagttctaccttataaaagaatagttctgttatgaaatcttatacatcagttatagaggggaggacatataaattatattacttatacaagtcaactaattttattgtatgataatgagacagatatgttattaaaatttcttcattacatcagtttttccaaaatagacagttttattgacttttctttttctaaaggtattatgaatattatctttaatgccagcatttaaagatctttatgttttgtgtgcatattatagttttttctgtgtgtttgtgtgttatataagaaggatcatgtgatatatacagttttgaaactggcttcaactccccctttcacagtatgtcatagacatctatcagtgtagtcattgattacaaatctgcatcatgattataatgactgtgtagcagcatattgaattgattcgtatgtctttgtttatttgcttaaccaatctcttattggtggacacttggttttcacattttctctctgataccaacacaactctgagatgtgtatactttctatgagactgtgtgtgtcatgcatactttcaaagatagccttctgataccttttttttttttgagacggagtctcactgtgtcacccaggctggagtgcagtggggtgattttggctcactgtatcctctgcctcctggattcaagtgattctcctgcctcagcctcctgaatagcggggattacaggcatgtaccacgaagcccaactaatttttgtatttttagtagagatggggtttccctgtattggccaggctggtctcgaactcctgacctcaggtgatctgcctctcttagcctcccaaagtgttgggattatagatgtaagccaccacacccagcctgattacttcttcaggataaatttcaggaagttgcagagcaatgtcatgttgcagcctctaccacctccttcttttcctcctccttccatttttttttgttatctgtaactatctcaagtctgactgctcgccagtcagaggccaaaaacatgagaagtgagatatggtgaaaggaaagcaactttattgattgaatgctagcagatgggagatggccaggcttctgcctcaaataagccatcttagttttttgggccggatgaaggagtttgagagggaaaaggtgtgggaagtatgctagagtggtgcaggaggttgcaagtctatgttttattccgatggctatcaagtaatcgcccgttggaagatccggtttgcatcaccttgactttggctcggtagtggtggactatctgtatctgtaattcctcctaagcaggaggattctgcctctgggtctctctctgcctgatttgtttaaaaattggcccctggaattttaaggcaagcacataattacataagcgagcactgttcactgaaatgcctggtgggaaaggaggaaacagagtttcaaagtatgtttcaaggctgaaagcaagaaaggaaaaaagttttaaaatgcattttgaggctgaaatacttggttacctgcttatttatatttataaattggtattctaaagtcccaatagaccatagagagaaaaatagagagaaggaaagtttcttttttctaatactctgctgtatgttaggtactgtaaatatagtatttaatcttcatgttaaccctgaaagctgagtggagagtttaaataatatgccaaaggctacattatcaatgtcaaggctaaaagggaatttattaatagttctgtctaatcgtagaacattgttttaaaatttaagtgaaattcatataacatacaattgaccatttaaaaatgtgcaattcaatgtgtgtttccttgtcttggctattgtgaataatgctgcaatgaacatgggagtgcaggtatcttttccagaaccaaatttcatttcctttcaatatatgcccagaagtgggatggctggatcatatggtagttttatttgtagtttttttgaggaatctccatactgttttccataatggctgtgctaattcacattcccaacaacagtgtgcaagggtccccttttctccacatcctctccaacacttgatatgttttgtctttttaataatagctattctaacaagtgtgaggtgatatctcattgtgattttgatttgcattttccccataattagcgatgttgagcaacttttcatattatctgttggccagatatgtcttatttgtatgtcttctttagagaaatatctattcagatcctttgcccatttttattcgggttttttttccattatttcgttttcattattgtatgagttcctcatatattttggatattaaccacttattagttatatagtttgcacatattttctcccacttcgtaagttttgtttttgtttttattttttttactttgttaattgtttgctgtgtagaagctttttagcttgatgtaatctcacttgtccttgattttgttgcttgagctcttggtgtcattacaaaaaagtcattggcaggagcaatatcaagaaacttctcctctgttttcttttaatagttataaggtttcaggtcttacatttaaatatttaaccactttgaactgatttttgaatgtggtgtgaaataaaagcacagttttattattctgcacatagatatccagttttcttaactccatttattaaagagactatcttttccccattttattttctgggcatctttgttaagcatcagttgaccataaatgtgtggatttatttctgggctattttgttctattggtttctatgcctgtttttatgccatcgccatactgttttcattgctgtagctttgtaatacattattttgaaaccaggaagtatgatgccttcagttttaatcttcttgctcaagattgcttcagctatttggagtctttgtggttctatatgaattttaagaatttttacatttctgtaaagaatgccattaggatttagatagggattgcattcagtgtatagatcatagatcattttgggtagtgtgaatattttaacaatactaatttttctaatcaatgaacacaggacatcatttctttcatctgtattttcttttattttcctaatcaatgttttaaattttcagtggaaaaatctttcatatttttagctaaatttattccctagtattttattctttttattgctagtgtaaataggatttttttccttgatttcctttctggatagtttgttgtcagtagatagaaatgacagtgatttttgtatgctaattttgtatcttgcaactttactgaatttgttcattattctaacagtttttttgttgccattagtgttttttacacatatgatcatgtcatctacaaacagggatagttttacttcttcctctctgatttcagtgccttttatttcttgtcttattgctctggctaggacttcttatactgtgttgaagagaagtggtaagcatgggtaccctagctttatatcagatcttagcagaaaagctttcagcttttccccattgattatgatattagctgtggagttttcatatgttgtctttattatgttgaagtcagttccttctatacctattttgttgagaggtttttcttaaatcatgaatggatgttaaattttgtcatatgctttttgtttttgcatctattgagatgatcatgtagttttatcttagagtctgttaatgtggtatatcacattgatcgatatgttgaatcatccttgaatctaagggataaatcccccttgatcattgtgtataatccttttaatatgttattaaatttagttttctgatattttgtggaggatttttgcattgtctgtagttttcttgtagtggctttgtctagctttgatattggagtgatattggcctcataaagttatttctgttttttgaaagggtttgagaaggattggtattaatatttctttgaatgtttggtagaattcacctgtgaaggcatctgcttctgggcttttctgttgttgttggaaggtttttgattactgattgaatctccttatttgttattggtcttttcaggctttctttttattctcaattccttcttgttaggttgtaggtattcaagaatttatttatgttctctaggttatctagttttttgacatataattcttcataatagtcctgtatgatccttttatttttgaggttcccattgcaatgtctcattttttcatttctggacaaatggataaagaaattgtggtgtctatatacaattagatattattcagcctttaaaaagaaggaaacccattttcaaaaacataaatgaacctagaggaaattatgctaagggaaataagccagatactcatcattgctgaatgatctcatttatatgtgagatctaaaataggcaaacttctagaacaagagagtagaatgttgtttgtcagggttggggggaaagaggaattggagagatgttgttcaaagggtacaatgttttaattatgcaagattaataatttcttgagatgggatctaatgtacagcaaggtaactacaatgaaagatacttggaatttgttaagagggtagaccttaagtgctctcgccacaaaaaggaaaataaagaaaatggtaactatgtgaggtgatgaatatgttacttaacttgattttggcagtcatttaagaatgtatacatatatcaaaacatcaaggtgaataccttaaatgtatacaatttgtttttgtcgagtatccctcaataaaatggaaaaaaaatcctaaactattcagcggccttgaatacatttgtagtgttgtgcaaccatcacctctgtttagtaccaagacattcttgttacaccaatatcaagccccacatgtattaaatgagtcttcatttccctcttgctagcctctgacagccatgaatctgctttccgtctctatggttttacttattctacatgtgtcatataaatggaatcatacaatacgtgacttttcgtgtctggcttctttcaccaaacaggtttttgagattcatttatgttgtagcatgtatcagtcctttcttatttttatggctgaataatattacatcatatagatataccacatttgtttattcattcatctgttgatatatatattcattgtttccactttttggctattgggaatagtgctgctctgaagattaatgtataagtacctattttcaattctgtttttttttgttattgtttttgtttgtttttttgttttttgtttttgaaatggagtctcattctgtcgcccaggctgaagtgcagtggcatgacctcggctcactgcaacctccacctcccgggttcaagcgattcttctgcctcagccacccaagtagccaggatgacaggcgtgcaccaccacacgcagctaatttttttatatttttggtagagacagggtttcaccatgttgaccaggctggtcctcccaaagtgctgggagtacaggcatgagctaccatgcccggcccctgttcacaattctttaggtatataactaagattggaattgctgggtcatcttatccatagaacttgtgtagccttctttcacaaggctgtgggtattgtctgataatataatattttcttactatttacaaaatagaaaattcaagttattttaaaagatttgaataatcacaaattttattattgatatgaactttgatgtttagaaatctaaaatcttaatcctctagtacgtttcttcctggaatttgagactcctgttaaaactgttacaagttaaagttgaagaaagcacaaatatactttctagctcctggctattgatatatgcgatttagctgacccatttcattcaaggtcaggagtgttagtgatcttatccagagaaaccacagattcttataaattccctagtttacaattggggatgacaaatcacattttttcgaatcttgaagctgaggatgggctttaaaggaatcatcatgatgagaacatttttacatataattgcccaggaaactattctctagggatcttgagttcatattggattcctatataatttcttcctgtgtattttgagacctgcaagatagaactaaggggaaattagagtgggcaagagaagttcccttcttattgccagtgaagtatagcagctgacatggcttgtcagggtaagtgagtctcattatccctcagtagttgctaccaggtgagctagcacaaggaattaccttcttcctgaagcataaaatacaacagagaggaaatatctcttttttttttccaagaaggggaaaggtaggaaagatgggaaaaaagaaagaaagaagatagtgtacttaattataatatttttgaaatggaggagacctgaggaatcactttagttcaacttctttactttaaatagaaagagactggtttaaagttacccagccctgtggttataaccccgcgggctagaagccaactgtgcactctcctgtggcttgtgttactagtttcctatggctgctgtaacaaattattacatacttagtggcttaaacaacacaaatttattattttactcttctggaagtgagaagtctgacataggtctcaccgggctaaaatcaaggtattggtagggttgcattattttctggaggctctagttaagaattattttctttccttttctagcttctagcagctgcctgcattctttggcttctggggcccttctgtcttcaaagccagcagtcacatcagtctgacctctccgttcatcatctttgactctgactcttctgcttctctctttcacttttaaggattcttgtgggcccacccaaagaccacaggatgatttccctaactcaagatccttaacgtaatcacatctgcacattctcttttgccatgtaaggttacatgtccacagtttccagggatttggacatggacatctttggaggacattgttctgtttaccatagcttgaccactcgttctttaaggaaaaacataaagaaagaaacaaattatataccccctcttctgaggactttgtagatttatttattgacaagtattttcactcatttaaagatggcaccttatatttgttatatttacaaactgcttttgcatatgctatttcatttcattgttgcccttttcacagtggcaacaaagactcaaaaacttaagtgaattttcagaacaaatagtggtcttggcatatgaatcccatgtatttgagtctgtctagtgtttacaacattctactcactatctcatgaaagtgattttcagcactttctaacttaattccttgagactttggatgtcatatgtgggttggtttgtggacattcttcatcatgtttaacatcctcgaagcctctcctacaaagaatgcactgctccttctggatttatgttgtaaaatatgttctaaaactaacttgaattcctatactttcttgcctattttctattcagaaaaaaacaagggaactgatatatttgtctacataattgtgagttgttagaagccaaataatcagtgtgaatggtatgccatgctctatgaatggttgttcagcagtccataaatttggtcttcttcttgagggtaggagtagtgttttgtttactttatggttcttagctattaactaagtaccttgcatttcatagggctttagtaaatttgtgatgtttttaattattgaatgctgattatatcttaagcttagaaaagaagtgaaacttgtggttttaatttaatttttaaattaatctcacattgataagtgtaactattaactacgttataaccttaaaatgagtcatttcatgagtctccaaaggctctttccttgtgtctaaaatgagcaacaaaacaaaccaaaataaaaccacagataatggcagagcttttaactttgggagactgaagaattgatgggagtaaagaaatttacaatttaaaatatcaaactagtttaaccttctaccaattaaattatgtactactggaaagcatagcttttaaaatactgtaactagttaacaaaaatcagctacaatgactgaatcaacaatcttctttcccctaattacaacattaactgcttcacttccttggtgaaaccccagctgcctctcagctccacctgaatctggtgaggcccaccatctcaagccatctttatcttttaatattttagtcaaccaaaatcaatctccatgtttcatttagctatttaggctgatacttacatttgtaaatcataacacaattgtgattatacttaacaatactcttttctctgggattttataggtaaagtagtaatttcttaatggttttctaatttatggaaccaggttgagtttaaatacttaaataaattaacttgtaaatttccattgggttgacttttagatgctctctatgaggaaggtgagcaaacaaaaataaactcacatttcatcaattctaagcacatttttaacatctctgaaatcagggtttaatctgatagtataaggtttgtcatcttttagttagcagcattttgttttttctctcttactggtacataggagatgacggtgcatcttttattcattggtttgccccttagatttcatgaaatgtggtcatttaggtgactctaagcaggaatcttttgcattctgatttgcataatacttttttaggaatgattacaaagcaggctttagaacttctcccttctcaagattttcttcattgatgtatttttctgaagtatggctctttaaaataaaattaagctggaaacaaacctgcttatgtgacatagttcaaggactatatttaacagagttgagtagattcagtggcatcttgacactaacagtggtgggaatttctcttctatattctgcattttcttggtgaacttacattatcctaaacaattgattatttgaactgaagtgaccaaattaaatgattctacgtggcctaaattttcttgggatcatgtgttgtgcacatcttgcccactgttttttctatccatatatcaactctgcctgggtcatacatcctcaataagtctataacatattgagttgaattaaacaaaacacatcatcagggattgaagtttttatcccagaagacttctgaaggtatttaaaacataaacaaaattttaaagtgaggataaataattaagggaaccactagaatttgattatcacccacttaattttcatagctttcttctagacccccaaaacagctattttcttctgtctctttcgattttctctagtgatttttctaagcaaggctgaatggaagctaccagtggtcatttgtgattgacacactaaaaatataatgtgaacacttggaaaagaaaatgcccttggacatttggttagctgcatatctcttgtctcagatgacacccatatactctttcactttccagacaacataaaaattaatgctgtttgctatagcagaaaacagtcagaattattttcagcttttaataaacagctcaatagcctcagggaaattgggcatattacttcatttcttggttttcaaatgtatttctatcacttaattatctaatgaaaatggtattatttatttaaaatatttaagaaggtttttgactcagattttctcctcatttttacctctctctattctgccttctgcatcacctgaatggccttgcaaaagacagtaagagatgttgtggacaaatctggagcaattgatgatatacattttgcatttatgtttgtagaatatgaggaagtctgacaaacttaaaacagctattcacaggctgaaatcccactttctcaaaaaataaaatgaatttttggaatggatttttagagcttataaagaaactagtttacttgtatgtttattttaggtaattactgtattaatactcttttaaattttatagtggtgtatttcaaaatgtctctattttgagatgctgagtcaaatatgtttttcattaaaatgaacctctgtgtctgctttccagtataattatttgtctactagctagaataccatattccattttatttttctttcaggattattctcctaatcccccaagaccatccctgttcagcgtatatttagggcaatgataacaataatagtattaaaattttattaggtaagccaatctgctgaattatgaatttaggtcttgttggaaggacactttttctgaatttgtatttctagctttccttatttatttgaatagttgagattttagtatatttttactttatattttgtagaacaacgtgaattttagcatggaccaaaaaattaacgctttattttaccagtgaacaactacttgaagaaaatatggggccgggcgcggtggctcaagcctgtgatcccagcactttgggaggccgaggcgggtggatcacaaggtcaggagatcgaggccatcctggctaacacggtgaaaccccatctcttctaaaaatacaaaaaattagctgggcgtggtggcgggcgcctgtagtcccagctactcggtaggctgaggcaggagaatggcatgaacccgggaggcggagcttgcagtgagcggagattgcaccactgcactccagcctgggcgacagagcgagactccgtctcagaaaaaaaaaaaaaaaataaaataaaatatgggggcagggggtgcgcggtggctcacgcctgtaattccagcactttgggaggctgaggcaggcagatcacctgaggtcaggagttagagaccagcctggccaacatggcgaaacttcgtctctactaaaaatacaaaaattatccaggcgtggtggtacatgctacagtaatcctagctactcaggaggctgaggcacgagaatcacttgaacccaggagttggaggttgcagtgagccgagactgcgtcactgcagtctagcctgggtgacagagagagactctgtctcaaaaaaaaaaaaaaaaaaaagagaaaatataggaaccactctttgttgcagaaactaccctttgtgaagtatctattaggttataatatatcacatttttttttttgagacagggtctcactctgttgtctgggctggagtgcagtgatgtgatcatggctcactgcagccttgacctcccaaggtcctccacttgggaggctcaagtggtcctcctacctcagcctccagagtagctaggactacaggtgtgcaccaccgtgcccagttaattttttagttttgtagaaacaaggtctccctatgttgcccaggctagtagtgttgaactcctggcctcaagtggtcctcccacctctgcctcccaaagcacttggattataggcatgagccactgtgcctgacctacatcatgtatttatttaactagacattaccacttacagagcactttttcattttattctcatcacaattctgtgaattaggcattattatttgaaaacagggaaacagggtttagaggggctctggggcttgtcaaaagcaatcatatttgaactttatcaatactttaatccacattttctgattttatgagtgctgccatttcccttatatcatgctgcttatttggttcgtgcatggaattgttattatcaattaaatataatctctacagaatgaatgataatgaacattatcatgtgacaataacattgtgcagccattcagagggcacttcaaactttggattttcagaggcagtatctccagtaattagctgtctttagaaaaatagcatctataaatgcttcttagtcctgcccataatgagagagttattgacaaagctaggatgtgaaccacgttctagccatgattcatttttaaattaaaatatcattatatatgttagggaagaaaataagggcctttaatcatgaatatgtcctatatagaaccaagataccaattttctcacgtcagttcgctcagtaaatggtaaatttgaatgcatttgccataaagacaagaataagtcctaatatgagaatgaaatttgctgcccccatgttatggtttggctgtgtccccacccaaaatctcaccttgaattgtaataatccccatgggtcatgggtgggaccaggtgaagataattgaatcatgggggtggtttcccccatgctgttctcatgatagtgagttctgatgagatctgatggttttataaggggcttttccctacctttgctctgcatttctctcccctgctgccacatgaagaagtacatgtttgcttccccttctgccatgattgtaagtttcctgaggcctccccagccatgctgaactgtgagtcaattaaacctctttcctttataaattacccagtctcaggtatgtctttattagcagtgtgagaacagactaatataccccattaatttatctcactataaaattatttaaaaatatttttactattgttattttatccacttatgagaactcaaaacgtcctttgaaataaatagggaaatatttccaaaaataaaacattttatttgtagagtttcttttctcaatgctacataatcaagctccacttgaggaccttaataacaatctttatcaaactctaaaaggaatttttatctttcattgctaggcagaatactcacgacttaccctggttgtctgagcagtcattatctagaatgttaccggttactatggcagaaaaaagagagcattagagagtctcccattggtaattaatttttctgtcaaaaaatgccatgttacttccttccacaagtcattatcagaactagtcaatgatgactgtgttccagtcttttgcctgtttactctgaggtcctttcccttcccttttcaaccttgccctggttttcaagaactgcatttcataggcctttttgctctctggattccaggtagttttggccattgggaggtactcatggcagaatgcagagggggtgggggtagtggataaattagattatttcatctccttctttcagccttgggcagtatctctagcagcagtggcttctctgtgatttcacctcccaactgacagcttgatatagttccaacttccacgaatggcttccggggtctgttaatcgtactttctctttgaccttcttcgcctaaagatataaccaactcctaggtggctttccatcctctatttggcctctcagctcttttaacacatgcataaacatttccctgtattaaattctctgtattgaaatgttaatgtggtttatgtttttgaggagctcctaactaataaatccagattaggacattcaatcttatcgtgttcccagaggacacagaactggaaatatttggtgaacagctctcatgattgctgtactgcctatttacatctgacttgcaatctacctctctccagccagacctctactctaaactataggaccgtatatatacatatatccaataaactacctgcttttgaatgtttcagagacacagtaaactcagcatgtcaaggtggcaacacatgctcaatcccccagcaaacctcatcctctcctgctccctccctcatgcattttgttagtcgagacaaacataattaattcttgcaacttcattccctttcagcctgcacaaccataattttaaccataatcataatcataaccataaccataccaataattaaaacccacaacctttacaattatgtaacctgtgataccctgaatatctctcacttctattcacttctctacattccactgctatcaccctattccaagctcctgccttcaactgaatgattgcaataacgtcttaaccttgtactcaatgttatattctcaaaattaaagttaatcatttttaaagacctccaaagattcaaaccttcagtgaacgaaggtcgtgaccttcagtggcttctaattgctcttaggagaaaaacaatactccttaacataatcctagaagacctagcaaaaacttcctcttcagccttatctccctccccacccctgcccctgatatgccatcttactctctgaattctggcctcaccaacttctttaagtcatttataagtgtcagtccttcccaacccccaacataacctcgggcttttaaatatacagttaccattgtctgaaacacttttcttccttactctctatgttaacatcatttagtaaggatttacttcagtgttatagcctcaggaaaaacttgcctgaccaccctgactacataaaataccctgttacacacattcaattgtgtcatgtacctctgccaggaagcattaacagaattgtgattttacatttcttcgtgtgattctttggtgagcagtaatctcctccagtcacaattgtctttaaactctttgaggtgagagacaatggatgattttgctaaccattatatccatagctcctatcagtgtctgggacataactagctcttaataagtatttgataaattaatgaatgagagcactcttcttcttccctcccttcttctatcctgtctttctctctttctttctccctcccttctttccttcctttttcattgtgtatttactattaggaaatgacaggtctggtactgaacagttaatttctacctataatttttaattcctcaccagtactttctttggttgatgtggagagtattcagacagtgtctaagttaattttgtgttgctataaaggcatacctgaggctgggtaatttataaagaaaataggtttatttggctcatgattctgcaggctgtatgagaagcatggcactagtatctgctctgtttctggtgagggcctcaagctgcttcccctcatggctgaaggtgaagaagagctggcatgtgcagagaccacatgatgagagaggaagcaagagacagacagggggaaggagcgaggctctttttaaaaacccccttttttctggaactgacattctcacccaagagccaatccagtctcatgagagctagaacttaccaccatgagaatgacatcaagccatacatgagggatctgcccccatgacggaaacaaacacctcccatcaggctccatctcccaacaacaccacactggagatcaaatttaaatatgagatttagggggacaaacttccaaactatagcagacaaaatatttgtggtcatgggcagcctatcattagcagagagagggtgcagattttcacatcagaaggaataggtttcgagtcctagctttgccacttgcttgttttgcactctgggctattgcaatgatctatctgaactcagtttccttcttggtaacataagaggataatcagtgccagcttgtgggcattacattgtagtaattatatatctaatgaaacaaactcacatgtagaagccactcaataaatagtagtcattttggccgttgtcaaaaaattattaagtaattatagattttaataagaactattaggtagcatagtgtataggaaaacctttactgagtgttcatatgtaatgtttgaatcagacaatgaaacataaataatggataagaaatataacgtacaattttggaggattaaaatgcagttcatttagtaaatactatgtgaaaacaatgtgtgtaggtgcacgactatatatacacacactgcgcctgtttctatttgcctatatattctttttttacctgtatactcttctattaatattatttaaattgacaaatcatacttgtatacctttatggagtacagtgtgatattgtcatgtaggtatacaatgtggaatgatcaaattgaggtaatggataggtccatatatcttaggtgaaagtattgtaatagcacccactgctgtcaatttttttcattaacttttgtgttgtttaaaacactgtgtttcaatacttttttaagtgtttttaattctttagaaagacaattccactggaataccttgatctcttacttcatagaggaaaagtagaggaaagaaaaagcttgtgcctctttactggtacccccaacaatgtctgtctttgtggggtgagaactgatgtcatctttggcagctatatggctgatactgttctgtgagattgcaacatatccagcacatgcctgataggaaacccttttccaaatagtaaacaacccttcacaaggcagctctgccaaagctatgtattgccattcaacagaagatcaacaggacagtccttttctctttactttaaaaagcatatgcctttaatgatgtgttatcgttcaagccatctgcagatgtactgtccatccaaattgccagggttaaattgttgattattagaaattgttgtgattgtctgattatgcttgtgtcataaaatgactattttctgtcacaatttgacgagcccctgctttagaatagcaatacaacacattttacccatttgcaggtatttcaagtattaaattggatgaatctttttaattttcttctactgaattgagttcaagtgaatttgataggattattagagcggctagtgtctggaataacaatgatgacttacagaaggagccagcagggctgatgttattgacgaagagatactttagaccctttatttgtcagcagggagccctgctctgtggttcctctatgagtccttccctgtgtacggtgcccgcctgttttactttgaaggcactaaatgcatcttttcaatcaatattcaattatataagacaaggaatgctggttaagtaaccatgcctatctgtcaaggaaatgcatttctccaaataatttgtcagggcttctgggttagttcatctttcctacctctggttgagtacttgcccagttacacttgtcgaacacgtgctttaccttcctgcacagagtctcctttggtggcgtgtttcttgcttttcttctggaaacacccttctcagctccattccttgcagtatttgactctcgctacccaggaaaccagagaacattcttcctagtttcacttcattttcttgccttctcatataggccactgccaatcagctgcctcatttaaatcctgcagtgtatgtttatattggtcttaccttgtcctttcttcctaaataaacctggggagctttggtcatgttcatttttcaacaaacctgactaggtattctaatttcgtaaattaaccatcattcttgttttattccactggaaattgacttaacatattattcactttggcccaatctgccaggcaggcatgaggatattgctttctaagctaccttctaattgaagaaatatgaagatttcacaggtcaacacataggcagtgtgaactggggagcttttagcatattaattgggctctgaataattcactatagttaatgaaagttgtgcttgttatctaagatatatggagggcactgctgtacctttcgtaggacaattcaaaaaaacaaaataaaacattaatgtaaaatagataagcaatgcataaatgggttgcagctcatattataagagttttgaattcattttatttcattcccatacttctcaaccaatccagctacacccacatcttatttaattgacagatttggactgtcttgctggctaggaggataaaggcaacaaactttctgactgatcctggattttcctcaagagcaagtttccttagttattggtgtgtcctctgggtatcctgcttcctgaattccacctttgatcctcctggttcttaaccatccatgttgtcttcagagtctgcttgtctgctcattcctgttaatttttttttaacttgatcttcaattgtgagtcttctcacttcctgcctgttctaacttgggctcaaccttgaccccagtcttcagctctgcaggtgggagatgtatggaataactgaagtactccacacggtgttcctgcttataacacaaaagccattgtcatttgacaaacagatgataaagaatctattgttattatttttactttttacctcattattactagtattagaaaatgctttactaagcttttgccaaatattagaccgtgtgctgggagttctacgtgtcatatctcttttaagcctcacatcatttacagaggaggcactgagaggctgtgttgcctcccctggccacatacttattaaatgaaggggtaagaatttgaatcctgacagtctgactgcctagcatgtgcctttatatttgatgctgtatcacactaaattaacaccccatagatccattcttaaatacaaaaatctatatcctcagactttcagggtgttaactttgcactgtaagttggagtctttacattttaaacaaatttcttactttctgtttgttttggattgtcattgcttattttttacttaggagtataaaaataagatagtgaaagtttggacaaccttacatacctttatcatcttcagaagtccgatttttaatgatacgttaaaatagtcacatgtaatcattcattctacaaattcagcaactgtttgctgagtatctactgtatactagcaatgatggaaggcactggggatgtaatggtgaacaaaaaggagtctcttcttctatagagtttacacatgtaagctgggcattggcccagccatgaagagtaagaaacaacttatgggaatttgttgagcttcaagttaaactctgttaaaaacaaacaaaccagaaatatatatgtagagtgtttaatgtgttctgtggctctcaataaatgatggcgttgaaaaataaaatgtaggtaatttgatttaatattcaatcagatgcttgcatcaatcagatgcttgcaaacagggtataacaagataatactatgatatttcttggaaggtaatttaaatttcagtttaaatattttattcagcttatttatcgctatgtaattatacataaatatataacttgaatcataatattctagttttacttttcttgcttcctattgggcttctccctctccatccctttccctcttgatgcaaaccagccatcccttgcagtcacccccaacaatatcaaagtgtgtgtactttcatttttcctccctatgttcttatatttctatttaggaattacagccacacacacaaatacagggttttattatgtcttagaaaaatttaattatcaatattggtgtttctgcatcttgcttttattaataacactcaataatgagtcatagataagttgttaattggtataaaaatacagttagaaggaataaattttagcatttgatagagtatggaaattatagttaataatttataatatatttcaaaataggtataagaggaggagcataatgctcccaacacaaagaaaagataaatgtttcaggtgatggatattccaattaacctgatttgatcattacacattgtatacaggtatcaaagtatcacatgtagcccctgacatctgtacaactatgatatgtcaacaaagacatacaaaaatttcacattacttttgtattaaataagtataattttataagtaaaaaaaatagtcattgaatctgtctaactaaacagacatagctctgttttctttttcctaataggtgcctaatattccagctgaagtggcataatttattttgttttaccctatttgccacaggcacattgctcccaggctttggcattacaaatattgctgcagtaaacatccttaaatatatgtccttaaataattgtgtatctgtggaatagattccaaagcatgagcatgattgggtaaagaagatgagtcttaaaattttaaatagatgttgagagattgctttaaaagaagaaaagatgtctcaattttgtttttacaagtatatgcggacatttcacatgttgtagattgatcagttgttgttacttttaatttgcctaatgacttgtacattggacttttttttgataagttgcttggcttttaaattttctcttctgtaaattatccaatttaaatatcctgccagtttttttctattgtactatttattctcttgtcaatttgtaagtatattttatatattgtggatattaaccctatgtgttttctgcatttcaaattatttttcaaatctagcattgccttgaattttttaatgatgttttccataaataaacatttaaagatttttgtatagtaaatttgtctgttttaggcatctaccatcttgtttaagatggattttcttgtctcttagattttatgtcttgttttctagaatttttaaaaacatatgtaatcttttaatatttttaaaaatttgtaagcctttgatagatcaggatttttaaaaacttgatttaaaatagagttactctttaaatttcctccagatggaaggacagttgtgatacaatgatttaaagcataatttatcatgttcccacaaaatttaagattgtttattaaaagtaccccctctttttatagatacaaaaatatcttcatataaatatttgatcaagttgtcattcatacattcaacaaatattaagtacctcctgttttcctggaattctgaaagaagcataggggtgggggaagcacaatcttgaaatggccactgctttttagagatacagcattcaattttgataacagtggtgggtccagaaatctcaaaaggctgaaatctgttgatggctctgtcactaagagtatgacaggtttctgacactcaacagtgctgggttttagtttcatctgaaacaaaatgaggaagttatgtccaatgatctccaaagccttttctagtcctcaaacatgacagcagctgttcaatctcttctactacccagctatttaaagttatcttctgccaaaacaagcaaaagctcatagctgagagagaatgaatgaatacaaataaatgaatatgaatatgtaaattggatagactgaactcagccaatctgaaataaaggtgaaagtgatttggtgatcaagctctatgtcatcttccttctctgaattatggtgatgggacaggggtttgaaaactcactttaatgaaagaggtgaatcactccatggctgaaaacagataacaaattacttgagaaaactggcaccatgacattttgcaggtaattaagcattcaccttccctgagctctcaccttgacccctgaagagatattcaggatttaatcacaatatatacattatgtgtagattaaccaaattttaaaattgccattcttaatttagtagtaatttgttagattattctggttcaaatcacctcaataatatcgactttaattaaaataatcagtataatcacaatgattcattttagtgcttttgttttatataaaaatctgtgaaaactttcttctttttggaagacaatttaaaaaaataggctacctgtcttaatgtatataacaagttaagtgtaaaatcctttacaggtacatattctttgtaatttatgtctagcatagtcatatatttgaaatcgagttagccattgaaatgaaggaagaactttgtcatgcaaagccattgaaacaacatacaaaaataagttgaagtttttataagtgaccattcgtggtcatcttatatgtttgaattaaggaaacaaactgaaatagccaagtagataaaggaagagcttgcctggcatgcaaagctagagaatactacacagaaagaagttcaagcacagaaattacagttcatgggaatgtcagaatacaaattctgtcctcacaatctcttttattcggtgagtttaccagttttaaagcattaatgaaattatttcaggtaattactgttttactcccatttttattgtctggtgtctctttagcacaacccattgaatcattctttcatcttaagtcactattcataaatgcacatgcaacagatggtttatattagatcatgtgatcctttgagccagagaatgaatttctatttgggtttcattcgaaattatctacctcagagataactgaaacctaacttgatagtattccctgtattctatttaatactttaaaagagtatgctttctgtttttctggttgtgtaaaatacaccttgaacacattcagcagactgctatgtacaaagaaagtgttcaataggtgtgtctgctgccgttttaaatttgggtgttagatattctaggtttcatcaaaataaggcattgtttcaagttgtttccacaataagagcatatatgcacaggcaaaacatattttgaaatggataaatggatacatatggatatgggtgatatttcttaatagcgtagctggattgactcaggcagacccttcagccagacgttttctttgaactggatcgtctctcctgtagcagaggactccagccaatgaagttaattagtgccagattaagatggtctcagcaggtggctgcttcagactctctctctcctctgtttgttgaagcctcatcgttggagaagggcttgagtagtcttgtgttactgacagctgtctactgttaatggaccatatgcaatgatggtaaagttgccatcaactgttgatgaaccatatgtaaatggtgaacagagtagcagatgaatacttagaaacaacgaaaggccttcactgctggactgagagtcagaaccttaaaatgattttaagaaaaggttgctaaaactatgtcatgatcattatacctttactgcacacaccctctgtcactcagtttgaggatctaagacagatatgccaatggaaagattattgtcttaggtcttacaaaacctgacatagaaggctataataccccacagagacatgatttttcagtttcattaatgaaaagaaaattaataatagcaaattaatcactaagctcaaccattttgaaaagttaaaagtattatttaagggaacatacgtagaagaaattcattatcaaatgaagagtatgggaggacttttttttgaaaggcagtttgattctacagggatgccctttactttctgttaagagtatgatgttctataagctgagatggggaagaagtagctacttaatttacagagaggtgattaaagattatatacaatgaacatcctcttaaagtaatataataatgataattgccaatataatagctaggtattttggatgtcctactcatttcatccactcatcattcttatgaagcagatactatcattatctttattttatagatgagggaaactgtagcctaaagaaattaagtaacttgctcaagattacgcagctgagggttttaacctcagtctgtctctggaacctctactctttttttttttttaattttactttaagttctgggatacatgtgcaaaacgtgcaggtttgttacataggtatacatgtgccatggtggtttgctgcacctatcaacctgtcatctaggttttaagccccgcatgcattagttatttgtcctgatgctcttcttcccctttgcctcccaccctccgacaggccccagtgtgtgatgttcccctccctgtatccacatgttctcattgttcagttcccacttacgagtgagaacatgcggtgtttgattttctgttcctgtgttagtttgctaagaatgatggtttccagcttcatccatgtccctgcaaaggacatgaactcattcttttttatggctacatagttttccatggtgtatatgtgccacattttctttatccagtctatcattgatgggcattagggttggttccaagtctttgctattgtgagtggtgctgaaataaacatatgcgtgcatgtgtctttatagtagaatgttttataatcctttgggtatatacccagtagtaggattgctgggtcaaatggtatttctggttctggatccttgaggaatctccacattgtcttccacaatggttgaactaatttacactcccaccaacaatgtaaaagcgttcaacctctactcttaagttatgctctaaactgggtacggttagtttaaaggtgaagtgattttgccccatttggaccttatttccaataattggaccagttattcaagtgacatccatggaacatggtatatgtttgctaactcattttttgaggtaagaataactgaataaatgggtaaaatatatgtgtaaggaagctattgttattgcattgttatgccacagggggcagttattttcctgccatgatactgatgagagattaattttactctttgtaaaatgtaagaaattacaagaatactgcaaagctgttttgcaaactccataaagcaacatatgttaagtgtcttgactgcagaagaaagttgttatacacctaaattttattgagtctgattctctgatttccattttagaaataaaatgtgtaaatctaaagacaaaaatcctttatgcaggagttagaaattattactcttggccatcctgcttacagcccatgtaggaagagattcagcacccaaaaacttcctccttacggctttatctgtggcttttaagatcagaaccatgtgtcaaagtctagtgatcttgttacttttctacagaaaagttatacagcagaaaacgtaggagggtaatttaaatgaggttagaaagggaagataattaaagaaaatctaatgatttactaaaatgaaggcataatttacaacatgtattatacatcaaatacctttaggttaataaaataaagcaagacatacttattttcaaataaccattctatactacttctgcctatattataggagttttaccaggctctcgtatctgacagtgaaatgatgctcatggactaaagtcttgtattgagagtttggaggctgtggtgctagatttccttttactatagtaacttgttttgtgatacttgctaagtcacgtaaaaagttgacctttagacattccttctatgtaactggtttagaatccatgacctcaacattttttgttagttatgttgtgtttttaatgctacaaaatgctatgattcagggtcaatgggatcttcaaatatttagttattaactcagcttaagcaaagactgtattcataaattgtatataatattagtagaaatttaaatacaattgtaaaaatgaaaacaattgaaaaatacttaaaacatttattacaaaggtgtttttcaaggttatgatggcacaattacacagattggaagaactataattggcactttcaactttaagaatactttcaatacaactgacaggttttcaaaaggaagaaactccaatacatcaagaaaccattgaccttttcaagtaatcatttccatgctagtgttaacaaaagaaacatttcaaatgcataatctcatcgtgtagtttttagagaactgttgcctaagtcactgttaatgtaaaataaagtcagaatgcttttgacttgatgctgaaatatgttggatttcagcaagtctttaaaaaaatattttcccacttgtattattgatgaaaataagatgatcgtagacacaccattcacccatttagtgacatttcacataattgtttaacatgtttttcctgtatttattgtttccactgttttacttccatgttgtgttttttttttacttgaaatgaagactgtagcttcaaacattcaaaatggaattgagacctaaactattctacctaatggtggaggctcaaagctgattatttgaagtatctgaataatcttctcagttcttatcataataagactgtccaagaatgcagattgacattgatcagttgtgagtctcttccttatgcccaattctcttgcccttgcatcagacaagctaaactttggatacttgtacacaactagtttcagttttggtggttagctttcaggaagttaagaagatagagttcttatgaaagcaagctaggaagtcttactttctacctgtgtggccctgggcaagttacttggcagattttaaggccagtttcctcagtaggcttaatgatattgcctacatcattaagttgatgtgaatatttctggagcgaatccatgtgaaaatggttaatccactgcctcacatttagtaaactattcaataaatgtcagtcattctgatgatatagatgattattgatgatgatgatgatggcagtgaagatgataatttcagagaagattttatctgtgcagttcttgtagtatcattcttaacctctcttgaaaaagcataggttccattgtataattacagattctgggacagaaaattaatggaacaggcttttgtaggggatgtgcagttattttctcaagtccccaaccccctaaagaatatctgatttttaagagatcagagtgataatcaccccaaagttggtcacagtctactagcaaatctcacaatcattgctaaacaattgcaacacctctgtaccactcttttttctgttattagcaaatcacagttctcccattagtgagagcaaacatcaaaatcgccttacatgtctactctaaagcaaagcactttgctgatcttttcaaaagaaaagactgggtgcttctggaatactatcttttgtctactacatgaatacatgtcattaccactagtctttctctaatttttatttttccaggacctcctatcctgcctcccacatttcctacctagcttgctctcttttctgttcatttgagtttccacatgcttcaaagaccttaggctatgagtggtagaggctgtgaagccttacctaatagcaaaagtggggaaatggagtatataattggatatccaaaaccaattattatgatcaattctttgcatgaaataataggcaacactcagatgaaaagtatcctagtatcaaatattccatacatatagattcttgcatgttttaacccttatttatttataccttgagatagctctaagccttctccagtctattaaactatggcaactaatatcacttgtacatttgttttccatcagggaattacatatatctaattataatctcccttttttttcatttttctccaaccttagggaatcatagtttcttttcttttcttttccctctttctattcccaatttcatcacgttccctcagaatagtattacttccacatctgcatatatttttattcattaattcatttaaaacacacaaacacacacacacacacacacacacacacacacacgcatgcacacacacccacagtttcttcatgtatcagaaaactatagtagattttggagatccagaagcaattccaacataaaggtcacttctctcatgaaacttatattcaagcgggtaagtagatcataaggtaaaagcaattgataagccctaacaataaacattacaaggagattaacatcaattatggtgatgtaatggagagtggctagataggcaaggtttttctggggagatcatatttgagcccagacctgaataagaaagcatcagacaaggaaagatatagggaagaaatacaaagtctctctggcagcggcaagttggcaggtttgagttcacacacacacacacacacacacacacacacacacaaaaaaaaaaaaaaaaaactgtgactggagcatgacaggcaagagtaagaatgagacaatactgggatggagaagtagtcataggacagatcatattgggcattggcagtgaacttgcattttgttctaaatataataggaatccattggaaggttgtaagtaggatgtgtgatatggtttgatttgccattttagtttgccactttgactgcttttggaaaatgttttgtagcaagtcatagtgggtatagtgagatgtgtggttggacgttgttacaattcttttggattgttctaagatggtgacattgtaattaaagagaaattgacaaattcaggatatattttggcaacagaggcagtgagactagcagatagtcccattgtttgtaatctaatagaattaccctaattatatttgacaaatctgaccacagtgcctgggacaaatgtgaatcagggattgggaaattaagtactgagtggaaattctaaccataaaaaaagagaaaaaacagtgtagtcaaccttaaaaacatttaaaattgttcataaatccccttcaaaatgtctgcaagactttccatcagacctaccggtgtcttttaaataggcttttctgtaaaaacaaattattcatattttgaaaagaggaattctttttccattcctaaaatacataattagatacaaaataggtaaagaaactagcaacgtgcacatgtgaattaggcaccataatagacgttgtaatataaatatagtgtacattcctcatactcaaggatttcatattccagtggagtggccaacatgtaaacaacaatacaaacatcccaatgcatctcagagggtggatataattgctcatgaaattctgctcaaggatgtctttctagaaaccggtatttatcactgatgactgtaggcacatgaattccaaagaaaaggcccaacatggaccactctatgcgtatatggcatgctgtatatcagaattatccagtagctacaactagtaaaattgtgataaattaataaatgaagtgatgaaagagttgagatgtggcttgctgtgtaggctgcaaaagattctgaaaagcccaggtgctgtggtcaaacgtttttgatgtatttgaacctgtaaagtgccatactgtttttctcagtggctgcatcattttatattgctaccagcaaggcacagggttccaattgctccatgtccttgatgacacttgttattttctattacagtcaagagccacataaggatgtttcagtcaatgacgaaccgcatgtaggatggtggtcccataagattataatgctgtatttttactgtaccttttctatgtttagatacataaatacctaccattgtgttgcaattgcctacagtattcagtacagtaatttgctatgcaggtttgtagcataggagcaataggccataccgtatagcctaagtatgtaataggctgtatcatctaggtttgcataagtacattcaatactgttcacacaatgaaattgtctaaggacatacatttcttttttctttttcttcctttctttctttcttttcttttttttttttgagacagtctcactctgtcacccagactggggtgcagtggtgtgatctcggctcactgcaacctctgcttcgcgggttcaagtgattctcctgcctcagcctcccaagtaactgggattacaggcacacgccaccatgcccagctaattttttgtatttttagtagagatggggttttgccatgttggccaggctggtctcggactcctgacctcaggtgatccacccaccttggcctctgaaagtgctgggattacaggcgtgaaccactgtacccagccattaggacacgtttcttagaacctatccccatcagtaagcaacatgtgccattaagtgacacatgactgtactttgataatagccacccaaatgggcatgaagtatctgttaagtgttttaaattatgtaccagatttgcaaatatggtgtacgtttttgggggccagatgcacaaatgtgaatcaggattgataacacaagtaaaagtgaaaagaaatgactgtcttcataaataattcgctcatctaaaaaatattattgttatgtttgtacaaggcactacgttagcctcaatgtatacattagttagcaaacagaacctgtcaagtccagtgggggattatgggcatttgttaactaactacatgaatatatagtgtggcagatgctcttggtgcccatccacatgcctttggcagtgtaaagcaaaggctgtttacttcgaacgcctgtgaatctctgcctgaggggttttgttcctggtaattacaacatacttggcccacgcaaggggtaagccctccatgctgaggcatttatattcctgggagaagccctcaagcaatgatggatgagaaatggtaaataaatagttcagtttctttgtccctcatttgggatacctctgagatgtgttctatattttctcccagagctccatagcaggattaagctctaattgctcatggtgctaacatacttgtgcaaatagtacatatcatgtagttacctaataagtctgcacatcaaccatatgattgccacataagttagtactccagaaacatctcttacactttaaaggagctcttagaactttttatagggtcgcctaaaatatatagaatatattataccacggactactcttttttcatctattaaagtttcagagggcaaatgcctgaaaatctactttggtggcaatgctgccaaggagaaatggtgacattgctgtgaatgagcttgacccgaatgatgttaactacaatatattgcttcatgtttagtccaaagtcacagagaaggctttttataaaactactaatctgagctgatgactaaaagagaaatatttaaaggtctttcctcctctccattgactcagtataaataggaatgacatgcacatagtgaggggagaatgtggtgccatgaatagagattttgtagcacatttttcattgactttaatgagatgcgtgtggataaatgtgttagtgcggttggcagagtgtcttttttttccaaagcatcaaggtttagcctaatgtctcagtgaatctttgaaatggagctggaattttaaagataacaagtagtgttcagagagcccattgacccagggagcttgcaaggcccctaccagtttcaacagtaatggaaacatttggcaacattgaggaattaaggcaagtagccctggagttgtgggcatttataaacaagtgcaaaggtaattacaggaaagagaatgggagaggtactctagcagtgaataatttttcattgtgttgattttgttgctgagaaaaatctcagaattcctagatttccatgtttagttacaggacatgcctttccataggaaaggctttgctgatgtccttagggcaatgcctttaacatgtccttggaactcttatatactgttggtatgaatgtatagtagtacagccactatggaaaacagttgtggagatgtctcagaaaactaaaaataggattaccatttgatccagctgcttaatatccacccaaaggaaagtaaatcaatatatcaaagggatacctgtactcgcatgtttattgcagcactattcacatggaatccacataagtgttcatgaacaaatgaatggataaagaaaatgtggtatatatacacataagggaatactatattgttcaggtataaaaaagaatgaaataatgtcatttgcagcaacatggatggaactggaagtcattaagtgaaagaagacaggcataaaaagacaaatatctcatggtttcacttacatgtgggagttaaaaaacttgatcacatggaggtagagaatggaaagataggtaagagacactgggaagggtgacttgagggagaggatgaagagaagtgggttaaagggtacaaatatacagtaaaatggaataaatacagtgtttgatagcagagtagggtgaatatacgtcacaaaaatatatactacttgggtgatggacacactaaataccctaacttaatcactatacgtagatacatgtaacaaaattttacatgtacccccatacatttgtgcaaaaaaagtccttaaggcaagactaaaaaataaagacagtgtaagtcagtcagtcaacagtttgattgccttctatgtacagtaaacagtgttagctgttgtcaggcatgtaattataatgcataaactcgatcctcgaggaatttgcaattatctgagaagattaaaaaaagtctgtgagggtaattgatgatatctcaatgccaagtgtgttataaatgagggcatttaggatacacatatagaaaatagacagccccaaatgttccacatattatataattcagtcaatcatcattacaaatcagtggaatgtactgtttattactattttacaaatgaggaaaatgccgggggtggggcatagaaagcttagttaactttcacaaggtcactgaatttaatagtggagcaggaatttaaacccaggtaatctgacttcagagtttgtgtgcccaaaacatgaatctgtattgaaagaagagaattgccagttttatcagaacaggaaaaaaaaatgttcagccttgaatgaagggtgtgctatagatgaatgaaaagagaatggggtggggtcgtgggagtgtgtggatctggggatgtgtttgtggggaggtggcacaaaatgataatgcttcaagcagcagcttgaaggtggaaattaaaatggcacaatatgcgtgtatatgtgggtggaagaatgagtagcaattcaaacctaggcgattttatgtaggaggttagttgatggtaggtgggaatgtagattggtacaggtttttaggcaagcaattttgcaacaccttaaaatttaaaaagtacatggcttcttattcagcctttcccaaactaggaatgcattccacagacgtacttatactgtattgttttaaaagtgaaaaaaatgacatagatgaccttcaaaaggagaactgttggattgtattttagtgtactctgaagtatttaaaaagatggaggctcatctatttttatagacagcgagagatgcttgtaatttattgtacagtggaacaaagtgatttgatgaacaatatgtataatatgattctattttaaaaattaatcaagtcaagaaacacttatggaagcctcactatgggctgggcactggttccagtatatgggatactgtagtggaccaaacatgcaaacagatcatactaaacaaatctctgacttcttggagcttacattcttgaggggagatagacaagaaacaataagcagaataaataagtaaattatataacagaagtatatcagtgcatgaaaaaataaaaagaaaaggagatcaggtaaataggattgggggtgctgattgggggtggggtgggagatagtcttaaatggggcagtcagggtaagactcattgagtaggtgagattttagcaaaggcctgaaaaacatcaagaggaacagcagtgggtcaaacataggccttaaattgggaatatgtctggtgttcaaagaacaccaagaaaaatggtatggctggtgtgggagaagtgaggggaagagtagatgagaggaggttgtagagttattgtggggtctggattatataggttaggactgtccaaaacaaatattatgtgaacctcatatataattttaattttttagtagctactttgaaaaaatggaataccaggtgaaattaattttgatagtatattttaaggtaatatattcaaaatatcatcattttaacatgtaatcaataaaaaagtattaatgtgatattttatacttttcgtactaagacattgaaacctgcggaatatttcccatgtaccacacatctaaatttggactagctacatttcaaattctcaatagcctcaagtggctagtggccatcatattgaacgacaggtatagagttgtgtaggtcacttgttatgatttggcttccacgtggagtgaaatagtcattgtggaagtttgagcagaagagtgacttagtctaatgtacatttaaatggatcactctgattggtgtgttgagaaatgcccaagtttggaaggaagaggggaatcgtgcatagaagcagggaggcctgttaggaggctgttgcgccaatccaggcaaaagatgatggagactcactcagatccaagtgttagcagtcaaaatggggagaactggtcagattgtagatttattttgaaagtagaaacagtgtagtttactgacatattgaatggggaaaaaggttgaaaggtgaaaaaggaatgtcaaggataatatcaaggcttttggcataagtggaaagatggaatttccatcagttgaaattgtggttctgcaggtggcacagatttggaggaaaaacttaagtgtgagattgctattatacccccaagtgaagatttgagttgtcagttggatatatgagtctaaatttgagaaagaagtctagactaaagatacaaatttgagagctatcagcgtaaataaaaattatttaaagctgtgagactggatgaggtcattaagggattgagggtagatggggaagagaagaggtctgatgactgagtcttggaaccctctaacactatggggactaataccagtctggatggatttataccatattgatgattatttttaccattacgtaggagaatttcaagggcctggccaagaaggggaacttttaatatataactgtatttttaataataaatatatataatatacatttatatattatatatataataaatgtatataaaatagaattttataataaatgtataatggttctggaatttaaaaatatgtgagcaatacagagaggacttacagctatagctcagatatataaagaagttgtgaacttatcactgttgtccttacaacaaggaaaagcttgacaactaattatcaatggatattgatgttcttatacacataagagaactgaatttgcagggcgaactttcatcgcaaacctaaagaggcaggtacctgcaggaagtcataaactgaagcatttgcttacctggggctgaagcctccagatgccatgaaaccatatgaggaacattaaactagaaagtctgatgaattgctggggtggttaagtatgggctagcaagagtgtgtacagctccttgagggccacagtcatgggtgtggggtgtggcttatacttacctaggcttttccttcagttagtacactaggctgtcattaggaagattggggataatccagagaaacctacctactgactttctctctgccttggtgattgtagaagtttctaaaggatattttcactggatataagattctgggttggcaggtttttttttttctctcactccacccaattccccgaatgactaagaagagcatagcaccctgacaacctgtgatggacatacagtgtgaacaagaaattaactttttttgtttgtattttagcaaaaacaaacagcaagttgtcagtacaatcatgttgattctggaaagcaagcataaggaaattttatgttttatattacatacagattggggaaaccattggatgtcttgaagaagagtagtatttgatttacccaataaaatcatgttctttgaatattaatccagtagcgatgtataggcaaagattctccactttctgaactaattctgacccttggctctattatgtgtctgaagttatttaataggaacaataataagaacccaaaccaagtgataattaccagaatcctattcatactattaaatagaattagctttgtgtattgtttgaggctattttttttaaaaaaagagaattttaatagtatcttaatgctttatataatttcccacaaaataatataaaaatactcatattgagtaattctacctgtttttacaattaaatgtccatcgctaaataatatttagctaggaatgtagttccttattattggctgttatgccaaaagataaaaaatttcttgttctataatgcctttaaaaatagttgtctattgaaaatatatctattttttttttctgagacagagtctcactgtgtcgcccaggctggagtgcagtggcctgatctcggctcactgcaaactccacctcattggttcacgccattctcctgcctcagcctcccgagtagctgggactacaggtgcccgccaccatgcccagctaatttttttttgtattttcagtagagacggggtttcactgtgttagccaggatggtctcgatctcctgaactcgtgatctgcccacctcggcctcccaaagtgctgggattacaggcgtgagccaccatgcccggcctatatctattttttaccggacttttaattaaataagaatctagagattttacctaattaaggaaaagcatgttggcttcagaaataatttttatgcatgccccataagtctttgaaaagacaatttaatattatgcctaatgttatttttgctttgggagaaaagtaacctatagccccaaaaagtcttatatatgatgggttgtcactcatggcaacttacagcaggaaggattgggtctagattttccttactttgcctcagatttttcattttcgaaaaaatgccccttttcatgtgttgcaactgaggagagttatgagtcaaacgcatcctgttttcaaactcatacatgatattttggttaataaatgcatcaggacctggaggacaattgacatataaaagaaacatagaaagaaggcagccaattgtgtctgtttacagactaaatatgacaaaaaaaggtctgtgagagttttaagttctgcctgttccctagaaatttctactcatttgaagatgaaccttgattgaaatgtaaagtttcaacttctaagaagctgagtaacatacacagcaggaactgccaatatcgttttaatagacatgtcttgtaaaggtgaatttcaatgagttttcagagctttctgaacagtattatcacacgttttaagtaaataggtcaatgttatcatttatgtataattttattgctttagtgctatatttttatgattattttacaaatactttactaagaatatactgaagtctcctgatgattttatgctctttcttattcttgttttactcgagaagttttaactttgaatccctacttagctactttaaaacctgtctcatttttccaacttacaccttgcatcatctctctttccttagagcccagacatcttgcggagccattcacttcttcctaacattttagatactccaatcttttttctatatttgattatttatttgtgaatctcaagaacagaagtagtctatccccaaaacatgcagagagctggaaaaagtatagacatatacaatttaatggaaggaaggaaggcaggaaggaaggatatgaattatatctctaaattggaaacttcaagccttatgtctttataatgatatatcataatttccttttaaaagtcaggaactcagaccaagacacaaactcatgcacatgctaaactgtgaaagcatacatttacctgtggtgacgttagctggcagttttagttggctcagaaaaataatcttacataaggaaagagcctccctccatgagcagccttgaaagtagaaaatttaggaagaatgtgtcaatgatcaaatctactgaaaatcagcaatatcttttgcatacttgtggagtaaggtgtgacaagttattagtggtatggatggctgagcttttctggaaagaagaggacatttttcaaatgtgccttgtattgtgcatggtcctttccatggttatacctacatactggccagttgtaaacattagatcatattaaaatcattcatggatctttcaaaaagacttagactcccacacaatagtagtgggatactttaacagcccactggcaatattagacagatcatcgagacagaaaattaacaaagatattcaggatgtaagctcagctctggaccaaatggatctgatagatagctacagaactctccacccaaaaacaatagaatatacgttcttctcattgccacatggcatttactctaaaattgatcgtataatcagaagtaaaacactcctcagcaaatgcagaaaactgaaaccatataaaacagtctctgggaccacagtgcagtcaaattaaaactaaagactaaggaattcactgaaaaccgtacaattacatggaaactgaataagctgctcctgaatgacttttgggtaaataataaaattaaggcagaaatcaagaagttctttgaaactaatgagaacaaagatacatcgtaccagaatctctggcacacagctaaggcagtgttaagagagaaatttatagcactaaatgcccacatcaaaaagttagaaagatctcaagttaacaacctaacatcacaactaaaagaactagagaaccaagagaaaaatcaagccacagaaatacaaacaaccatcagaaaatattacaaatacctctatgaacataaactagaaaatctagaagaaagggataaattcctggacatagacaccctcccaagactgaaccaggaagaaatagaatccctaaacagaccaataatgagttctgaaattgaggcagtaataaatagcctaccaatcaaaaaaagtccaggaccagatggattcacagctgaattctacccgatgtacaaagaagagctggtaccattcctactgaaactattccaaaaaattgaaaaaaggggactcttccctaactcattctatgagaccagcatcatcttgataccaaaaccctgcagagacacaataaaagaaagaaaacttcaggccaatttacttgataacattgatgcaaaaatcctcaataaaatactggcaaactgaatccagcaacacatcaaaaagcttatccaccacaatcaagtaggcttcatccctgggatgcaagcaagcttggttcaacatacacaaatcagtaaatgtgattcatcacataaacagaactaaagagaaaacacacatgattatctcaatagatgcagaaaaggcttgtgacaaaattcaacatcccttcgtgttaaaaactcacaataaactaggtattgaaggaacatacgtcaaaataataagagccatgtgtggcaaacccacagccaacatcgtactgaatgggcaaaagctggaagcattccccttgaaaactggcacaaggacgcctgctctcaccactcatattcaacatagtattggaagttttggccagggtagtcaggcaagagaaagaaataaagagtattcaaatagggagagaggaagtcaaactaacacttttgaagatgtttaaaaaaagcaatggggaaaggattcccttttcattaaatggtgctgggataactgtctggccatatgcagaagattgaaactggaccccttccttacaccatatacaaaatttaactcaagatggattaaaaacttaaatgtaaaacccaaacatataaaaattctggaagacaacctaggcaatactattcaggacatagcctgggcaaagatttcatgatgacgacaccaaaagcaattgcaactaaagcaaaaattgacaaatgggatccaattaaaataaagagcttctgcacagcaaagtaactatcaacagacaacctacagagtgagagaaaaatttttgcaaactatgcttccaacaaaagtctaatttataaggaacttcaacaaatttacaagaaaaaaacaccaccccattaaaaagtgggcaaaggagatgaacagacacttctcaaaggaaggcagacacatggacaacatgcatgtgaataaaagctcaacatcactgatcattagaaaaatgcaagtcaaaaccacaatgagataccatctcacaccagtcagaatggctactatgaaaaaataacagatactggtgaggttgtggagaagaaagaacacttatacactgttgatgggagtgtaaattagttcagccatcgtggaagagtgtgacaattcctcaaagacctaaagacagaaataccattcaatccagcaatcccattactgggtatatacccaaaggaatataaattgttctatcacaaagacagatgcatgcatatgttcactgcaatactattcacaatagcaaagatatggaatcaacctaaatgcccatcaatgatagactggataaagaaaatgtagtacatatataccattgaatactatacagccataaaaaagaatgagatcatgtcctttgtagggacatggatggaactggaggccattatccttagcaaactaacacaggaacagaaaaccaaataccacatattttcttttagttgggagctaaatgttgagaacccataagacacatagaggtgaacagcacacactgaggcctaccagagggtagagggtgggaggaggaagaggatcaggaaaaataactaatggatactaggcttaatacctgagtgatgaaataatctgtacaacaaacccccatgacacacatttacctatgttacaaagctacacatgtactcctgaacttaaaataaaagaataaaaaaaatcgttcatgagtctttacaaaatcttaatacctgagtctcaggattgagattcgaagtggggagggggactggaggactttttttgagttgataaagaagaaactggtactttgaaagaaggtatacgtttcttccttcctcctttttggtaatattctggaatcactgatccttaagactcccaggattttcaagttgtattctgttgcatttagatgcaaaataatctaatgtagtattttccacaatgagcttcctgaaaggctgatcttctctgaaaatgttagtaacctcatatgataaataagtaaatactaatgagtttcttccaaaatatgtttagaactctaagaaaatcactaaagaaatgtaaatagttcttactattatgcaatactttttcattagaaatacagtaccaaatcaagaatgccaaggagaatgagaaatcattcattactttaatctgttcaattaatatttttgagcatctactatatgcctggtatagttgtaggtgcttgggatacatcagtaaaatgcattaatacatgactttaattctgcagcatttagaaaaaaactctctgatgtttgatgggtttttaaaatatcgtataatgttctttattcatttttcattcaaatttataaatgaattaaaaaataaactaaaccagactaatttgctttattcatatgtaaagttaaaaataattagatattgatcatttcttacaagatttatttcattgattccttttattcttttgctgtcaaatacaagagtgaatttctatgaactgtggagattttcaatgcatttgaattaaaagactatgatgaacagaaaatgacacatccatacatgaaacttctctgtaagtgaaagctttattatatatttctttggggaaaccttttgccatgaagaaatgaagcaggttctgaaataaatttgaaacaaaatttttatgcaacttaagcaaattttacattggtaaatcacgtgatttattagaattttacaaatattacaaatgtaacatcttacactttatcaagctaaacaagaaatagaatcttttctggttgactggctgacatgaaatagtttttgattcaagcaaacttctgcaagtagctctttgtaaacagaaaaataagatagatggatatatatagataaatacataaaactaacttatttgactcttatttggtcccaccagttgggcttttagggatgttttctgcattcaggaagtttcttgaaataaagatgagtatttgttgttatgtttgtctgcagagaacagtctgcaaatagtcatatgtgtttcataaggatcgcctcaactttcttttttgtttctgttttgtttttgcatataggtagggttagacataattgtaaatactccttcttaaaaaggatatatatgcatcggaatttaggaaatggtcatataatggctttgaatcagattaacctggatttaatacaggtccctaggtattgtggaccctcatacccaattctctttgactttgttttgtcatttgtcacataaagatattaatatttaatatacaaggttgttataaatcaataagataataaaagtgtaaagagcactgcactgaacctgccttatggtaaggattcattggaaagtaattatttgttattactgttattattattaagcatctattatgtgttagggttgggaataataaatggaatattatattgggcataggtttcaagtgtagtgtctagttggagaactaaagagtatatgtttgaggtaataactaaaaataaaaacagtagtatggatgagaatagacagtttttttttaaatgtaagctttggaggtttttgtgacataaatattataaatggtcctgaagaaatctgaacctaaatttcttcatgtatacagcccatttatactgttcattaggtagaaaccagctcgtagatgaccttcaataaagtttgtattgattgctaggtttttgaggaaacaaaaacaagagacaattcaattttcccagcttatttctttttgaacagtagaaaggtgttacatcttgttgctgccaagtggagcagattaaaggtcaggacagcatgcaagatctgtttctctaataggaacattccagcacacaggaatgggggatggagtaatttttagtctatgtttctcatgaaagtcaagaatagcataacattagaggtacttttttggtctcatgtttattcagtagctttgaccgtagagttttttcctatttagtgactatattctacttggaaaatatgatgtaaaagaaattcgtagagaaaaatgcaaataccgttgcatatccccaagtaatttatgctttttcttacccccaaattcttgaaatatattcatttgtaataaaaaaagtccctgcacctggagttatcttttattttcctttctttttttaattactctgacatataattgtaagatacatatttatgaagagttgagacaggccagaatcaaattttcttgtccagcctacccagctgctgatggccatctctgagataaccaacttgctcacacatgctcctaatgatttctgttatatagttgagagggagtgtccgtctgtcagcactaaatgctatttgtgaaattaatggcacaaggaaacaatgtagctctgatactagttgcagctatacatgttagctgattttgaaaaaaggttggaatttagtaatatctttcagtcacatggtatttttccctctactcttcccctggttcatggcattctaagcatatcaaattacctactacttgttattgcaaatgatacttttaaatttctgatttgagatattacttgacccatataaaaatacaaaatgactgatttttttttattattatactttaagttctagggtacatatgcacaacgtgcaggtttgttacatatgtatccatgggccatgtgggtatgctgcacccattaacttgtcatttacattaggtatatctcctaatgctttccctcccctctcaccccaccccaccacaggccctggtgtgtgatgttccccttcctgtgtccaggttttctcattgttcaattcccacctatgagtgagaacatgtggtgtttggttttttgtccttgagatagtttgctgagaatgatggtttccagcttcatccatgtccctgcaaaggacatgaactcatttatggctgcattatattccatggtgtatatgtgccacattttcttaatccagtctatcattgatggacatttgggttggttccaagtctttgctattgtgaatagtgtcacaataaacatacgtgtgcatgtgcttttatagcagcatgatttataatcctttgggtatatacccagtaatgggatggctgggtcaaatggtatttctagttctagatccttgaggaatcaccacactgcttccacaatggttgaactagtttacagtcccaccaacagtgttaaagtgttcccatttctccacatcctctccagcacctgttgtttcctgactttttaatgatcgccattctaactggtgtgagataatatctcattgtggttttgatttgcatttctctgatggccagtgacgatgagtattttttcatgtgtctgttggctgcataaatgtcttcttttgagaagtgtctgttcatatccttcgcccactttttgatggggttgtttgtttttttcttgtaaatttgtttgagttctttgtggattctggatattagccctttgtcagatgagtagattgcaaaaattttctcccattctataggttgcctgtgcactctgatggtagtttcttttgctgtgcagaagctctttagtttaattagatcccatttgtcaattttggcttttgttgccattgcttttggtgttttagacatgaagtccttgcccgtgcctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggaattatttctgagggctctgttctgttccactggtctgtatctctgttttggtaccagtaccatgctgttttggttactgtagccttgtagtatagtttgaagtcaggtagcatgatgcctccagctttgttcttttggcttaggattgacttggcaatgcaggctcttttttggttccatatgaactttaaagtagctttttctaattctgcgaagaaagtcattggtagcttgatggggatggcattgaatctgtaaattaccttgggcagtatggccattttcatgatattaattcttcctatccatgagcatggaatgttcttccatttgtttgtatcctcttttatttcattgagcagtggtttgtagttctccttgaagaggtccttcacatcccttgtaagttgaattcctaggtattttattctctttgaagcaattgtgaatgggagttcactcatgatttggctctttgtctgttattggtgtataagaatgcttgtgatttttgcacattgattttgtatcttgagactttgctgaagttgcttatcagcttaaggagattttgggctgagacgatggggttttctaaatatacaatcatgtcatctgcaaacagggacaatttgacttcctcttttcctaattgaataccctttatttctttctcctgcccgattgccctggccagaacttccaacactatgttgaataggagtggtgagagagggcatccctgtcttatgccagttttcgaagggaatgcttccagtttttggccattcagtatgatattggctgtgggtttgccataaatagctcttaattattttgagatacgtcccatcaatacctaatttattgagtgtttttagcatgaagggctgttgaattttgtcaaaggccttttctgcatctattgagaaaatcatgtcgtttttgtctttggttctgtttatgtgctggattacgtttattgatttgcgtatgttgaaccagccttgcaccccagggatgaagtccacttgatcatggtggataagctttttgatgtgctgctggattcggtttgccagtatcttattgaggatttttacatcgatgttcatcagggatattggtctaaaattctctttttttgttgtgtctctacccggctttggtatcaggatgatgctggcctcataaaatgagttagggaggattccctctttttctattcattggaatagtttcagaaggtatggttccatctcctccttgtacctctggtagaattgggctgtgaatccatctggtcctggactttttttgattggtaggctattaattattgcctcaatttcagatactgttattggtctattcagggattcaacttcttcctggtttagtcttgggagggtgtgtgtgtccaggaatttatccatttcttctagattttctagcttatttgcatagaggtgtttatagtattctctggtggtagtttgtatttctgtgggatcagtggtgatatcccctttatcattttttattgcaactatttgattcttctctcttttcttctttgttagtcttgctagcagtctatcaattttgttgctcttttcaaaaaagcagcttctggattcattgattttttgaagggttttttgtgtctctatctccttcagttctgctctgatcttagttatttcttgccttctgctagctcttgaatgtgtttgcttttgcttctctagttcttttaattgtgatattagggtgtcaattttagatctttcctgctttctcttgtgggcatttagtggcataaatttccctctacacaccgctttaaatgtgtcccagagattctggtatgttgtgtctttgttctcattggtttcaaagaacatctttatttctgccttcatttcgttatgtacccagtagtcattcagaagcaggttgttcagtttccatgtagttgggcgattttgagtgagtttcttaatcctgagttctagtttgattgcactgtggtctgagagacagtttgttataatttctgttcttttacatttgctgaggagagctttacttccaactatgtggtcagttttggaataagtgtgatgtggtgctgagaagaatgtatattctgttgatatggggtggagagttctgtagatgtctattaggtctgcttgttgcagagctgagttcaattcctgggtatccttattaactttctgtctcattgatccgtctaatgttgacagtgcagcgttaaagtcacccattattattgagtgggagtctaagtctctttgtagatctctaaggacttgctttatgaatctgggtgctcctgtattgggtgcatatatatttaagatagttagatcttcttgttgaattgatccctttaccattatgtaatggccttctttgtctcttttgatctttgttggtttaaagtctgttttatcagagactaggattgcaacccctgccttttttttgttttccattttcttggtagatcttcctccatccctttattttgagcctatatgtgtctctgcacgtgagatgggtctcctgaatacagcacactgatgggtcttgactctttatccaatttgccagtctgtgtcttttaactggagcatttagcccatttacatttaaggttaatattgttatgtgtgaatttggtcctgtcattatgatgttatctggttattttgcttgttagtgggtgcggtttcttcctagcctcgatggtctttaaaatttggcatgtttttgcagtggctggtactggttgtttctttccatgtttagtgcttccttgaggagctccagacctgccctacaagaatgactgattgttagagacttttttgtgtttctatggaaaaattaaaacatatgtgagagagtaaactgctgattattctatacaaagccttctagcatatctttctgactttctgtaaatggaacatgacttgacgtctacctccaactcaatttgttttttttttttttttttctgagacggagtctcactctgtcccccaggctggagtgcagtgatgcaatctcggctcactgcaagctctgcctcccgggttcacgccattgtcctgcctcagcctcctgagcatctgggactataggcgcccgcaccacgcccggctaattttttgtatttttagtagagacgaggtttcaccgtgttagcaaggatggtctcagtctccagatctcatgatccacctgtctcggcctcccaaagtgctgggattacaggcatgagccaccatgcctggcccttggtgtgttttttaaaacacaatcaaacacataaacattcacaaagaactacttcagaaaaacaagaattcactggactagagaggacctttaaaaaatctgaaagcttctttgacaagaaaggataattgctgtatatctttcttattgagtataattttcgtttacatattttattttgtgtgtttttaaaaattattattaccgggtaattatgatagatataactcagaatacgcataggtcaaggcatgggatagggattgtatggagcttccatactccccactgtgtgccaccctcttagcacatctgtgttttcaccaacccagaagttcttcatacaattttaaaacgtaattaataaaagatcttgcaagtctctgaattttcttaccttcttactcataggatcaggcaaatttcaatctctttgtgaaaatgctaacatgttgagaatgagcaaggcagagcagtggggtggataattctaataataaatcatgaacaaaagtaaatggtgatggctgtgatggtgtgaaataacctgatggtggcataggcctcttgaaggaatactctgggaatctcccttgtaacacttttaagagcaaatttaaaaaatcgagactatttatgcatttttgttgtatttagaaaagcatcatgtacttaaatggaagaaaaaaagtgagggatacttccagtgttggatggttaagtttttctgaagtctatgtttattttcaaagttatttatgacaatgaaataatatttaatgctacagctatcacagtgcactcatttatttttttctaaattgtgaagaatacatggttaataataggtttcagataggtatctggattcatgtgaatgaacttaaaaagacagttttgatgatcattctgttgaggatagaactgtggtatatgtgatcatgggttttatttttctcatgtgtaaaatgaggtatataatctgagtctcaggtgactccaaatttttaccattcttcacatattgatattatgttcaagaaatcaatagggataagggggaattaaggataataatttggttctacttaataacacacactacttgattattaacaacattgcacgcaagtgttaatacagctcatttgctttggatggaagctgtaatgtctaagattcaagcataccttcctttggtgatggccttcattcattcaaccaatatttttgtagtgactgttgtgtggggattgtggtagaattaaaactttaaggaaaaacctattataaaactccctcacaaaaaatacgataaattgaaatttaaacattatttaagaaattttattacttggcagataataaatgatacttactgagtgctaccacacccaggcactattcaattcactctacagttattaattgacttatatcatcctcatagtgttcctatgaagtaaatgtcattatttcccccactttacagatgaggaaactgaggtatagagagaataggcagtttgatcaagcttttaagattggtgaatggaagagtgtgatttgaccccagagctctagtgcctgcatgcttaaacactatattgcacagcttcttcatttagatacattgcagaaacagaggaatctaattgtagatgcatctggctcaactcctttgtgaacatagtagtaatgtaatcagaagacttatatcctcagttttattcttttatggattttatatgggaccaatgataaactttcttcatttaccccagtctcttaataaaaataattttccaattctgtgaagaaaggcattggtagcttgatggggatggcattgaatctgtaaattaccttgggcagtatggccattttcacgatattgattcttcctacccaggagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtcttttgttggtgtataagaatgcttgtgatttttgtacattgattttgtatcctgagactttgctgaagttgcttatcagcttaaggagattttgggctgagacaatggggttttctagatatacaatcatgtcgtctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctcttattattttgaaatacatcccatcaatacctaatttattgagagtttttagcatgaagggctgttgaattttgtcaaaggccttttctgcatctattgagataatcatcattctcagtaaactatcgcaagaacaaaaaaccaaacgccgcatattctcactcataggtgggaattgaacaatgagatcacatggacacaggaaggggaacatcacactctggggactgttgtggggtgggggaaggggggagggatagcattgggagatatacctaatgctagatgacgagttagtgggtgcagcgcaccagcgtggcacatgtatacatatgtaactaacctgcacaatgtgcacatgtaccctaaaacttaaagtataataataaaataaaataaaataaaaaataaaaataattttcattagagtgtatatgagattatgatgatggatttcttattatatcagaattatattttcataaattcagataacactgtacagttattgttgaatactatactatgtataaatgtccacaaatcaaattttaactattcaagggtgctttcctttcaaaattagcagaaagattacgttttcaacagttaattaaaccattttgaaattacaagagataatgtagaattgtatccaaagtcttatacatttgttctggcaatacctttattcagcaagagagaagaatttattctctgcagataaccgctactcacccacaaacagtccaacatacagcccagagatgtaggcttctcattttggaaatacaaactgtttacaatgagagtatctctaaaaaaattgtttcttaggaggaaagatcgttctatcttccaggaaagggaaactccaagaagtttctttattctaaaaaattaagaaagaccctcaaacctcaaagcacataaaggagacttagcaaacaatattctgtaatatttgcagaaaaacataaacacagcatctttactaatgtttattttccaaaaatatggtaataatagacatttattgggaacttccggcattgcaatgcagaacacttttttataatgaatataaactcattatatagatgaagaagctgagttgcaaagaagtcaagtaggaaactcatttaaaccctctggagtcatgtccttccacagtgttttatatttactttcttgtagatattatggctattctaaatatttggatatttgctgctctaaaagtctttttccttaaagaaaatttttcaagttgtatttctttttcactttaaaagttattttaaacttaaagggaactttacagcccattctagctatgttactctgtattatcatttgcttatatcaaacattttgcatgctactatgactataaatatatcattttaaactttaatttgtgcaaatttaaaatgattgacttttattttgcagttagcaaataagctcccagactgaccaaaatgcttttaagggtcacatttatgttaaaaaattatatgtataaaattcccattgggaaaagtttgattccagtattcttatgtaatagccaagggagtgccagttaagtacaaatttaatagcttttctaggtaggactccagaattagtgcatgaagggaacatagttaatctgtttgaagagttcattaaattaggttatatatgctattatgaaatatagaggagcataaaagtatccagaggaaagcatagaaacaatgcaaattacttagaaccaaaaagattgatttatgatgaattattaaagataaatggatcttaatagtaaatgctctataaacagagtatatgtctaatgccaagatgctaagttcaaagaagctttacctaataattaatgaggactggaaatactctagcattctagatatagttgcccaattaaatatgttatagaaaattatctgaaaatgggaagctaactgagctcatccaaaatttagatgatgacttatttcttccagttagaagatagggatgaggccgggtgtggtggctcatgcctgtaatcccagcactttgggaggccgaggcaggcggatcatgaggtcaggagattgagaccatcctggccaacatggtgaaaccccatttctactaaaaatacaaaaattagctgggtgtggtggtgcacgcctgtagtcccagctactctggaggctgaggcaggagaatggcgtgaacccaggaggcggagcttgcagtgagccaagatccatctcaaaacaaaaaacaaaacaaaaaaaattatgacttgaatttcaattatgacttgaaattatcttatgatagtttctaataggtggttttcctcatttgtttcaattataattaaaaatagttttataattattatgacacttgtaaagatagtaaaactctgtttcagaaagcttatccatttgctgaagtttgtattgctctctcatctattccttgaagaactttaatattgaaggaaaacaatgacaacttttatgataggaaattcccctgcttaactaaaccagcacatattggtctcaaaaattgagatgacctgaatctttgaatatagtttttttacacgttgagcattgtatatagttagaaagggctatagaaactgtttcatgtttaaataattatttctttccttttataaataatataaagagtatatatcagttatgtattcagaggaacacttccgaaaaacgactaaatagatacttggccatattttctacaaaattatctaacatagaatgaacatatttattcaataaatgtatgctgaaaaaagctacatcataagtaaaatgaacaataaaaaaactaataatattttccagttttcttgataatgatttacacttgttgaactgtgatgtgtgatatacttgttgaacatgctaaggaatattaagccatgccctaattttcattattttacattcatgcattaacttgagcaagaccctaagatttatttataggtgccagttcagaaagtttttcttgctgtgaaatcctagacctgatgttttaacatatatatggactttgaaaccatgttcatttaatgcctatgaccaatagttttaatgaatgcctaacaacttacttaaaccaaacaaataattagtgtcaattacagaagtgtaaatttgactctaattaatgaatgtgccagactctacgcattggtttaagtgtaattgatcttagggccactgagatcactttaagggttggaaaaatgacaacaagtaggaagtgactcagatgtaagaatgctcactcctagaaagattaattggtgtattagtgataaactagtgggtggctgatgtaataatgatatccctatattaagatgcctcaaaataggatcaccaactctaaagcttgtaagtttatacaattactatgtcaaatatactcttttaaaagaatatctgtcacgttcatttgtccttttttcattttgattttttttctttttcatcattataaaaaaaacatcctaagggaagcatactgatgttttactttatgctttgaaatgttctcactgaactgtgttggtaggcctgggtgtggtaaattaagtggcttgtattaaaaagacaatgattgctagctagtatttttccattttctttgctgtcagcaaagtctgcttttgttgccatgataacttctccccactttgatggtgaaatctggaaggacaaaaaagaagggcatttctattgtgctattacatttcttctcttttgaagaacttctaatactttgaatgatgggttaaaaagccgagatgatgtgatgaagctgaatggtgggcaaaagctaaattatggcatattcatttttttatcagtgcgtgaaaggtcactggctgagggagagacaggcaaagtcctagatcaagagagtgagaggtggctgctaagtggggagttgagaagatcagaatactacggagtctttgtcctttttctgactattccctgcctatgttttttccctcccttctttctcccctacctcctaaccccagacaactgtcctaatgaaaagatttttaagaaagatgtcaaagaaaatagagtttttaaagaaagatgtcaaaggaaattgttgaatgaggcacaggggcagcatgagaccagagtggaggaaagtgataaaggcactttttagaagttaagcccagaaaactggggcaagaatcaaagcgacgctacaggcagggatgaggtaaccagggtcctgaagataatcataaggagctggagtctgaggcaggaaaaaaggcaagtctggttaagaggtttaaggcagaggatgacctacttagaaaaagatcttttcaacagccagacttcggactagaggggaagtaggtcaagaggcctgagagtaggttacattcgtctgagaggaagttgttttgactaaacaagaagttgtaattataccaaattatgagatcgttaaattaagtagtcatgtgcaataacatttcctccttaaatatttttaaacatttttttagcagagttgttcatcatacatcaaattttaatttgcattatgttgtgtagtacaacttcatttagactacttcagtggaagaacaatcgaaatttacgaacattctgaaagagttggaattttgcttcttgtccgtatataaataggatcaagttaacctttcatactgtgtgaactcctttgtcttatttcttcgagggctttttaaaagataagaataatgaacgtgaaagggattttataaaaacatgattaattcaggtaattgaaatagtttgatatcctaagtagtttaagcattctttctgctacctcatttggattaatagtttgtttcatcccagcactttgggaggccgaggcgggtggatcacgaggtcaagagatcaagaccatcctggccaacatggtaaaacccatctctactaaaaatacaaaaattagctgggcatggtggcacatgcctgtagtcccagctacttaggagactgaggcaggagaattgcttgaacccgggaggcagaggttgcagtgagccgagtttgcgccactgcactccagcctggcaacaaagtgagactctgtcttaaataataataataattaataatttgtttcaaaatacagcaggatggtatagtgttaaacacataaattctagaggcagattacctggattaattcctagctctatgattttctacccgtgtgaggatattggatcttaatgtttatatgtcagttctctcacctgtaaaatgggctaatagtagtgactatttcatagagtggttgtaacaatttattatacaggtgtgtgtgtgtgtgtatataatatatacaggtgcacacacagttatatatatatatacatacttaggacagtaacagaaacagagaaaatgcttatcaaatatttatgattattatgagcaatgttaacagtaattatatgtatcctaaaatacttctaaaatagtaatgatactattaatccaatcctaattttaatactaatcttaacaatatttttgtataccatcccccagctcctcctgccatttcttttctcccctttatagtaaaactcagaagagttgcctgtgcttgctctcttctcatttctcttagacctcttccagtctgggttttggagccaccactccaactaaactattcctaccaaggtcccgaatgtcctccacattgctgaattagacccaattctcaatccttaaggcagatagttgacctatcagcaacaatttatcacctacttctttgatgatgtactgtcttcacttgtctttcagaattgactcttggtataccttcagatttagttggtctttctcagccttctttctgattttgtcgactctcgtagacttctcgatgatggaagaagccagtctcattccttggtcctcttctcaattcacttccttagtcatttcacctagtactgtggttttaaatatcatttgattgttgacaattttgactaatttattttctgtttccagctcctctcccaaattccagattcgtacatctaactccttactcaagattttcactgaaagcacttatagacacttaaaatttaatatgtccaaaggctatagagccaatatcctcctcagaactggttccacaaacacccattcccatatcagttgctatagttccctgtgtctggttattcagaacaaatttctttgagtcatccttcactcctctcattttgttatactccacatcaaacagttctcactttctgttggcttgaccttcacaagagatccagatggtgaccatttcttaccacctctgctgctacaaccctactttaagtcactatcatttctctcctgaatttatgtgatgacatctggtctgcctgcttctgctcttcccctcttcaaatctattctcaacacagaagtcaaatgtcagtaaaatcctgtcagtcctcaccttgaaaccctgcagtgaaaccacaattcattcattacaaatgaaaagtgtttacaatggcttccatggatttatatagtggcccccattatttcttcttatgtcatctactcctattttccctgtaatttgtgttactctagccacagtgacacctcactgtttctgaaacatgctagacatgtgcctaccttaaggatttgcatttgctgttccctctgcctaaaaccattttcccatatataatcccacaattcctttacttcttttaggtctttaccaaagtgtcatttttttttttttttaatgtggctcttcctctagttttaaaactataactctctaactcctgactgtcacctctggcatttcccatttctcctaccctcctctagagcttagtatatgttccaacatcatgtaccatttacttatttgttatgcctgttatttatcagtcttctactagaaagtaagctccatatgggcagggaacatttttcatttactggttggatcagtacctattattttgtaggcactcaataaatacatgtcaaatgaatgagtgaatgagtattctgttgttttttcctctcccctacaaatattatgttgaaaagggttttcctcaaatgcagatcttatgcaagatacctgcatgatataggcagtgaacatcatctgctactttcgtttgctaatacaacaggcaagctcaacgtgaaaattacttactgtggcatccagtgttgctctccacatctggaatgtgtttccttaatcttatgaaacattactttcctatcaagttctgtaccacctatgaagtttttcttctctggacattcttgccaactgtgatttccaattctttagaattggtatagcacttatttttcttactatacaatttagccaatacattttatattaagtttcattgttttgtctcttcaactagcttgccaagtcttgaagggcagaaatcacatactatgccttctggtaaagcaatgtacatgttcacactccaatctatagagtattttttttttaaatcttcaaaataggttttgtctcttcaactagcttgccaagtcttgaagggcagaaagcacatattatgctttctggtaatgcaatgtacgtgttcacgctccaatctatagaatatttttcagaaaaaaatttaaaaataattttccaggaagattcctcagaatcttagtggtaacccaggagcagtggttcatgcctgtaatcccagagctttgggaggccgaggtggaaggattgcttgaggcccggagttcaagcccagcctgggtgacatagcaagaccccatgtcttaaaaaaaaattagctgggtgtagtgacacacaaccgtagtcctagctgcttgggagcctgaggcaggaagattgcttgagcccaaggattcgaggctgttgagctatgatcatgccactgcattccagactggacagcagggcaataccctgtctccaaaagtataaaattaaaaaaaaaattagaatcttagggataaattgcttaaaaacaagataaagtttcaaacaaatacctaatatacaactgtcttcaaaagacattttttagtattaatgatttaaagtattttccctttcatatttccttccttatgggtaaggaatgtggaatgtcaagccatttttcatgggttttataaatactacctattgattattcatgaaataatatgtccttttatgctttgttgttaaattcaagatattatatagcaataaaacatttaagtatttgctgaatcaaatgaccaaactggaaagaagtgatggtcaattagaatgtatacaatccttgttcattaaaatgatggctcacaggctgggcgtggtggctcacacctgtaatctcagcactttgggaggccgaggtgggcagatcacaaggtcaggagttcgagaccagcctggccaacatagtgaaaccccgtctctactaaaaaatacaaaaaataagccaggcgtggtggcgggcacctgtaatcccagctacttgggaggctgaggcaggagaattgcttgaacccaggaggcagaggttgcagtgagccgaggttgtgccattgtattccagaccgggcaatagtgtgagactgtctcaaaaaaaaaaaaaaatgatggctcatagatgatattcatgaaaaggttctctcttgccttacaaaactcttctacttatctgttaatgtatacagttaattttctacaattgcataaatacatgcacattaaacattaaaatgacttagtttatgttccaaacttacaaagccaaataaagtcagtggtaatgacagacctttaactctccccattgttcttaatggcaaccattgctactaagacagcctgtgcaattattcagtatctcaggagtacaaaccatatgctggataaaaaagtaggcaaaataagcttgatgtattaacactaggagactgcaggttgtattttgtttcatagatttgagagaatatttttattttgtttttcactattttttttccttcaggagtgtgttgcatgtttattgtcttgtgttatatatgcaacagtagattttcttaactctgtttttataaaatgtcatggattctttcattccattaacttctttgaatgttatgaaaaatgagtgttatgaatagcttaggagacttgagtgtttggagaaactgaggagacttggaggggctgctcagccctgaatatttccttttcttttcttttcttttcttttcttttcttttcttttcgttttgtttcttttcttttctcttcttttccttccttccttccttccttccttccttccttccttccttccttccttccttccttccttcctttctttcctttctctttctttctttctctttctttctttctttctttctttctttctttctttctttctttctttctttctttctttctttttttgagatagagtctcactctgttgcacaggctggaggacagtggtgcgatctcggctcactgcaacctctgcctcccagacttaagtgattctcctgcctcagcttcctgagtagctgggattacaggtgcctgccaccatgcccagctaattttttgtatttttagtagagatggggtttcatcatgttggccaggctggtcttgaactcctaagttcaagtgatccacctgcctcagcctcccaaagtattgggattacaggcatgagccactgtgctcagccagccctgaatacttctgaagtcctttcatttctctaaatattaagagagcaaacaatagaaaagtaataatcaacaaacttgatttcttacaagaaggcttatatgccaatgttttaaagttttaacattttaatatagagattttacatggtttatgttatttcctttttagtatatctttttaacttcttaaagacacaacaaatatggaatattaaacttggataaacaactctttcattataaaacaattcatccaacaaaactgtatcaaatgcctcctcagtgctaagcgttctgctagtcattggtgatacaagttgaatgaggcaaccaatgaccgaggcttcttactgttcacattcaagtggaagtgtgagaaaataaaaaatatgtaatgtagaaaagaaggaaggaaggaaggaaagagtcagggagggagggaaggaaaaaaaaaggggaaaaaagaagggaaataattatccattcagataattgctaaagcagaagtacacaggtacagtgaatagcaatttgcagccagaaaatcactattatatacatttctttgcatgtttccaaataaataactcttccaaatatctaatctctttttttaaaaaaaaaaaatcttagaacattattgaaaactagtttatgggaactagaattgtcctacaggacagaaaaatttggcccaagcagcccagttttagaaatctacttcatgttaacattattttacttagctgacaaatatttactaaatgcttattatgggccatgcactgattttggtgatatagcagagaacaaaaataagtccctgacctcatgtatcttataagaagtaggtgatgattgtaatagatcagtggatgataagcactctggacaaaaattaaaactgggggagagttatgtggtgtctgggtggaagatgttggagttctctagggtggcaaaagaagacctcactgagaagcagtcatttcaactaaatgctggaaaaggtgagggggtgagttatgtgtgtattagatctagagaaatgcaggtgcaaaggccataaggcaggcaccatactggttcaaggaaaaccaagaaggcttgtgcggctgcagtagggtaagaaagagggaggttagtgcaagatggagttagaaagataatgttgttaggagtgctttttaagggttttggagccaagaattaaacaaaaatctgcttgatggcaggaggcagcagatgacatctgtttgctactgtccttccatgtgggttgtatcattcctaggtaattgttctcatttctgaccaggagtgttagtcttttctaattagcatcctaattattttctccaactcatcttctacttggctgtctaagtgatctttccataatgcatgtcccatcttgtagtctcaatttaataccctttggtgacactccattagctttgcaaaaagacaaaggtcttaaatggtgttcaaggcccttcataatttgatgtctccaagatacctacacagcattcctcctctgggtcttgacacttgtagttccctctacctggaatgttcttttcccatttcttcccatgacagctttcttttaatcttttaaattcctatttgaatgccaccttcactgaaagacattcctttcctgaccactctttctaaagcaggtgacacggagtctatattttccatcattatcatgctgtaattttcctccttaccacaattagaaattatatattttgctttactcttttgatgtctgtctgtctcagtagtatgacgcttcatgaaggcagtgatctcgctgtctttacacttctgtaccaacaataaaagctaacacatatttaatgcttgttatttcccaggcactattcccagcacgttgcatccactaactcatttaatacttaaccatacgaggaagataccatttattaatctagactaggctatcaaggcacagagagactaagtgcctggactccaattccatggctaatagagtagaagagacaggattttaattcacacaatctgcctccatgaaatcaatgtacactctgtgcattagacaaatttgattatttattttaggtaccttatactttctataagctgaggctttcagtagtgcttcctctgccaggaatgcttatatcttcttttccctggccatatgctatctctctttctagttttcatccactcttcatctcctttccaaggcttttatgatatccccctccttccctgcccagactaaatagaagcttctctttgcctaacctctttgcttccatatgatagtttagcaattattatgctatattttaattattaattttcttatatcccctagacactgaactcccaagatggggacagtgtcttttttttttaattcccagtgctcattatagtttatggcataaaaagttggtgctcaataatgtttggttaaatgaatgtgtgacacagaacatttcaacagcatactcattaatatcgtagaaatcttacctggttcaaaaaatactaagacatctgtccaagtagaaatcataaatccaataaacccaggataatagttttgaaggaagagagatgtaggtttagaaattgtcaacagccttatgtcactgaagagaagaataagaaagctgctgtctcaaccactgaatttaaactaagctgctttagacaaagaaactaattttaagtgagaatgaggaaggacaatgagcagaagttagaattagcagaaggattggagatagggtttgactttgtgtatatctgaatctttcactaataggcaaaatttataaatcattaatatctctgatatgagccatattttgttccttgaagcaattttctttttttaaccctataatgtcataaatttattttttttccttccaacttttcttttaggttcaggtggtacatgtgcaggtttgttgtgtgggtaaattgtgtgttgctggattttggtgtaaaaatgatttgtcacccaggtagtgagcttattaccctataggtagtttttcaatcctcaccctccaccctcaactaggccccagtgtctattgtccctctctttgtgtccatgtgtactcaatgtttagctcccagttataagaacatgtataatatttggtttactgttgctgtgttaatttgcttaggataatggcctccagctgcatccatgttgctacaaggatttgatttcaatctttttatggctgtgtggcgtttcatggtgtatatgtaccacattttctttatctagtccaccattgatggacatctagattgattccacgtctttgctattgtaaatggtattgcagttaacatatgagtgcgtgtgtgtttgcacacacattggtctgtcgtccacaatgatggactacataccgtcgtttgattgaacaatgttttttttcttttggatacacatacagtaatgagattgctgggctgaatgatagctctgagtttttttgagaaatcaccaaactgctttccacagtggctgaacttatttacattcctatcagtagtgtttaagcattcccttttctccacatcctcaacaatatctgttatttttttactttttggtaatagtcattctgatgggtgtgagatgttatttcattgtggtttggattttgcatttctctaatggttagtgatgttgagcattttttcatatgcttgttggccatatgtatgtctttttttgagaagtgtctgttcatatcctttgcccatttttcactgaggttgtttgatttttgcttgttgatttgtttaaattccttatagattctagatattagacctttgtcagatggatagtttgcaaatattttctgccattctgtagggtgtctgtttactctgtttatagaccttcaagtaattttccaaacatgcttcacaaaccttgaagtacgtgcaaatattttagatggacaaacagactatattaaaacattttccaagagattccttatctcattttgttgaatgtgagaaagcaagacgaagaggatttgtaacttgtgatacaaaatagggcacaatcaaatctaatctcacctgagatcttcacctcacctttgtcagcaaatagattctttcttttgcaccctgcactataagtattctgcatctattagttttcttatcagcatgaataaataattttacaacatagttcttgaattaacaaactattttgctccaaatacctatttcataatttctctttagttaaagtttgattctgttctttgtgacattcatagttctgaatttatatttttacttcttaagcaggggatttatattttttgtttcaaactagtggtattctttatctgatcaatttcagactgaaattagattggcgtaagtgaacaattaatttggatgttagtaatgggaaatttgagttctctgcgcagactggcagaacgtctcgttgggacatgatctgagagtaaaattttgcagtatggaaaatgactatgccttctgactatacttgtcagaagaaggtagcctacaactagccgaaaatggtcaaactaagatttatggaccaaacaaattaaaataccagtaaagggcactgaaatccattaagtgacttatccaagctaatgccagacaagacggcaaccaaagactaaaaataattatgtttagtgcaagctcttggcaaataaggagacaatatatctgcagttcaacaaaatcaatggattttgagtacctgcatatgttaggcattgtaattgataataggaatacaaagatgaaaatgtattttcctatttttatttcccatagtcttcattggaagacatttgtatttccaccttaaacttttatttttaagtagtgaaagcagagggactccattatgtagtagaaaacacaatggatgttctagattcaatttgtggagtcaatccgagtcttttttggagaagaacaacagaaatattttacattttttgccaagaagtataaagtgcatatttcaaatggctgttattgcaagaaagagtggattaatcatataagtattcaacaggcacttaaggagaccgattgtgttcagttaaataatttcacttctatagatgccaaatcactggattctataacacatggtaagaccagcatgatttgttaagtgacagagacaacttgaagagtgcaaagaacataccattgtcaaaagacttgaggtttagtatttcttcagtcattactcaatctttaggaacctcaattcatcttcttataacatggatatagtaatctgtatatcttggggctttggtagaaaccaaatgtaattatatacatcaaagaacattgtaatctgtaaaatattattcctgaaaagaatgcgcttaatgaagcatcataattgattacatatgattcttccttatccttaatttaactttcaaaatatcactcaatttgtcgttctcttctcagcccaaggaattaaatggtgaatttcaaataacctctaatggtcatctattttcaaagtagaatttatgattctgtgtgcccaattttgttttcttcccactatacctgggtgcctattgatactaacctagtttaagcacttatcacctcgtatttttaaatcttacaatcatatccttatcacttcaatttatctaaggtctctcttttcaaatcatccagcatgtaatctttaaaatgacttttccgaaacataatttttacaatattacggaaaatatttgttgtttgaagtcatacagacaaagctaagccctatgtcttactagttacaagacctttcttcttattcacttctctgtgaataatagtgtctgtctcctagggttgaattgagaacaaccaagtatatagtttgcacagtatctggattagagaaatgctccaattggacctctaccacctaatcctgactcactttataactgagtagtttatcgtcatccatgggataagtatgaaaatacaaactcctttgtgattccgtatactccaaaatgtttctagtcttctccatcaccgattcttttcctgctgaaaccattcgtttgcttatttatttatttatttatttaatggcgtacaacataatgttttgatatatgtgtttgttgtgaaatgattatatcaagctaattaatcaaatcctctatttcatccaaactgttttaattttctgaaatccctatactattcacttggtctcatggcctctacaatatcttgccctgtaattatgtgaatcctatcaagtattcaagtctgagcatttgctaaccttttttaataaacctgactactttcaactcaaactgctacttctaagtatcaaaaatatttactagatccttatcatttatatttttgtttatttccctctcttctttcctccctccccttcttctgccttcctttctgtccttccatctttcttactttcattacagatttcctttcaaaatgtatatcttatacgcatatctatgctatacgttcctgaagggtaaaaagagtctttacatctttccatgcacctatgacggagagatagggaccaatcaatagttgttaattgtctgtactatgggtttaacaaaaacacattaaaactaatatatgttaaaagttccaggccttaatttaagaaacttatttatattaatgcatgtaatctgcctgacaatcctataaagatgggcagactgaagctcagcgacattaggtaatttgcccgaggtcacacaggtcttaaattttataagcagtatgagaacccaagcacattcctgtcaaagcatatgctcttaactataaaggtacagtgatgcttttgcagttttggaaaaggatccttgtgactctgggtagcgttttcaaaagatggttgcctgtgtgtctatactcaaaatgccaatagtgattattatgaattcatttagcaatgattcatagagaactattctaggcactgggaatgatatgataaacgcagcagaacaggtggttaattttgtgaagctagttggtgagagatggacgctgagcacataaattagaaaatataaagtaatgatcagttctataaataaaataaaccatggatatggattggattaagttgagtttatactttgatttgtgtggtcagtaaagtcctctttgggtaagtgacttcttacctgagaccttatattaggaaaataattctagttagtataagcgcaaggagacttattaaaggcaattagatggcttactagaaaattaaacctggatgcttcttggaaaggatcagagtgccaggagccacacacctttcgtaaatatacccaaccacactaagaaacaacttagcactgatacttgtggttcccaagttacctcagtttcttgagatacttgaaatggagagattattagagtgatttcaattaagatggaaaggggggtaagttgtgttttgcatgtaaagcttactacagaatttctcaactggtggcagaacaggttaatgaaataccatgatactgatcatctcagcctttagggtaggacccagggcagcccaaattctcacgttcattaccttcagccttgagcagccctgtttccttcagtcttccatgccgtggaaaagactggggaccactagcctatagtattggcttaagaatgtgggatagagaagaatcaaagatgaattatgggtttttaacttgattgacttgttggctcatggtgccacttactagtaaggaaataggtagggcagagcaagttatagaggaaggggaataaaagggatttttttgtaaagatgtgaggtttatgaaatttagtctttaatatgtagatgtcaaataggtagatggctacataaaacgagttcaggagggcagttcaatttggagatctacatttcagagttattagcataaagatgtagtgtaggagcatgggactgaatgaaattactaagggagaaaacagaaaacaaagagaaatgattttaagactaaggccttgtgcacataaacattttgaagtagaacagactaatagtgtgctatatagtgtatgtacaatataggaagagaattcttgatgtgatatatattttaaaaactggaaaacatactgattacacaaaactaatgcatttctacatgtgtagttgaaagaaaaaacatagttgggaataatccagtaaattataaggaggactgaacatgttggggaagaaaactttcatactaggacaaacttttttttaagaaaaataactttttaaaaatgaagcctaagagaagatattatcaaagcttataaaatcaaaaattgtatgaatagggtcaacccattctttttttaaattattatactttaagttctagggtacatgtggaaccaacccaaatgttcatcagtgatagactggattaagaaaatgtggcacatatacaccatggaatactatgcagccataaaaaaggatgagttcatgtcctttgtagggacatggatgaagctggaaaccatcattctcagcaaacacattcttatttaccaaagtcaaaatactagaactagtgctttaaagcactccctgaggctttaaagaattactctgaggacaaaatgaaagtaaattctgttttaaccagtgggtagtaaacttaaaaaactctttaccataagcggtagaatgggttgaaaatataaatagtttcaaggtggagttcatggacaatagatacacaataggttgtttaaggaaatggaatattttaatgagtggtacatctccaatcttttaattttgatatcctattttataaccactttctgtaaaaaagattatttcaagccagagttggaatagaagggatataatctgatataatatgaatttttgttctgttagcaaacatttttaaagtgaatgttctgaatagattccaattttcttaaaatagttattatgccttatgaagacctgcaatatccgtgtaagaagagcaatgctttttatatgttgtaataagtaatttattagaacatttattcacaatgatgaatcaccttaattaatatggtgagggcaaaataatttctgctatcaaatatcagtatgtacttgcaaaattcttataaacttcagttcatatgtctgtttttctttaaaatatccctaattactgacctaattttattcattttgccatttaatttatttataacgccattcttttcttctaatgcgttctcctgtttgaataatcatgttctctttattctctttttcgtctttctactggttggggaattatatattctatatacattttctgagcccttatccttaaatttatatcattcataattaatgacattctagtctaaacatcgcaagagcagtagaatgtttaaattctgatttccctcctaccatatttcatgttattgttgcctgatattttgctcctatacattgttacccctcccattagtcattttttatggtagtaaaatatttataatactattttcttcttatgagttctgattcttctttctggttcaaatttcctccttccccatgtacacatgttaacaagtacctttgtaaatctatatttcattcttacccttgaataacagttcagcaggggccgggcgcagtggctcttgcctgtaatcccaacactttaggaggctgaggcgggcggatcacttcacttgaggccaggagttcaagaccatactggccaacatggtaaaatcccgtctctactgaaaacacaaaaattagccgtgggtggtggcgcacacctgtaatcccagcgactcgggaggctgaggcatgagaattgcttgaacctgagagacagaggttgcagtgagctgagatttcactactgcatcccggcctgggcgacagagtgagactccgtctcgaaacaaaattaaaagttcagcaaggcattgtattctatatataatattctttgtgtaattatcttttgaggataatgcatcttttctttttgctgctcttaagattttgtctttcatgttctgtatttccataactatgtgttctgagtatttatacattggaacttggtatgcatcttcaagtgaggactcttgtgtttctatgattctggaacattgtctaccattatcatttcaaatattgtttcccagattctctctagtcactttttctctgattccactgtatgtgcattgaatattctcctttcatactaccacgtattttaatttctctttacatatcttctaattcactaattctctagttcaatctaatctatggttcatcacatattttgagagctttgctaaattccttaatttgtttttggaatttatgtttggttattttcaaatatatgtgttttatatgtcctctttttgttttctattttctatttttatttctctggccatttgaatcatatacacatcatgaataaaaagaaaaacaaattgttctattagtaatagttttattttgctgtccgtaaaatcaaaatacgatgagaagccatatgacagtaagatggaaaaaacatagggaagaatgagaaaatttaaaaaatagagtaagtggatggatttgaagtagcaccttatttctctttcttgcatttgggtttgcccatttttaaaaacaatccccatcccttttaccacagtatttccatgtgtttggaaaaaaagaggaaaggtttttgtgggtatatggtgaaggagtactcctacaatttcttaggactgtatgttcaacaaaatttgtttttaaatttgatggaacaaaccttttcacaaaataatattaatataaatataaaatgactgattcatgaattaccaacaaacaacttgaatttacaaaataaaccttcaaatgtatttttcccttgaatagtattttatttatatttttaattgacatgttataattgtacatatttatgaagtatcttttgatatttgaatacatgtatacattgtgtaatgttcaaatcaatgtacttagcatatccataacctcggggatttatcatttctttgtagcaagaacattacaaaccttcttctagctattttgtaatatacagtaccttactcttaaccatattcaccctactgtgcaatatgataccatattcctcttaccaaatagtaactttgcactcattgaccaacttctctccttcctcccctccctgctctctgttaatcactgttctatatctcaatgagatcaacttttaaaaaacccacatgaatgagatcatgcagtatttttcagtgtgcctggcatactcagcattatgtccttcaggtttgtccactttgtctcaaatgacaggatatcatcccttgttatggttaaatagtattcgattctgtagatataccacattttctttatccattcatctgttgttaggcattttggttgattcccagtcttggctgttgtggatagtgctacagtaaacaggagtgcagatatctctttgacgtactcatttcagttcctttggatgtatatacccaatagtgggatgactggatcctatggtagttttatttttaattttttcatgaaccttcatactgtttttcataatgggtgtaccaatttacagtcccactaacattttgtaaaagctcccttttctccaaatgctcaccaacacttcttttcttttgtctttttgataatagccattctaataggagtgagatggtatgtcgttgaggttgatttgcatttctctaatgattagtgatgttgagcatttttttcatacacttgttggccatttgtatgtcttcttttgaaaaatgtctattaaggtattttgcccattttaaaatcaggttatttggtttttgctgttaagttcttatatattctggatattaactccttgccagatatatagtttgcaaatatttcctcccattttgtaggttgtctcttcactcttgtttctttgggtttgcaaaatcttttttgtttgatgtaattccatttgtctatttttgcttttgctgcctatatttttaagttcttatctaaaaaaaaatttgctcagcccaatgttgtgaatcatttcccctatgttttcttctagtagtttcatggtttgggattttacatttaagtcattcatccaaaaaaaagaaagaaaaaaaaagaaaaaaaaagaaaattaatcactttctacatttttttttttttgagatggagtcttactctgttacccaggctggagtgcagtgacacgatctctgcttactgcaacctccgtctcccaggttcaagcaattctcctgcctcagcctccctagtagctgggattacaggcatgtgtcaccacccctggctaatttttgtatttttattagagagggggtttcactgtgttggccaggctggtctcaaactcaacctcaagtgatccatctgcctcagcctcccgaagtgctggaattacagatctacattgtatcttgatggcagtataactattattttttaaatttttggatttttaggcatcttatgtattatacaatgcctttacttaaaagtggaaaaataaggtgaacatattttgtgacttgtcccaggtaccattgtttataaatagcactaaaactaaaatgactgaattagtcactccttgtttttgtcattgctctaagtatgtgttttcttccatttatagtatgagataactcagccattttcattaaatgtcagaaaaaattttatatagatctttacacagcatgctaattttaatagttatatttatatcatatttggagtattagctttcatcatagtcctttgttatgttactcatatttttcttgatactgaatgatggaatgagtcatttctatacacttagtattaacctttcagtagttaaagaagtggcatttatttttaggacccacacaactgtttctgaacttgtaaggaaaagccatacattttttctttagttcaaataactttacatcctaatatgtatatttggttgataagtatattgattaggacaaatcagtttggaaatagttatatatgtaagaggatacttatcaggaagtgagccaaaaatgtttgtcagtagtactggttaaatattgaaattatatttcttaatttgtcagtctgtaagtgtgagcacaatgtcttagcacttgggataatttagaagcaactctggctctagattacctagcggatttctcaacgctggctgtagactttaattcaaccgtgattctgtattacgttatataataggacactatttccacaggcctatgaattttttataaatttggaatcttcactttttcattgtttttattttacctacttaatcttttttgtagtatgttttattctcccagagatcttttgactcttaaatatttatagagcttttgcactacctcagaatatcattagcaatatgatagctgttacttctgaatacttttctttttaactttcttttaataatcttccataaaagtcttctttgcatgtatgtttaatctattaattaacttctagagtctgctacttaaataggtgctatctttcttctgtccaaacttgtatagtaattaaaaccagcagtgtgtagtagaagacattttgcataccatcaatttccgaaaaatttccaaatattatggtttctagtcatatgtctacaagtttatgttttgtaattaaattcttcccttaaaatgtttatgtaaaaaaagttggtctttccttttttagtcataaatatttgatttccagtttttcataagtaatatatacatttatttctacttcagcagatactccattataatcaatgttgctacagcagtagataaaatacaagctccatgagagcagagatcatgtcagtcttcggtagttgctgcaaaaccagttttgagtaactatctttgacaaataaatgaaagaataagtttgatttcaatgtacatcttcaaaataatatctaaatgaaattcatctgtgcaggcctaaccctgtttgagtccagctgcaaatgtacaagtggtttttttttggtatagtagagtggaaagggtgaaagctttcaagctaggcaagtcttgtttcaaatcctagtgttgctgtgtaatcgctgtgtgaccttaggtatatcccttaacttctctaagccaaagtttcttaatagaaaacttgtgatggttttaacaattatgaaaaattgcattgctgaaagaagatgctcagtatatatcattgtattttacactgtgagataatgggatccacataaactggcatgcacatttttaaaataacttttatttttaaaaaatgggctttagaaattgttcaattacctaatgttctaatgcatttttaacattctctccattttcttttatttctgctatttttatttccatattccagtttatttgcgcaacttatgtctgaagcataagcaaagattcttccccagcttctcctcttattttacatcttcagttctacaataatactgtattagtcagggattggtcacaaaaagacgagctgctctatagatttcaagcagtgaagagatttaatacaaagaattaagtgctttactgaacccctggaaaggctgggagaataggattcaggtgacgatgccactagctctccacttagctacaatgttcagaaaatgagcaaattgtgcagaccacaggaaaccactagcagttttcactactgcttgtgttatcaaagcaggtgatgtttaggaagtacccagtggccactgtaaaattctcatgtctgcagaaatccaaacctctgcttctcacccccaggggaagccctaataaattttcagcctctccttagcttgcaaatctggtacaaggtttgggaaaaggtgattgatgcccaggcttccagcccctatgataacagaggagagcatggcaggtggaatgatactgagatgccaacagagaagctggtacagcttcacctgtatatgactgttcattttcattccaatttcaggcatactctctattttcagttctgatccctatgcctcctattattgcaataattattacttaataaataaatggctccaattgcagaaagaggtttacttatgtttagcatacatactactctctcttaggcatctttatatttcatttatctcagaaacttatcctttttacaaacaagtctgtagactataggtaggcaaactatgacgcagaaacgaagtccccgaggctgcctatttgtgcagataaagcttacctggaaagcagcaacacccatttgtttccacattgttagtggctgctttcacaccaccacagcagcatggaatatttgcaacagaggccatatggcacacaaagcctaaagtatttaccatctggccctttatagaaaaaagttgctgacccctactatggatattatgtaaagaaaggaactactacaggtagatttttctcacgtgcttgcctattgaatttctttcataattgatttaatgaatataggctttttatcttatgggaaaatatcatcatactgcacgtacttgtgtgggactctgtcagtgatcttaaaaataaaaatgtcatgcacccaagagaaaagtattcattcaaccaagccaatgaataggttccgaatcttcctcctgcactaggcattgtgatttcacctacatttccaaacatctgatttttaataatgcatcgtataatcttgattctcacatgcttcacaggacagccgaattctttttcaaaacttatagtcactgttgagtcataccaatgatctttgctttctagtagcttccatatcttaataacatttttaaaatatgatacaatagtaggtctattttactcccagtaattaggccttgaatcttattagcaacttgatcatgctggtcactattgagccatgaaggcaatttatgaaataaaaggcttttcattctttgccaaccaatgattcacccacatcttttcccctatcctcctgtatcttttgtatttttttctgctgtgaagtcatttttttaagacgggaaggctggcagggagggaaggaaggagggagggagagagagagagagagagagacagagaaagagagaacgagaacacaccctaaaaggttttcttattaactattctcaagtattatttcttatcagctatcatcagctatttcttcttcagcatcatcttcaggtatttttttttaatcttgtaaaacagaacacttttttctcacacattgtaacttctcccgaggtagtcctttattcttgtatgacctcctcctttgctcatcaccttgggtcttattctgcatacttctctcacttgctctttgatttctactcttcttgctccaattcttacaatttcttaacctctattttaaaaaatcttttctcttcatcattaaatgcttttacagatggaaacattcattttgttctttaaggcatttcaatatttttcttcccttgagtacatttcttatgccattttaacttgctcctttaccatctgaaatcttgaaaggggaatagttcattcttcctcttgaatatatattttcattgaattttcttcctgttaaacaagaatttatgcctgtcaatgcttttgataaaaataccaatttttttgagaaattaatttaactgtaaccaagatgtgggctttcagtttgtattctaccatgtctatgttcacctgcacataaatctattaattctggggaccattcccatccatctctgtttttattataattctgatagcaagcatctaaatatacaatctcaaattctatattcttaccagtgtatgtaagtgtatgtattgtgtgcatgtattgtgtaagtgtatgtattgtgaccacggataacttccagttacttccaacattttcatctttttctggaacaacgttggaaatccctttcaagacagaaaattccttcgtgaatgaagcacggatataaaatgcttcccctctttgtttctttggatgtagggtagctacatatataaatgtgataggccctaattcctaatttatttctttgattacatattttccagtgcaaagcatagattattaaatatctgcacaaataaaaattcatgttcacatttttttgttttgtttttttttgagatagagtttcactcttgtcgcccaggctggagtgcaacggcacgatcttggctcaccgcaacctctgcctcccgggttcaagcgattctcctgcctcagcctcccaagtagctgggattacaggtgcctgccaccacgcccagctaacttttttgtatttttagtagagatggggtttcaccatgttggtcaggctggtctcaaactcctgacctcaggtaatccacccgccttggcctcccaaagtgctgggattataggcatgagccaccacacttggcctcatgttcacatttttatcccatttatccatgtgaaattagctctaaatgtgataaccactagccacatgtggctgtgtaactttgaattaattaaaattaagtaaaatttaagatttagtttttcaactgcactagttacattccaagtgttcaatggtagcatgaggctaggagcttccaccttggatagtgcagatagagatcattttcattattgcagaactctctactggacactaaatattagaaaacatacatagttccttcatttgtaacacatctctccctatcacattaagctctcttctttgtatgaagagtgtgtaaatttgattcatttcatgtcggaatccatgggttgtacttctaaactttagtggtaatttacactttgtattatgtactcctatttctgatttcattttttcccattgtttgtcatttaattcagccaaattttcttttcttgcattctcctattctatgtattccttagatcagtggttctcaaattttaatgagcatcaaaattacttggagggtttgctgaacacatattgaagggcttaccctgagaatttctgattcagagagtctaggatttggccgagtaatttgcacttctgttattgctactcgttctgggggctcctaccctaagaaccactgcctagggaaggcttctacctctctttgcccacttttctatgcacagagctattttttatacaccctgcttcagtattttctatacagcttatttatttcttcctctatttatttaatcattatgtatttcccccataacttgaaatccatctctcttaactctacctgtctccccataccctttctgtctgtgttctctcttttcccttgcttctccaggagactttcaagatttcatttttacagacgtttcttgttctgtttccttttgctcttgcatgctggctcttgaagatggcccaactatgccttccttcctttcactataatgtgtccttggcatttaatttttattttactagtggctctcttctcagtaggcactgtggtatcactgcactccagactgaaaccacatttcctaactgtgtcctatacttaagtgacctgggaagtgacagttatatcatgtctttagctgtcttctgtgtagaagcaataatatttctctgtaacttactgagaatctctcagcaggtggtcagcacgctcaccattttgtcacctctcttgttaaaaattgctttttgcagctcaattctccaaatgtcccaacctctactggactggctcatacttaatcactttttcaaaacggtgtcacagtatgtttattttgtttctaaagctttgactcttttccttcttgtacagtctcaaaataagtttccatttttctgtttaattggaacttacatcaaacttcttacttcccagcatttgaactgctgcatgatgtgtaccctggatccattccaaattgaattaataagcagacctcaattttatctcttgctagactgtaactctcatcccctgttaagcaactcttcagtaacagcctagtattgttaaagggggggcctcttgagttagaacaacccttttcacattccacctctgcttctcatttttctcacctacacaatgggctaatattagcatctatcttatagaatcattgagaagaacaaatgaaagaaggtactttgcacaatgcctggattatggtaaatcttaaatcttggcctttactaatgttgctatattaatcacagtttcccatgaaggaagttatttctttctttatccttcaatttctttaccttgcagtagatgcaaaaaatttgcaataaatattttccagatctttattctacttctctactagcttttgccttttcctctaagttgcctatcccaactttgaaagtctttacctctgtttctcatttgcagttgaacactgacacaaaacaagagaaaacaacaagcgaataagaacacaaacacaacatcatctcagcactttctctcactgtgccaaatgttcttaaaggtttgttagttttttatcaaatcacagcttgatttatttccagcctgtgctccacaccagttgactactgttatctttgtagtaaccaagcaaaacaagtagggcaggaactactgtgcctcttgtgcagacttggaaagtgaggccacaatgacagatgtgacttagcaaggatggtgcagccatgtagtgtaaacagggctgctgttctaggctgtgaaggtggtgcaccgcagcaggacaccacagttaaagggatacctccaccttgaagacatcactgatttgttttttatagtaaggcagtttccagcactgtcatggagagaggctcctatttccaatttgcccaaaggtgctatgtgggctctcattagccaagaaaactcaactcaacacatgtgctctgctttatagcttatttactctttagtcgacgttccatacaacatagattactatgtttccttttctaattcattttatcctgttattttctttatcactctccccctctaccctgcaacaacccatttacttttcactttactatataggaaaagtaagcattaaaattcagttggacgataaggtgaaagcatgtaaagctgttgaaaagccaggtgaccattattacatgtgactacattctagactaagtgggatgactaatatattttaaatgggaagaaataatttagatagctttatttgctaatgtgagataaatagattaaagttgaaagccactcaggctattgcaaatattatagcaggagaccataagaccctgagtaggcataccacaaagtaataatgtagatgattggctttggataagaggcccagtgaggaagctaattgcagaagcttgtagttgattagttataagatgacaaggggaataaaagcaagagtttctgagtctagataaccaggatgatgatggtgccatagagagaaatggaaaaatacagagaaagaacagatttcagaggaagaaaatattttatttgaagagaggagtggtgttctggtaaaaatgtcctctaggtgatagaaaaatgtgacaggaaattagaggtaaattagaggtggagaaaaacattacatgtagttgaatagagctacttttgaaagatatcaaaggtattcagttctcaatggccaaaagagggaagctgccattgttaaggttccacagcgtaggggatctcctgcaggtaagaaatagaagaaggatgaagagcaagcacatgatttagagacagaggttctcaagaaaaaaagggatgctcagcattgtagaatgcttcttataaattaaaatgaagactggtaaaacctattctttttttctggtgatttgttacaatttaaaaaaattgtatcttccttttactatcagtgaaaattcccatgatagcttcccattttggaggcacccaccaaaaatgtccttttatatatctccttcagtcttagatttccaaattccctttttctgtaacctgacctctttctatgaaatacaaaagtttgatttaaaagatgcctttcacactccataaaatagtatacattgtcctggctgggtgcagcggctcacgcctgtaatcccagcactttgggaggccgaggagggcagatcacctaaggtcaggcgttcaagaccagcctggccaatatggcaaaaccctatttctactaaaaataccaaaaattagctgggtgtggtggtgggcacctgtaatcccagctactcaggaagctgaggcaggagaatcgcttgatcccgggaggcggaagttgcagtgaggtgagatcacgccattgcactccagcctgggcagcaagagtgaaactccatctcaaaaaaaaaaaataataataatatacgttgtccttatccaataacgtggagttttttggtttttaaagcaacacagagattcattagcacctcattagttcttgaagggaaggagctctgaatgcaatactatctgtcttccattaaaaatggaagacatcattcccataagttgggaaaatttgagatttaataagaataacaactacagtgaattgagacacatcaaatatttaaaaactgatgattttataaacatactaatcaaggaaacattgttagtttacagcattgcagcatactaggatcccgactcattattctgcaaagagacaaataaagggaaggaagcatacatttggcctgccttttttcgtaccaactgtacgtattttaggataatcacattggaaatacataaatattatttttgaagtatagtttcagctaataaatgcaggaaagaatatcacccttttgcagcccataataaaatggtacgaaatgatcaccaagcctttggctcaaaggttggtggagatgcttgagtatggaaggattagggtgaaacctcctgaaccactgctaaatcttggtgtcactaaagtgtaacaaccagaaatcaggaattacgtgagttcttgtacctaggaagtatttttgcctaattttaaaaaaagacaaatatcctctaaatcatgcatgcctgttttcattagctactttacctgactttttcatgaggaattaaaaaagttattcttctgtacttttaggactcaaattgataaaagaaaaaagtttttaattttttaaatacttcgttccctttgtcgacatgtagaatgtgagatatgagatcacactgaggaaaagagaagccagcttcatgtggctttctgaaaatatgatattattatgtgaataataattattatttagtgaaaaggtaaacaaaaatgctttgtttatatgctattagtgcaaccaaatatttgtgtcagaaatgattaataattggaaactgacagaataactggcatatgaactcttaggtctattatctagccctaactctccttgatttttattgaataatacaacaatgcttaaataatcacaaaaatgaataggaaacaggggtcattgacaatttgtaggtcaaccaaacaaatgtcttagctgtagaacattttacaatccaatagagaacaaactttatcttagattagtgaatgccaaagtgactattctttcatcagggccaaggtggcactaacactttattagcccatatggatgggtctcaaaagcagtaatatagaaactttgcagcttagctgtataagaataatgcttataaataaaataccataacgtgtaaaagtaaaaatgtctctcttctttttaaatatacttcagtctattcaagacaaagaagtagccaagaaacataagaaaaaaatgctcaacatcactgatcatcagagaaatgtaaatcaaaaccaccataagacaccacctcacattatccagaatagctattattaaaaagtcaaaaaagattggctgggcgcggtggctcatgcctgtaatcccagcactttgggaggccgaggtgggtggatcatgaggtcaggagttcaagaccagcctgaccaatatggtgaaaccccatctctactaaaaatacaaacattagccgggcatggtggcgtgcggttatagtcccagctacttaggaggctgaggtgggagaattgcttgaacctgggggggcagaggttgtagtgagctgagatcccaccactgcactccagcctgggcaacagagcgagactccttctcaaaaaaaaaaaaaagtcaaaaaagaacagatgctggtgaggctgtggggaaaagagaacacttacacactgttggtgggagtgtaaattatttcaggcattgtgggagcagcttggagatttctccaagaatttaaaacagaactatcattcaacccagaaatcccactactgggtatataccgagaggaaaataaatcattctaccaaaaatacacatgctctcatatgttcatcacagcactgttcactgttgatatgcccattaatggtggatttgacaaagaaattgtggtacatatacactgtggaatactatggagccataaaaaagaatgaaatcatttctttacagcagcttgggtgcagctagaggccatcatcctaagtgaattcacacaggaacagaaaaccaaatgccacatatactaacttataaggggaagcaaaacgttgtgtatttataaacataaagatgggaacagtaggcactggggattactagaggaataagggaaagagcggggcaagagctggaaaactacctgttgggtaccatccccactacctgggagatgagatcatttgtactagaaaccccagagtcatgcaatgtgctcatgtaacaaacttgcacatgtacccccgaatctaaaattcatacaaataaataagtaaacttcgatatattcagaagaaacacagatacctgcttataatttaaaatagaaattttgagaaaagaaaaaacggagatagttttatcagttcttaacagtgtagtcataagagtcagtcatacctgggtttgaatcctggctctccggcttactaacaagttaccttacatctctaaacctgtttcgctatctataatatgagtctaataatagcaccaacccttagacaggtgtcagaatagatgagaaaatttatgtaaacagcttagcatagcgcctaacagattgtgatacttaataaatagtaactatcatgattagtatctgtcatcataatgaattccagatgaattaaaaatttagatctgaaatgttaaaatataccaaaatccagaaggaaatatatgattttcaattgctgatctataaatagaagagaacattataaatgatgaaagacattataaaaaaagaacataaaacaatgactaactggaaatataattgccatgaaaagtaacacatttaatatccttagtgtataataaaattttacaattaagtaggaaaatgtaaatcaaaataggaataaaagggcatgaatttaaaaattttatgacacgcatacatccacaaaggaaaagacaaaagaaatgcaaaaggctgcatggcgttcagaaaaggattagtataaagaagaaaaaagaagtaacgttatctgcaatcttacctcttattaataatcactgtttaaacttggtagagtctctttcagacatatccacatgcatgtgtaaatacatacatacacgggcacacacacactttgcatcctatctgcattttgcttcatgtttttccattattccatggtaattttttcatgcctaagaacagtctttaaagtgttttatttggctctgtagagtattagtatgtcaatcaggtctctagttgaaggttcctgaaactcaacttgaactagattgtatatatataaaatctaatacgcacgcgcgcgcacacacacacacacacacacacacacacacacacacagagagagagagagagagagagagagagaagcttgtttcacgtaaccaaagcagaggaaagacttgatggaattacagaaatgaggtatttttacaccattaataatcactttgatttggcttagctttttatgccagctttacatttttaggcaagttttctctggtatgtcagggaacattgacacaaataactccaagctagtatctccatgtctccaaattcagagaaaagatgaacaggtctgcccttctaactctaattaggggaactccagggaagacctctgttggatatttgggtcatctgcttattcctggagcagttatgtggccaggggcataggataagtagcctagactcttatcaatccagagatgagttaggagaggctgttatgagaagaggatggacaggtgctgagcagccgaaaacaatgattgccacgatatgaatgtcccacaatttattcagtgttttgtacgttaatggatacttaagtttctctaccatttgatcttataattaatgttatgataattgtcgtcatgcatgcggctttgttgaaatttttattggttttctcttgtaggataatttactagaattgaaattattttatgcaatcccatgtagctatgaatacatagagtcacatctttcatgtacttaacctgtataaattcaattatgttgaatcagaaatacagggtagagaaattaagaaaacagtagtggagatagagtgagtgagaggaccagtgagaagaataaaaactagttgaatagctcagccgtacttacctcagaatcaatgaccttatgcttagagggagcagcatgaactaggagtctctagtcctatgttatgtcagtttttctcaatgttggcctgcttcttgtagagtgagattgtgcctagctgagtttcattctagtggtaagagttagattttctttttttgtatgccatggactccaaacacatggcaacccttaatctagtattcctccaaagaaaacagcaatctgttcaacaccagaggaaaatctgacgggcttgtacttaccaagtcattatattatattttgtgtgtatgtgtgtgtgtatgatttagtgatatctcaaggataattttgagtatgccctattttcatatttcataccaattctaaagcctaccccacaggaacttgaaactctgctcaattgctaaattaccattaccaaataatttatgtcaatttaaactcctaccataggatatgtacaggcacatttcacctcatccttgcctgttctgggttaaagcactttagagttaatgggaagaaagaaaaataattatttaatataaataacaaatacagaggtggtcagccacatttcattttaatgaaatggggccacgagaattccagtaaatcacaattctacttctataaataaatggaaaagaaaatagctaatcttgtcgcacctggaagcctcaaacctaagataacaacaaagctgattatttttatagtgatcagatcttaagaaatacaccagcatcttatgatgctatgctagaattattttaaaaaacatacagccggatgcagtggctcacgcctgtaatcctggcactttgggaggctgaggtgggcagatcacctgaggtcaggagtttgagaccagcctggccaatatggtgaaacacgtaaaaatacagcaagggatttattctacaacattaagattttcaatttaacagacatattctatgtgtacatatttgcatgatactagcactgagcaatactcttctgttaattcaagttactctgaatttaaatccccagacttccagaatattaagtctgcttatgatcagtgatcatttattaacttttttgcattgtattttagataatttcacagttgtaaagaatttcataggttattgcataaaattcatgcttttgaatataaacacacatgcacgcaaacacacacacacacacacatatcccccatgctcacgtatgtttattgagacacttttcacaatagcaaagactcggaaccaacccaaatgtccatcaatgatagactggattaagaaaatgtggcacatatacagcatggaatactatgcagccataaaaaaggatgagttcatgtcctttgtagggacatggatgaagttggaaaccatcattctcagcaaactatcacaaggacaaaaaaccgaacaccacatgttctcactcataggtgggaattgaacaatgacaacacttggacacaggaaggggaacatcacacactggggcctgttgtggggtgggggtggggggtagggaaagcattaggagatatacctaatgtaaatgatgagttaatgggtgcagcacaccaacatggcacatgtatacatatgtaagaaacctgcacgttgtgcacatgtaccttggaacttaaagtataaaaaaaaaattcttaggttgtgtgccttgcaaaaaagtcagtgggctagatttggctcatgggctattgtttgcttacccctgccctaagtcatagtttccaatgattttaaaattataaaaattataatcatataaattatgttggattgatcatatactgataatttaatgatctttatgaaaaaatttaaggtaatttgatacaattctttaagttacagaagaaaatgatatcatgagcgaaatgaaaaaaatgggataaaatagctaatggtgacaatacttttttggtatactatctggtatttatctttatttaatctttggataatatgtacattcctaagatgaaaatgagaatgtaatttgaccatttgaaaatatatattcttacactgacttaaaaagataaagtattgataatttcacatcatctctgtctttgcattaaaaagtatcatggaacaatagccacactttttggaaattcaagattccataaaatatagtttgaaaaacacatggacgtgtttattaatttctcctttcaatattctttctgggcatactggaggaaaattgacatgaagaatctttaaatttgttatgaaaagtagaaggtggcatgtaggcaaaactttcccctctgagagtgtttctgcattatttctttgcatgggaagatctcaccaccaaagtgtagcatgtctgtacccaataggaaaatgcataccctgatattcattttaatgaaaaatttcaatgacgtataatcctttgtcattctttcccaaattgaccctctgatggggtaagaaaaaaatgaattctacctttttcatagatagtaaccatagaaagctctggtttctagagagattcaatcctttaaaaaggaacataaagagaaaagggatttggagagaaattaattctaagactctagacctgcatgtctgtgtaacccaaattctagcaatatctagaaaatagaaatcaaatcaactaggaactggtaatacaattgctaagacttcctttatcttaggtccagcagattcaaatgacacactctttaaaaaaaaaaattattatttttagtttttgtgggtacctggcaggtgtatatattttggggatatatgagatgttctgatacagacatgcaatgtgaaataatcaaatcatggagaatagggtatccgtcccctcaagcatttattttttgtgttaaaaataatccaattacactcttttagttgttttaaaatgtacaattaagttattattgagtatagccaccctgttgtgctatcacatagtggtcttattcattctttctatttttttgtacccattaaccatcctcctctcctcccgcatcccccattacccttcccagcctctggtaaccatccttctactctccatgtccatgagttcaattgttttgatttctagatcccacaaataagtgagaacattcaatgtttgtctttctgtgcctggcttatttcactcaacataatgaccttcagttccatccatgttgttgcaaatgacaagatctctttttttttatggctgaatagtagttcattgtgtatatataccacattttctttatccattcatctgttgatggacgcttcagttgctttcaaatcttagctattgtgaccagtactgcaacaaacataggaatgtagatatccctttgatatactgatttcctttcttttgggtatatacccagcagtgggattgctggatcatatggtatctctatttttagtttttttaggaacctccaaactattctccttagtggttgtactaatttacatttccaacagtgtataaagggtccccttttctccacatccttgccagcatttgttattacctatcttttggatataagccattttaactgaggttagatgatacctcattgtagttttgatttcaggtgacacatgcttgactttagtatgaaagtgtcattgacattggctgtctagtcagtgtctaatagccttttctctatctttgtcataaaatctatcatcatctgtggtctactttgactcttttttttaatgacccctgagatagttgatatggaaaatacataaatagttgaataattgtatgaacttttcagtgtcttctcaggtgacctaccagaggagaagtagggtatagaatgacaactttttaattagggattttttttcccttaagaaacagctatggaataatggaaggaacctaggttttagattttacatatacacacacaaacatacacacatgtgtgtgtatgtgcatgtgcgtgtgtgtctgtgtatttatatatatatttgaaatccatttattccacctctcaatcttatctgagcctgggggatgtgtgtgtgtgtgtgtgtgtgtgtgtgtgcatgcacatgtgtgttcatattcaaaagctaagcatgaattttatgcaataacctgtgaaattctttacaactctgaaattatctaaaatacaatgcaaaaaagttaagtgatcactgatcataagcagactgttgctattctggaagtctggggatttaaattcagagtaaccttgaattaacagaagagtattactcagtgctagtatcatgcaaatatgtacacatagaatatgtctgttaaattgaaaatcttaatgttgtggaataaatcccttgctgtatttttacgtgttgtatttataaagatataatgggctctaatttttagagagtcctgagaagtccatgaatattaaacacatcgtgtggatttttatttatcatcatctctgattttatgttcgtgaaattataactcagtttcgttggagttctaactacaggcctagttcaacaaaattctgatttccatcatcttgactacattgattttgtgcactttgatctttactttgtattatataaaagtcaatatgttgatctataaacacatctgctgcttggatagtagttattttagaattggctctctttccaagcacagttatgacactgagaattggtactgtatgctccagtcagcacttcccagtcacaaaccttatgaagaatttaaagaactatgtggaggaaatactctttgttctaattcaacattagtgtatagattgtgtttgtgaaaaactgtatgagaaactggtctttttaaaaatgtttttccttcagttctggagtgtcaatatcaattttattctgtgattagaaatcgcatgactacagcctgtgtgtcaaatcattaattcattgaaattcctaatcaatgtaatattgcttttaggataaagttttagtaacttactgagtgggctctctctgtctctctctctctctgtttctctctctctctctctctctctctgtctctctctctctctctctctctctctatatatatatatatatatatatacacacactatatatatacagacattatatatataatgtgtgtgtgtatatatatatatatatatatatatatggcagtctaactataagagctatactttttagtgtaaaaaggttgtatattcgtgcattggatggatacctaaagctgagaggttagccctacaaagtattaaaaaacaactcaagaagtaagaaatcaagaaatgatcaagagttccatagctagttaaaacaaatcagcagtctcaaatgagttcgagtgtgaagtgaaataccacaaagatgaattattttagacctgatgtgaaaagaaatgatggtgtaagaatatgagttacagcttacacctatatgtgtgtgtgtttgtgtgtatgtgtgtgtgtgtgtatgagtatatatatatgagattatatgggaaaaagctaaagagtatatatggaaaaagtactttccagctatacatgggaaaaacaatacatgggaaaaagttataaggagttttagtttagcataagtgttctagttatctattgatatataacatagaacataaaatgtcacttttgttacattttactgaaaaggtaagacaaaagggcagccagtgttcaagaggaagggaggaatagaccccaactctcaatgaaggaatgacatgcacatatggaagggattgaattgttgaaccatattggagacagctatctaagaagtaaatattatttaatgatacttttgtatattggatatcactatcatgacaaggacatattgaaaatagtttacctgggtaattttactctcatctacttaattaaagtaatacatatagattttgtccattcatttgatgacagagagtatgacacagtgagtatgtccttttgggtttcaaattgatgaagcaggcagacctgttatcattctggggacgcttcccagtttggaggttctgagtgcaagagggcattaggaagacagagttccctactgctgctgcatctgctcattgcagtatgggattgggtctaaaattctatgactttgaggaatattaccagattatataattttaaacattccaagaaggaattgtagtgatcttcttgtccaattgttttatcaaaaagatacgaatactaaagcccagagaagttgacctcacaaagatcttaatgtatgagctatatagactctgaatctaagtcttttaactgctgagttactactcttattattccatatattgacactgctttccaaaagtctgtggtgtaattatcaatctggcaatccatgtaggaggactgttttcaccaaacggtgaataaaactttgttatttcattatattttcatgttttgggatctctaacagagtgaaaatgtttagtcaacttgaaagaagtatggtagtgagtaatttaagtgcatatggtgagctggggaggatctagttttgatgggccctgaagcttttacaagtttggctctactctgtaagaagaaaggatgtaaaattacaactgcaaaataagtacatggctttaaaagaggcctgtgtagtttaagaaccctcaagctcaagcttcatcagtctctgtggttgagttgattagtttaattgaaatactagagtttgggaaggacttaagaacaaggtgttatttcttcaaatcgttgtcgcctttgaaaagggtaaccttttttctggacttaaagtgctatccttccaacgtgtataatagtttttaaatgcaatcttgctgacatgtgtcaacatatgcaaagaaattgagaatactttctagctcttagtggtatgatactgccttgcataatgatttagacatgcagctctgccttttgtatatctccagccaccaacatttaggtaggaagcaagtactattgatctttgaaaactaaagaattgtgaatgatgcatttgattggtatgttaaagctatcctttgtatgcatatttttgtaagtcgttgaaatacagattatttgacctcaatttctccatctacaatatgaggatcaatgaggatattatatcatgtctgttgaaaatggttggatataagtggaggccagtggaagtattcagtgaaatgatgcatttccaaaatattgttttccagccaatgtccagtgttagtattccacacatggaatgcatgataggtatagagaaaataagggtagtattttacatcacagagtattttgagataggcaagaccattattatgtttgccattcttgtgaagaaaatcagttgcaggatattaacttatttaccttaagtaacatagctgggagtcaagcccaagacttaggacacaaagggcagcaggctttttaatcatcccactctgtctctttgagaggccaatagaagtttctaccatctccactgtcataccccacctggaaacgattgcattctcaaagtcttgtaatttagcttttcattatgactgcttttctctgtgttacttaattagaatctgcagcttttggcaggaaaatagtcaaccaagcagatttctaataagcaatgtctttaggggagaaagtcgaagtgagcaaagagaagagaatgaatgcgtgatagtagctgctagaatatattagttgcagacaaatttcagtgagagtgtcagtcaccgtgaattaaatttttaagtgaagtggccggaaaaacaagaatggaatggagcaaagcacatatatcatagttcagaagatttggaattctcccaaacttgtcatcctttaatggagaacctgttaggaacaaaggcagagcctgcattaatagaatgatcttgggaaatgccttccaaggacatctttttaacattcttactcagacttgatattttgaaaggtttttctgttagataaataaacttttaaaaacagtaattaatatgtatcttatttaaaaatagtcacatataatgtaggccaatggataataccattatgcattctgaagggttgaaaattgctagagacccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaaaaagaaaattgctagagacaatctagtctagcttttggaaacaacttttacagaaaataaatgttaaatactgggtgaaaaaacagtggtttcactgttactgacaactatggattaagagcgctttctacccctttctctcgaaacatttcattgttggtagatgaaaaagagagggatggtagagtctgttgagaaatgctctcaacagagaaagtgagttcttcctactgggatgataacattaatatggttctttatcatgttgcaccttagaacatttcagattcctattttgtctagtaaatagttgatcacatggttctctgcatgatgttgatgagaaactttaaaaaaaatctattctccttaaagcccatagttttctcaaaattagcttttctgctggggtgattgcaataaactactactggagtttaaaattgtgcctatttttccaggaacaagcttaaatcctgttaaactagtgtcaagcccatagtttgcattgaagttaacatggagggagtggcagactagctttccgccaggaaatgtgagggtatttagaccccatcatgctgtaaaacatttttcttaaggtgtaaacattggatatattacccaggaagttaaaacatatgcagctaaagggaactggattttctcagtctgtcaaattatgtgtgtctgcttcttaatcattatcatgaaactgttctatgggactacttgaaccaagttagctttcaattagcatgacgttatattggcaggtctaaactgttagacaaaatatgattctggcatggacagtacatacatgaacaatttattggtacatttccatggtccagcactatgacaacttattaaacccttaaaactctaaaacttgcccttctattttgtgttatactcacttgtggaaaagaactccaacctgaattaaattcaactatctacctgctcctcaccttcacccaagttgttcagcattaattaaataaatcatattacctttctgacttagtctttgtgatcacatatctccaatgaacctgaaatggtgtcaaataatccttttttcttataatatctctctctctctctctctctcactttgaagaaacaaggtttcattctgtcgctcaggctggagtgcagtggtgtgatcatagcacactgcagcctcgaactcctgggctcaagatatccacccacttcaaccttcctagtagttgggactacagatgtgcaccagcatgcccagctaatttcttgtttgttttttgaagaggcagggtctcactttcttgccgaggctcgtcttgaaatcctggccttaagtgattctcccactttggcctaccaaaacacttggattacaagagtcagccaccatgccttgaatcacacaatccttttacttctctttgacattcactttaccactctttgagatattattttgttaattctcctctatctttaaacttcttactctttgcacaccctgcacactcagctgtgaaacagtcaacttacctttcctcccatttattattttacaaatgatgcattgaaatagaacaagctcatatttctatcactaaatttaccactctacctttacctttacctctatttagagtagatgaactctgctactatctgaagccaactctgaaggttatgttttccaatgatctctcgaagactgctccttcaactgtctcctcccctatatcaccaatttatctctcaatataaagtcatccccatgagtatacaaatatagcttttttcacatgttaagtaaaatgtcccctcatgctatggccctattgacttcacagaaatatctgtctaaaagttatctgtatttgatatctttgctctctcacattccattatctccttagtcaaaacaatgaggtttctgttcctcgcaaaatgtccacgttaaagttactaatgaacgttgtttaccaaatccagtggtcaattctcagttctcaccttagctgatcctttatataatttgacccagttgaccacaactttcatttcaaaactttttctggttttacgcctacctcattactttctgatttactttactgattctttttttcgatttgttctcattatgttgtagttcaagacctcaatcctgagccctcccttatatttttccctctttagatgactgcattgagttttttggctttaaataaaatctgcctgttgatgactcctaaatatgtacctgcagattatatttatcttatattgtttccatctgtattagttatctattgctgcataaaaagttatccaaaccttagtgtcttaataacatctattatatcatactttctgtgggtcaggaatctgggcatggattatccgggtcctctggctcaggatctctaacaaggctgcagtcaatgtattggatggggcagcagtcatctcagggtctgattggggcaggacccactttcaggttcactcaataatggtttacaaaattcagttccttgaaagttgagccacctgcattttcttaccacatggtcttttccatagggcagctctcaaaatggcagctggcttcatcaaagtgagtaaacgagaaaatgtcagcaaaaggtgggccagtgttttataacttaatctcagaaatgacataccatcactctggccttattaccaagtcactaggtccatttctcactcaaaggtgggggattacacaaggtaatgaataacaagaggcaagggtcatatatggtatgataaaagcatctcaaactttatccaaaacaaaacgacttcctgacttcccaaactttctatgcccctagccttcctcatctcagtaaatggtagcacaatacccctttactctctgaccaaacctggaagtgatctttgatttctcttttactcactaaccatacccgatgtattagtaactcatattattgttatctacaaattattcaccaagtctgatgaccttccatcattacctttgttaaaattgtagtctaagatgatataaattcttgtctgaactactgcattagccttctaccttattaatatcttttcttcctttcttttgttccattatagtacaagtgaacttgttaaaaatgtatattatcttattagtacttgtatttgtctcctagggctgccataacaaattaccacaaacagggtagcttgaaaaagcagaaatttattctttcacagttttagaggctagaagtcaaatatcaaggtattagcaaggccatgctctcgcagaagtctctagaggttgattctttcttgcctcttcctggtttctagtggttaccagcaatctttggctttccttgacttgtagctacatcacttcaatctctgcctccattgtcatttggccttcctcctgatgagtgttagtttgtgtctcttcttctaaggatacagtaattggatttagggtacaccctaatctgttatgaccccatcttaacttgattttatctgcagagccactctttccaagatcacatatataggtactcagagttagaatttcaacatatctttttagaggacaattcaacctgcaacagtcccctaccttaaactacaaatggctttttactacaaatacaataaaatacaaaatacttactctgttaataagcctttacatgaattggcctcagcctattctttgtgtctcacttagttccactctcacccttattcaatctactccaaccacattggccttatttatgttgtacaactatgccaagcttgtcctgttcttatggcctttccatatgttttatatctttctggaatttttctcctgtatccacctgtgactgccttctcctcatgatttaagtcctaagttacagacaacttcttggagaaattaaaatagtaacttctgtactccatcactctctaccctcataatgtgtattaactgacatatattttttatttgttcactcatgttttccctggcaagaatgtaagcttgatgaagataggatatgggtctgtcctgtttcttcttatgtctctaataccctaatatctaggacagtgcatggaatatattggtcaatgagtttatgtccccattataacctaaaagagcaagatgatatgcataatagctaagtagattctggaaagtagaatgctaatttacctctgatcttctgaacttgtggaggtggtaagaactaatgtgtagtatttctagatgtggtgggaagaacagtcaatcttagaagtcaattcttagaactccaagcagggaaaaccatatgctaagtactgggaagttaagaagcaacaagatcaaacagacataaagcaatttatattctctttgaggagacagtgcagctcctgcaataaagcaggaacctcagatagtgaaaatctttgagctgagtgactatagccaatacctagttgaaagtcacataaatatcacttagaatttcagtccatgcagagactttgcaagcccacagtttccagagaaatagtagcatagtctgcaggttgaacattggatatagatcatttatgtcctttgtgtatatatttgcatcagaggtttcagaactgttttatttattattgactatttaaattattgtcagtagaaaacatagaacctaattttctagctgcatgaccttgggaaagatactctaaatagacaacaatagcatctacctgattaataatttctaaggattaataagatagtacatataaagtgctcagatacatgcctggcacatagaaagtgctcaacaaatgttggcagttattattaataatgcttattacttacaggcattgaaaactgaatgtgaaaaattagatatgaacttgtagataatatcacaattatctgtaaatgctaatgataaacaaaaatattcctgttagctttctggcttttcaaatattttactagcttcctattgctgctgtaacaaagtatcacaaacttcgtggctcaaaacaacatagatttattcttttacaattctgtaggtcgaaagtataaaatgaaatttatggagctaaaatcaaggcattggcagggctaggtcttctagggcttcaggggagaatctgttgcttgcatcttctagttcctagtctttgatggaattccttggctcatggctgcatcactctaatatccacttccatcatcatatggccttctctctaactttgacactcctgctactctcttataaggacccttgtgattacaatgagcccaccttgtaatctggaataatctccttatctcaaaattcttcactgaatcacatctacagagttccttttgacatgtaaggtaacatgttcataagttctggagattagggtgtggatatctttgcaagccattattctgtctagcacaaatgcagtcactatcttttaattttaacagttattttgaaacaaatacattctattattgctttttcctctataagaggattctattgacacattggcacataggacaaatacttatatttcttttccttgaagcttcagtggtcatgttctcgctgagtaacgctggggtgactatggagctcttttataaaaggtaactagtttttctgtgctccatggcctcagaatggaatttttattgtttgataaagctaattattgtgaatagtgattaaacttgtgatctgagggtaccagccatgccccagattatttggaacattaggagatatttttgcttgtgacaactaggtgaaggtgctactggtatctagtgaatacaggccatggatgctgctaaacatcctacaatgtacaggacagcccacctccccaacaatgaataatctatctcaccagattaatagtaccatgtttgagaaaccctgccataggcaattttaagaaacagtattattgcttgggcctttgcttttcaaaagtgtggtgcatggaccagcagttttggcatcacgtgggtcatcagtctctttgaaatctccccaagtgatcccaaaattcagccaaggctgaaaatcactgccttagcttttctcccattatcttaccctactcataagttgttatggttatggatatatagagtttaactggaaaaataaaactaaaaaatttgccacgtgtaacaaacatcatatattagagctctaattggcataaagccacctttttcttgagaattgcaataaataataaattcctcagtgtactgaattgtaaacacacagatatgtggtaagagtcaggtttatccaactattcgttaaatatattggcagggagaactcacaaaggagggcaaattcactcagctaggatcatgtttgcagcctgcaagagcgatgatggaatatatttgcttttcctccctggctctgtcacttgcctcatccaatctgctgactttagaacccaaaaagtttctttggtatgggcttttggagctgaattacagtggagggcatgatgaatacgaaaggcgtaagaaaggtgaattagaaaagtggcagatagaaactgtgtagtgtttttatttatgctctctattcttcagcacagtgcactttccattttagctagtcaggttcatccatttacagtattttttcttgtcaccaaataagtgtgagctctattgaatttcacagaattttctggcagtgtatgaaacatatcaatttccccagtaattcccagtaatttaagtttggaattattatacaaattaattcaattaagactacagttatcagcatagccctgttaatattctgtggcttataaaaataaaaggtaacatggatctaactagacaccaatgtttaagggtaatcatacattattgtattcaatgtttgcagtaatcctttgagatacagactattcatctggccattttacagatgaagaaaatgagatattagatattggaatgtcaagtattagtaatttttccaagtttgcatagctagtaagaagtcgagctgggtttcatatacaaggacttttactcctgagtgtgtgcacttaaccactttcattgtatatttcttcaggtctgtcttcacaggcaagcatcggctagtgccagggattttctaaactatattggttacattaggcaactctagattttgcaagggatgattccattgtttttaatgaccttgattgaagccttttcctagccactattcccctaagatgggtagtttctctgctttgccaaatctgagagaaagacctagtgtctcaaaatacatttagttgctcctgttgatgataatgttatggaaatggactttttctatgcacctttgcagttccactgatctcttgtttagcagccttgacagtgtctttatattgttgttcacatggtttctgattaaaaccccatgatactaagctctgactagaatacgaaatctaacccgaattagtttatcatgatttcttttgtttaatttcctttttaacattttattgaacattgacaattatacttgtatatatttatcaggtacagagtgatactattatgtgtgtgtgtgtgtgtatatatatatatatatatatatatatatatatatatatatatagaatgtggaaagattgaatcaagctaattagcgtattgctcatcttaaatacttaccttgcttaaactgtaaaaaatactttatcttaaagcatttattgactaacttgattttaataaatgaatgtagtattaagtaaattaaaaaagaaattaaaacttgactttcataaagatataaaatgaacttttgtcaaagttttatttacatcactaattaatgagggaactagacaagatgttacacctgacttgatggagttgtcaaagaaccacaaatttatatgcaataaaggaatattgaactcaattgaacacagcatgtctatccatagaacaataatcaattgcattctaccagacacaattaataagcatttccatggataagaattgtttgcattgctattagctttctagatgttcactgtatctttacagagatataaaatagcttattcaaaagcaaagttacacatataagatcagataattcccagaggctccacctttccatggaaaggatagctaataatctctcttgcttgtttcagattctcaaatgtttccttaaagtagtattaggtggatacatttacaggcatatctcttccacagtatacatttcattctttcaatcacagtgtgtgtgtgtatgtgtgtgtgtgtgtgtgtgtgtgtgtgtgtgtctgtctgtctgtccagaatctattttaattagattcagattgctaacctggtgttttttattagtgatccattaaagtggatcatatggttgaaaacagtggaagttgttgcattgagaaaatattttgcacaatgtgatttatcaggatgactcttggatttagaaacgtatggcttttacttgtagaattagaattataataaatcattcagattctggaaaaaaagtaatataatttgatcctttaaaaccttttctaatgaaattttaaagaggcataaatacatacatatttttgtaaaaaatagtgcatgttcttttttttcaaattagggaaacatagcaatgtggaggagagccaaaatcagtataattacttatgatagccagctcatgtgatctgctgtgctgtagtttttaagtcatttttctattattaatagtaataatattattcatactatggataattttctctatacagcattatattatgctttcatctcctttccatgttattttgactatttttgcaaattattaatttcagaagtatttgtgaaagctaaataatattccatcttacagatattctctacaattgttactagtcctctatattagtcaatagaaaatataataattatctctttacataaatctgtctggattaatgaatatttaaggtggtatattatttacctatttttacataacaaattaccaaaaacttagcagcttgaaactatacaaatatattatcatgtagtttctgtgggtcaggaatctgggcacaggttagctgactcagttcagggtctcacaagtgtgaaatcaagatgtcatctgggtcttaggtcttatctgagacttgaagtcctcttccaagctcttatggttttttgcaaacttgagggttttttttttatttatttttatttttatttttatttttttttgtggttttagaactgagtccctcagctcctagaggttgatggccattccctgtcacatggctgtctccatgacatggcactttcttgttgaaagccaaaaggaaataatctctgctacttctttcctctaaccttttctatctctaacctctagaaccttttttaaaagaccacctgattaggctgggcccaaccaggataatttcccttttgattaacttaaaggcacctgattagtggccttaatcacacctacaaaatccttctatctttgttatataatataacctaatcatgggcatgatatctaccatatttataggccccacccaaacttaaaagaagacaattctacagggtgtggacacaagggagtggaagtcttggggcccatctcagaatttttaccacttacagatggatttttagaagcaggatgattgattcccagtggttaagtattttaaaggctatatattgagaaattgctttccagtaaaactgtactaatattcactcccatcatcagattatcagcatacttgttttactatatccatattgacataatagtcatttaaataactttgattactattttcctttctctataattatatatgtatgaatatacaaaattacaatcatggcatttttgtgtgagaaaattttatttttatttgacaaattattttagtatatgcttttatttactatcagttttatgattgtaatatttagtgactgtatgtcttctaggtattacctattcacttgatttgttcattttctatattcattccctttgctaattttcccaatagatttgtaagcattctttatattatatgggcactagcctattgatgtgtatgttggaaatatgtttgctaatttatatttgacttttaactttccctatacaatttatatttttatgttctaaaaaacacaataaatattccatttgaattttgactagaagtgcatattcccattttggaaaaatttgacattttatgccaaaattgataaagtagtcaatattttaatcctggagcatattatttgcatgaatttataatggaataaagttttctaacttcttgtcaccataccctactactaataaaaattttacatttctctctttctaatatttacagtcactgcctaggaattccagatcaaagctaaatgaaaatagtaacattaactatccttgccctcattctttatattagtttaaagcacttcgtcagtttaaaaagaaaaaggttttctatatttttatagccataaccatgattttctattccttggaccaaactctgtttcttgaaagtttggaagtactcatctgtattgttttcttcaattaacatttttggagtttatactttaatagcattttgagattttaaacggttttgggtttactcgtaattttcttctgtttaatgaattttagttatttttatccccaatcatccattctgtaaaatttacaaatttagtaaaattcagtgttctaaatattttatgtcattgtatattttataacttcttcagttctaattttgtttatatcattgctcttttttttcttaatagattagagggaagtttcatcaactctttgtaatacaaaaccggttttgacagtctgttctttaagcactattggtttttaacctcctgaagcatatagtcaggacatcttgagagtcaaaccaaccctttccttaccagattcctgtacaacttttcagcttcacctggtgccacccagtaggtgtgccaattatcccatagtaactgcgcttactgctccagtagtctataggtttgcaagacattccacagcattttgtgttagattgctccacagtgaactccacagtgtttaattctcgggacaatatttaaataaggcacagatgcattttggataagattatttgactgctgcgtatagtattcttcatcaccttgtagggtaatctgccaagaagcgtatgacttcagatttttattgataactttggttttttagtcatattgtgaattagcttttggagatcagtttagaagcttggttgtaagatttggaaggtcaacattcccttgtcagagaagcgctataggaataaatggtcttctgtttagaattgtgttaaaaagaaaacaagcaaattcccacagagttttgtcagggccaatttagaaaaaaattatcttggtgacctaaaacttgttttcgatgatctaaatgtatccccctccctactccccaactcatattgaatagattgtcaagtatttagctttattttcatcagtggttttccaaatggaccatgcactctttctgtcctactctacctgtaatctcttgcccaccatttatttaaccctttctaccttagtcattaatgaactccctcttctgcttccaaagtcagcccaatgccaccctcttctgtgaatgttttcatgacctatccaggctgcactgagcactttccatggattcttgagaagtcgtctctcataacatgtatccctttgctaaaattgttgatttccatgtctctcttccatgtaatccttgccacagtgaccatttcctaatcattttgtacctcagtatttagaacagcatctgcatcatgataggcactccataattaaaaaaacaaatgtatacataactttataatttgtgtttaatttcctcaaggtagtagccaaagcttatgatttagacacaagtttccctgtgactaattgtaaatattgtgccttttagtaacttatggttgcagagtatctaagagcttctgtttatcctctccccaggaaatctatctcataacatgcatcgctttgtgtaaattgaactcttggaaaaatactttatccgtgtcaggcacaaatggatacttcaatttttgattagagtgaaaaatggttgctttaatcttgaatatagtaatggcaaaactttaaatattaagtaaaatatagtgaatcatttttttagcataggtaattactacatacaagccaggagtggaaagaaggcataagaaaagagctagcattagaaaatgtctataattaaatgtcattgttaaacactaatagtcaccataaagacaagtattttatttaaggcttatgaaactttgaagtaggtatttgctacctcaacatgttgaggaaaagtaggtaaaaactgaaataaatatggcagatacttatgtccatgctttgtaggtgagaaaactggggcttataaagatgaagtaacttgcttaccttaacatacagtaaggccaataatccaggtttttctgattctaaagcgtattctccctgctttatagttaagaataaaacaaatgagtgcagcttccctccctttcacttccaaatttacctttatattcacccatttgtactttattttctacctataaaaggagtctcaacttccccatactaatatctcttccttctagattctcttctttcctctgaatctcttttgcctcagtttacatatgtcatccagaattccccagttaatcctcaacttctctaccctgaattgtggattccacatccacattcaaaacacattgttgcttgttttgaatgttgtttttgaaaaacattcaaaaacaagcagatgaaacctagtttccaccttggactcttttgattatgcccacttatactcctatttgtgtaatgaaaagactggtcattagcatcttaactctgataccagttgtcttttttatttcgagacaggatctcactctgttgcccaggctagagtgtagtgaaataatcactgctcactccagcctcaacctctggggcttaagtgatccacccgcctcagcctccccagtacctgggactacagcatgtgctaccacacctggctaatttttaaatttttttgtagagatggtggtcttactgtggtgcacagactggtcttgaactcctgggcccaaatgatcctcctgccttgacctcccaaaatgttaggattacaggcgtgagccaccaacgctggcccagatgtctttttttattctcacaatacacaaactctcctgattgtatccttaaatatccttgcttgcttattttacccagtattttctgattcacactccctctgtggcttgcttttctcactttttctccctcttgattcattttgcctgtcctataaatatttgtaagccccagggtggataatgtgagccttcttctcttctttatctgtacttccttcttgtttttcctaatacatgttcttaacttcagctacagttacagtgttgtgttatcttccatctctctactaagctcctggctaatattttaataaactacatgaaagttttaacagggccagtctaattaaataggtaagcatttgtttcctttattggtttgtgagcctttttgattagactccattgcattgtctttgtgtccccactacatcatagcaaaacatcttgtaactagtgtatgctcaataagggtttatcaaatgatgggtttaaatatcaaaattgaactgcatataatagcaaccatatccagtctttcattcatttatttttttccagctagtattcattgagcattggaaattaaaagttgcataaaactcacatttacccttcaaggccttccagtcaagtagaaaactgggatacacagaaaacttgatagggaaaggatgtgaatattagtagtatgaattaattggtagtacttacaataataataaaagtaataacaattaactgcaataacaacaataaaaacagaagctttgcctgtaatctcagcactttgggaggccaaggcaggcagatcagttgaggtcaggagttcgagaccagcctgcccaacatagtgaaaccccatctctactaaaaatacaaaaattagccgagtatggtggtgggcgcctgtaatcccagctacttgggaggctgaaagaggagagtcatttgaacccaggaggcagcggttgcagtgagccgagatcgcgccactgcactccagcctgaacgacagagagagactctgtctcaaaaacaaacaaacaaacaaaaatcccggaagctttgatttgttgttctttcaatgtgccagtgctgttctaagcactatgctatatatactattataatacttactttgcaaataaagaaactagtcacagagaggttatttgttccaaatcacagtttataggtggcaaagctgggatatatagactttctgctcttaaccattgtgatatgctcattctgcataaggtttagtagtggtttatgtgaagccaaatggtgaatggtattgacaggaaacaggcaactggtttcaggtccatttatccagaaattgaggcctcttgaaattagttcaccaatagtataagcaataagaaaatatgtgagaacctcactaaatgattatgtacagtttgtattgctatttctgggtgcaaattttgattatgcaacaaggatagcaaaacttggatgtctatggctagatacatttaatctgttttgcaatttaagacacaataaacttcctcaaagaagtttgtaaagattattatagattgaccaagatgttaagtctgtgaaattctatggatttctttttgtgttccctaatacataaagtttcaagagattcagttaaggatcttgatattaccaaattgatgctttccacacatattaattttaagaaatagaattgcaaactagcctatatgctttatagaaatgaaatgagtaaggaaatagtattttgaacaggagtaaagtaataagatagttgagctgaaaggtcttgcagtgtatagttgggtcctggagtttcttgggcagtgctgattaaacttacacagagaagaactgattctcacagctaacctgaaggctgaaggtgtcaacttgaagatttcctgcagctccagttagtgtggtggctgggaaatggtattcgggttttaggaatgcatgactcagatttgtactttaatgtggcagttcatcagatgtgtctgatgaatcagctctttggattaggtttcatttatgtctttatgtaaacttaaggtctttggatagaaaacttaaacagattgtcatcccttaaaggtgccgccattaaaatagattattttccatgctattacaaattcactgattttctgaataaaatggtgatggtgacaccttgccacaggtgaatggattttgcttttgttttgtgaattaaaatgtgttttaacagacttattaatatgagtaaattaatcaattaaaaccattcagaagtatctgaatgaggctctgggagaacccaaaatgtgatagttttggcattttcatctttaataaagttatagtgattgagagctggattgatcagtcctcaagtgtcttgcaaagaaaggtgtcctgtcataagtttacaatatatttgaactgtgttctgatttcccactttttgaaagtcggtctttcagctccactatctcagtcttatacaaaaagaaaagaagcagagagtagaatggtggtggccaagggctgggacaggatggggaaaaatggggagatgttggtcagagggtacaaacttgcagatatacaatgagtacattctggggatctaatgtacagcatgttgactataattaatgatactacattgtatacttaaaattttttgagagtagatcttaagtcttaccacacacaaaaatataacaactgtatcagttgaagtatgtgttagctaactttatagtggtaatcatttcacaatatatatgcatatcaaaacacactgtacattttaaacatatccaactttgtgaattatacctcaataaagctgagacacagaaggatgattttctgaggaagacaatgttcgtttatttaatttcaaatgaaatatttctcctttagaaatccaaacacactaggttagtgtcccttcttatattcctctgcaagccttataatagaaagaaatgatttttgggtagtttcgttgagtgttgtttcttcttcttctttcttctttcttcttcttcctttgttgcttaggctgtagtacagtgacacaatctcagctcactgcagccttgacctcccaggctcaagccatcctcctacatcagcctcccaagtagctgggcctacaggtgcactccaccacgcccagctatttttttttttttttgtagtgatgggggttttgccatgttgcccaggctggtctcaaactcctgggctcaagggatctacccgcttcagcctcccaaagtgctgagattacagtcatgagccactgtgcctggccagagtatacattcttttaataaaaacaaaagtcttaaaattatcttacaatatcttttagaggtttttgaaagaaaattataaaatcacgattaaatattttgaggcagacagcttatgatttaatctctgttggaaagaatgacactgaataaaaccacattctattgcagcatggaatgttaaaaatgtcagtttggatgatttttattaagataaattgttagtgaaataattcttttgacgggattgtttccatttatttaaatacaactagggcgtttaaataaaaaatccaaaacctcaagtgaacataagattttaaagcattttgggggtgagggctatggaggcataattttggtattaccagtttcgatttaacttaggaaccacaacatatgggaaaatataatagaaatcctggttatattctttccttttgtgtaattcattgcaccgatcatgtttgatcaaagttatgaaactctaataatattgctatctatttttaaaacatgtatgtttttcttctttttaatctttgctttagggaacggcctttaagagctggaagatgaaagctccgattccacacttgattctcttatacgctacttttactcagagtttgaaggttgtgaccaaaagaggctccggtaagcagtattcctctattttttatgtgtttttatagcttaaagtgatagtgctacatctacacatgtgccattagtggaaaagttgagaatgatcagttatcaatattgtggagatattgtagatattatgagtaaataggtggagcacactcatagggaattaggaaagtgagagtggattcaaaagaatgtggcttattttatcgattactatgaattggcatggattcaatagcaaagccttgtatttagatttcattttgtggtaggattttaagtattcttatataaacagtgttatttaattttttgcatggaaatattattgtatctttgatgttaacttttattgttaccattttgatgtcagctatacttagggaagattcttttcagggttgtactccagctgatttgatgaattgcttggaagtatataaagaaaatactagtgttattgaagaaaatgtcatgaggaagcactaatattttaataggaaatatagaggtaaagtaggatggtaatgaaaggaactactaaatagattaatgttggcatttatgaaaaactttacatgttatcaggcatcttggtttgtagtggactgttgatagttcaattgtatgggacaattgaataaataccattatcaatgtgaagttgtatcttgtctagtaagtcactaataatataaagccttgccatgctcacactatgtggagtcacataatttttgaagttatagcttttaggtatgaaggaagatgaagggtattgtgttttgttgctagaattagaatgtattgtctgttagttctagagagcctgtgggaaaaagaagatgagataatgtacaagaggttgcagtgttgtgatataagcaattgcatggacaaaagcatctttggagttcagaaaggaaagggaatgaaagggctgagatggggctgtgaagcaaacatcttaaccatgaggttaaaaggcttcaaactcactttgatgatataacgaaaaagcccacatgcaggggaaatagggagcagctctgctctcgtgagcccctcctggggataaagtctgaagggaaactggggagggcattgtgcatggacaaaggtttggtgcatggttgaaagttaaaaaaaaatactgagactgttggttctagcatatttggttattatacagctgttgtatctgccattgatgtggttataggcaacgtgaaaaaaatactgttgttatgtctacacattatttcatctcttcttctcagtggatcttctgaatgagataaaaccctagggcaggattatgatgttgtggtttatgtaattcaaatgggttaatgggaaataacatatatcttgatttctttaattgtactatgctcaagtacaattgagcataaccaagagagttagagtaggtagaaagaggggtaaatagtgatgaaagctgataatttttacaacactgatgttttctggaatagaaatttacattaaaatcacttaagataggtttttgagatagtagctatatataagagaaacactcatttgtgtaagtattataacaaaatgacaatagttcatccaaaatagaaatattgattaattctttaaaactttatttttctggttattaccactaattatataaaatctgtttttttttcagttctttctgtgtatgtcagatctatgatttatttattcaaatagaaatgttactcctttttaatcataaagtaatggtgataggtccattctatataacctctaatttgggggcaagaaattttatcaaactgggacttactttgtgtgtttgagaagcatgagagcagagctagaaacatggggcagttggaaaatgcaaatttaatataaatgcaaatattaaaatgtctcaaaaatctatattaagtgattttaatgtaaattcctattctagaaaacgtcattgttgtaaaaattttctgctctaaagacctgagaaaactcaagaatctgtctcaaattcagttttattttaattttgtaattatttgagaagaatggtaataagatgctgtgctaagctaagcagaagttctgagacctttctctcttcagtttatgaatgcagttgtcacgtaattatataataccttctaaaccaaatgtgttttctatattataatgtaaaaatgacaaggcaggtactgggattttgcagcatgcctgatttgtttacttttctatatgatgtgaattaacataccttccttcccctagtgtctatattaagatccagatggatggaggcttgtttgtttgtttgatttttggatattaagtgtgcactttgggaaggaataatattattctatccacatactttcatagcttggactgatttcagctgatgtctgttcctgtggcacctttgtttgaaggaagcagatatgtagcttactgaatagtgtcattactcatctccatacatcaagtagaagaggagtgtagttggcatcttttccttgaaagattaatagctcaatcttcatacccagcccaacctataaaaccagcagcaccatggccaggggataaaaatcaatttttgatgtttgattttacgtattaaccaagaggacttcttatctttcttcttttgtcttatcatttaattctcttttgattctttattttattcatctttttgaaaggtcagtaaacatgactcaaaacccaatgcttttcatgtgtcttttactagaatattatttttagttcactgtgaccactagaaaaccagaactagatattttaataattaggaacatatacaatattatattacacagagaaatattgatttttaatggcatgttaattttgtagagtgtttactttagattaacacatatggtcattccataaaagtagatattgttttctcattaacagaactaatttgaaagcaataggaggtcttattacacaagctggaaatgcattatttttatcacattggcttacagtcccatcgctgttaatttaaggaacagattaaatataataaggcaggccgggcgcgttggctcacgcctgtaatcccagcactttgggaggccgaggcgggcagatcacgaggtcaggagatcgagaccatcctggctaacacagtgaaaccccgtctctactaaaaatacaaaaaaattagccgggcgtggtggcgggtgcttgtagtcccagctacttgggaggctgaggcaggagaatggcgtgaacccgggaggtggagctcgcagtgagtcgagatcacgccactgcactccagcctgggcgacagagcaagactccatctcaaaaaaaaaaaaaaaaaaaaaaaaaaaaaatatatatatatatatatatatatatatatatataaaaaataaggcaattatatcattataacattcttgattgaaatattaaaatgcaactttataacattttgttttaaatatcacttcagatatgtacaatatgtatgacaactaaggactatatctggtctctcaggtaaagtcctaaagttgtgcctacatttagaatgaagacttttaatatctatggaagcacatattcagcattcgttacacaatagattttatcctgggacaatttcatacctattttttttagtttttataagtagcacttgatgaaagaggctaagatgaccaatattaccaatccccgtcaagcatgtgaaatattatagcaattcagtaagtaaacatctcggttgctgtcatttttagaattctgaaaaaaaatcccccacatgtaaagcaaacgcttgcttggagaatctttgtatctcaaccagttgaggaaatttagctttacattcttgtttgttggtccctttcttcattccttcctcccttctttccctttttgttctttccttccttccttcctttcttcctcccttccttcttctctgctagtatatttatctgcaaataaaaataatttattttcatattcccactgtgtcttggtaggacttttcaaactataaaaatattattattactttgtctgcatggttgaagtatttgaaatattctatctttacaaggccattcaaagaggttagcatagtctttgttaataatagctattcttaaatatatacattttaaaatggtgtataagaaaatctgcagtaagatttgggagcagggaaatagtataaatagttgaaggactgttatggacaaagtatgactatagcactttgcggggactaaagtgtgagttgtaatttgcctgaaaagtttgggatactgaagaaaaatgaagctagaggggtctggatgtagaaattaggtaagagaaggggttccatgatgtttttctctcaaaaacatcctcagaatataagatggtgagtgcaaggaccatgattaatgtatgcttataatctctacagtgccaaatatgctgtttcagagtcagggttcaaggaaatgtcttaatgacttaatgacttaatgactgcatgaatggttgagtgagtggttttaataatcagagttacatcagtgaggatgctacaggaccaaaacgatattagaaagataaaggtaaaattaaatagaggcatttaagaaaaatgatttttttttcttaaagagcaatcagtataatgtataatgtgagactactgaagcaaaagatataacccggaataagcaatatctaggacataataagggtttagatgaagacaatgaacctttacaaatggggagtgttttcatgggcttgaaatgcagttcaaaatctgttaaagggtaaggaaaatgattcttcgagtatttttctattggaattctactacgtttagtgccgctttaaagaagtactaatgtcattgtgcagaattttgaatttaatggtattgttccataatggccattatgaaaaggctgtagctcatgattactaatacaggataaataagcaagtgacttcagtataggaaaaaagtattcacagttattagaccatatggagaagagtaagtggctgcattaccaaaaagcacgttattttaggaggaatttcatctatataaaagctccctaaagcatccagctattagagagtaaaagggttaccaaaaggagttgatcttctcttcattctagaacctgacaggggacacctgtttgtgtaaatgatttagatgcaattcttctagacagcaagaggaaggcaagcctcaaaaggttttcctaaacttgtgactctaggcccaaataatttataaaaggtaagagtagtcaaataaccaaagacacagtttcagttctaatttttgtgttgttatgtatggatattcatttaagtaaaagaaattatactactgtgtaaagaaagcgagatttaactgaataggaatgagaaagtctagtgggggtacttccatctcatgtcaatgtgatttatgtgcagctgctctcttgagcattcctgtaagtcaatgagcttaatttcacatgattaagagacaacctagtcccccagcatctgccttttattatgttaccatgtgtttattctcagtttgtcaaatatgtcaaaaaagataaggtgtttctccttattttcctttggggtagcttataagaccaaacttctgggactttgtttctttaccttttgaagttaaaaaaaatgcactttaattttttctcaggaaaaaaaattctcctatttattgtaatttttacaaattttgaaattagatctagagtaattttaatattcctttgaaattatgtccttaaataaaataataagtctaataaaaatggaacttgcacctaacaaacaaaataaaattagccaatgtctttgtttagttatatctatgttctgttatacctatattctgttatacctatgaatttccccacaaacttacccattcagttttagttgtcagtataattttatatagagttggcacagatgaataccaattgtggaaaatgatgcctgcttcatggtgagttaaggataaaaggcagtatgaatgaatcttccaagttgactaagacttcaatgaggaggagaatattccaagttaataagtatagtattccaagttaatccaacttattaacttggaattcaaactaattaacttggaatattattattattagttgtattagtattccaacttattaacttgtattccaacttattacttattattgcttataataagtaataatattcaaagtatcataagtatataagtgtggtactgtattatgagggtacaaaataatatattgttctatgtatttgatgggagaggtgaggaatagagggaagcagtatagaagctggcaaatggtaggcaatataagtttgttagagaaatgatgttcgtattattccattttcatgctgctgataaagacatacctgagactgggcaatttataaaataaagaggtttaattgggctttccatatggctggggaagcctcacaatcatggcggaaggcaaggagaagcaagtcatgtcttacatggatggcagcaggcaaaaagagagcttgtgcagggaaattcccgttttcaaaaccatcagatcttgtaggactcattcactctcatgagaacagtgcaggaaaggtctgcccccataatttaatcacctcccactgggttcctcccatgacaggtgggaattgtgggagttacagtttaaggtgagagttgggtggggacacaaccaaaccatatcattccaccccggcccctcccagatttcatgtcctcacatttcaaaaccagtcatgccatcacaacagtcccccaaagtcttcactcatttcagcattaactcagaagtccacagtccaatgtctcatttgagacaagtcaagtcccttcggcctatgagcctgtaaaatcaaaaacaagttagttacttcctagatacaatgggggtacaagcattgggtaaatacaggcattccaaatgggagaaattggccaaaacaaagggactacaggccccatgcaagtccaaaatctagcagggcagtcaaatcttaaagcttcaaaatgatctcttttgactccatgtcttgctcatctgggtcatgctgatggaagaggtgggttcccatggtcttgacagctctacccccgtggctttgcagggtacagcctccctcccagctgctttcacgggctagtgttgagtgtctgtggcttttccaggcacacaatgcaagctgtcggtgggtctaccattctggagtcttgaggatggtggcccccttcttacagctccactaggcagtgccccagtagggactctgtgcgggggctctggccccacatttctcttctgcattgccctagcaatgattctccatgagagccccacccttacaccaaacttctgcctgggcatccaggcatttccatacattttctgaaatctaggtggaggtcaccaaacttcaattcttgacttccgtgcactgccaggctcaacaccatgtggaagccaccaaggcttggggcttgtaccctctgaagcaacagcctgagctctgtgttggtccctttcagccacagctggagcagctgggacatagggcaccaggtccctagactgcacacagcaggaggaccctgggcccagcccatgaaatcacattttcctcctaaacctctgggcctatgatggtgggggactgctatgaaaacctctgacataccctggagacattttccccactgtctcggggattaacattcggttcctcattacttatgcaaatttctgcagccagcttgaatttctcctcaaaaaatgggattttcttttctatcacattgtcaggctgcaaattttccaaacttttatgctctgcttccctcataaaactgaatgcctttaacagcacccaagtcacctcttgaacactttgctgcttagaaatttcttccgctagataccctaaatcatctctctcaagttcaaagttctacaaatctctagggcaggggcaaaatgctgccagtctctttgctaaaacataacaagagtcacctttgctccagttcccaacaagttcctcatctccatctcagaacgcctcagcccggaccttattgttcatatcactgtcagcatttttgtcaaagtcattcagcaagtctctaggaagttctaaactttcccaccttttcctgtcttcttctgaatcctccaaactgttccaacctctgcctgttacccagttccaaagtcgcttctgcattttccggtatcttttcagcaatgccctactcctggtaccaatttactgtgttagcctgttttcatgctgctgataaggacatacctgagaccaagaagaaaaaaaggtttaattggacttacagttccacatggctggggaagcctcacaatcgtggtggaaggcaaggagtatgtcacatcttacatggatggcagcaggcaaaaagagagcttgtgtagggaaattcccatttttaaaaccatcagatctcatgtgactcattcactgtcagaagaacagtgcaggaaagacccacccccataattccatcacgtcccaccagattcctcccatgacaggtgggaattgtgggagttacaattcaagatgagatttgggtggggacacagccaaaccatatcaatgtttattgtagagatagcatacaggcattcactgctaggaccagaggattaacccctgatccactggtggtcaactataggcttgcacgtgatccataaggtggcttggaaattagggacactggtgtatcagtatcttactgatgttttaacaaattgctacaaatatagtgacttaaagcaacacaaatttattatcttacagttcttgaggttctttatcatcacatctcctctgactctgacccttctacctctctctttcccttataagggtcttcattattatattgggcatcctcagataacccaggacaatcatttcatcttaaaatcatgaatttaatcaaattggaaacgtaccttttgccatgtaatatgacatagtcatatgcttcagggatgaggcagtagacatctttctagagaacattatttagcttactgcaactggcaattagccaattcaaacaaactgtctattgaatgcgttgaagactagagcaagaattgtcagccaggagccagatgggaatggaagagaaaagaacagggaagttgaaaacttttgctgaagggcctgtgcaatccatggtgcatgataaaaggtgcagagggtttgtagcaaaagaagaaaagggaaagaaaacagggcagagggaaaggaaggatgagagatgcggaaggagaaagaggaaactgatactagtgatgctttggatcttaagaacattttaagattaatctgcactccacacatatactttcaaaaatacccccttttctttgtggtaggctaaaggcgtctgtgttcctttcaacaaagtaatacctgacctgaaaatgatttccagacgtaaagtaatagcagtgagaatagtgaagacagaagagagagcaattttaaagttagactcaattgaaatagatgatcaattagatgtgagaggttataaagaaagaggtaaagaaaaacattctgtaatgagaggattgggataccatccatcatattaaaggtccccaaagcacagaaacttgaaatgactacttattgaaggaaaatagtaaggtctttgtgactaagatgaagccccaaatgtagattgaggatagaatatgagggattttgaatatcttgcaaggaattttagattttatcttgagaacaaaatattttggctgagatatttaataactttgcaaatccctttagtagaaaattcagtctgggtggttgggcctctgatttgatagatctgttcattgtggtgtcttctctacaccataaagatgaaacttcttgctttgtgtatgatggtgttacacacatttgtgagtccatcagtaaagctgcctttgcagagaagggaagacacacaatcaaactatgtaggatcatacatgaaaatggcatggtcaaacctggtgtttgacatgtaacactccctgtagaaaagactagggtgggattccagaatgaccagtaagggactcgataaaaatcgtatttacatatactgagggcctgaaaagcaatcaaaggcactgaaaataaatttctgaagaatatataggatctagtgagtgtttggagatgaattgtgaaataattcgaggagaggttatattgatggtgtcgccaattacagagagaagatgaatggcaatttttgcggggagagtggatggaatgaagtcaattcggaacatacaagctgtggtagtcactggaagtattgagctaatggatttattggtctggaattgtactagtttcctgtggcttctgtaacaaattgtcacaaactgggtgacctaaaacaataaaatttattgtctcacagttctggaggccagaagcccgaaatcaaagtataagcagggctacacttcttctgaaggctctgtgacagaaaacttccttgcctcttccaccttctggtggcttcagttttccttgggttgtagctgctaccatcttcacatggccttcccctctgtgtctttaatctccttctgcttttctcttataaggacacctgtcattggatttaggatccactgggaaaatccagcatgatctcattttgagatctgtaaccttaattacatccacaaagattctttatccaaataaattcatatgcacaggtcttggcggacatatcttttgggggaccactgttcacactgcaaatgtcaaagcaagaggtatggattttgaaattgtcctcatattgagagcaacatgatggaatgagattatccagggaaaacatgcagagagagaagaggaaaagaaaagggaaagggtgaggatcaaggattctgtggaacactagccctgaagaggctggcagagaaagagcagccagtcagggaaagagactaagggaaagctaagggaggaagaaagagaccttacttgttttggttcctgcaaaccaagagtggagaaagtttcaaaatgaaagaatgatcatgttacattctttggaaagttgtgtcagataactgaaaatacgtcattaaatgaagattcaggaaaatgtaggggtggagagacaacggagtctgaaagaagttgatgtcaggttttaaaaagtatatattgtacaaaatcagtatattaaagggcctttgcatattaaagggattttatttatttatttatttatttatttatttatttatttatttatttattttgagacagagtcttgccctgtcgcccaggctggagtgcaatggtgtgacctcggctcactgcaacctccacctccagagttcaaatgattctcctacctcagcctcctgagtagctgagattacaggcacccgccaccatgcccagctaatttttgtattcttagtagagacagggtttcaccatgttggccagggtggtctcgaactcctgacctcgtaatccgcccctgcttggcctcccaaagtgctgggattacaggcgtgagccaccacacctggccagggattttactttttaaagtttgtttaactgtttagaaattatgctttttctatttaggtaaaacgagtataaaacttgtggtcatccatgctaatgaaaagaattgtacattagtacagatataatagtatagataaaattttttccaatcaaaaacttctttttttttccaatcaaaaacttcttttagcaagaattaaaacatgttttgccatagataaacctcctgaaggaagggtgatactgatttaattttcgttttttcatttcataaatacagatatggaagatagcttacaagtgtattataattttccacggttaatcttcatgttaagtatcgtaagttccaggaaaggtctacagacagctaatatttacactccaactttcattcacagtgatgatcacaaaaattacatctttttagttagtatctcagaagtggcttacattaatctgatgagtattatattaggttggtgcaaaagtaattgcaatttttgccattactttcaatggcaaaaaccgcaattagttttgcacctaccttataatacccacagcagtggaaattaaaacacttgggtttcaatgcagctgctaacgagccttgttgattgggaacatgtccctaactgaagctgtcatatctttggtttcctttttcataaagttttgcactacaacattgtccatacaaataatagttcatctttttgttcctttcacaaatatttattgagcactttcaatgcatactaagtatatacctgacacttttttctgtaacttattttacatgtttgcaaattgatcacacgtttaaaaaggcagagtttgtgaccagagtacctgaggcccattgttagctacatttaactttgtgctatacagtttgagtcagcactacagagtggaggatgttattagcttaaaacaaaggttctgttaagagaaaaaaaaattagtttttatttctttttaaatagcacacagtatatcattagaaagccaaattaaaaataagatacttctccttgcatgtggtgatgtgattaagtaaaatttggtttgtcagtttcaaataccaaaccatgttttagtctatttttgcttatttaaggcaaatttctttttgtagagttatggtctcttaagacatctatgcaagacaccttgcatgggaaatgttgccttaaggcgatgacagtgaataactttgccaagttttaaaatctctgagggttatatataaatatttcttcaaaaaatgtcagtgagcctcttgtgagtattctcaacactattcaattgtcatttatgttttactaactgtactaaaatatttccaaattagttttgctaccttgagctcaataaagtactgccattggcatcttactttaagttcttaatgcatattccacttattttgtattccaaatattatgttgtaaatagtaaagaaaaattattcttatcaatgatgaagaaagattttcatactctggtgcattaatatttttctgaaatatattgtcatatcagaaaaaatgcaactatctgaaaagaggattcttccaattttttctataaatatgttctataaagcaattgtactctccaatgccatcttgtggctttttaggattgatgaaaatgcggtaataaacacagaacacagggagaaataaacatgggaagaaaacttctgatgaattattgctcagtgattattttacttgatcttaatactgttcaaacatttatttgccctgatttattgccttaggttttataaagagtatatatatatttctcctatattttgctacatttttataatagaaatgttcattgagatcttgtaaggagataaaaatatcgtatttttatgatcttagcatcatgtccatttgtagccctatattaccagaattcaaattattttgacaagtgcattgatattatagacttattaaaaatcctcttttaatacattgctgtcattaaggtcttgtcattttaataattcaggtgtcgaaaggagaaaaagtcattaaagattttagttgctcactattataaataagagctgctgagaagaatatggaagtgaagatcttgtgtggatagatgtgtgcttcacgacttaggttttcctgctggtctattggacaggccttggaataggagatgggagggcctaggtagaatcaagctaaatggaaagcactagtcatcaggcaaagttaccttgaaaaagcagttacttttatctgcatgtcccaaagaatgaagaccaagagaaattattggtcggcaatgttttgtttttttaaagtgaaaaattttcaaagggtcttaacagttataaatgcgttttcaaacgaaaggcatataatacaccccccacacacgaaaatattagcatgctaccaatgttttcaaactttgataagaatatttttcctgttatgagcactcatctaaaatatgtacaactgtacttgattacgtgtgtttcttttaggattttatgcatggaacctacttcttcttaaaggacaaagtaacaggttgtgtacaccaatgttaacaagcatttattgaattcctagtatataccaagtgcttgataacattgattcacatcagctatgcctgggcataaaaaaggttaaaatgtttagatatttgtttgtagaaacttgccttttgtattctttatttaaaaaacaaacttgtggaaaattttattaatagaaaccaaggcaatatgatttatctttattaatttgatcattcttagttttctatacctatgaatcatatcctgaaaattgtttatataatttcctcataactttgctgatttttttaagaaacatatggagtgcttatttttgtaactgcatgcctttttactttataaaatccatgtatctgtcatgtctttggaactggtggtgctataggcattgtcctttcatattcactagtcagttctaatttattctttgtatttagcaaatgttttcagacaaaacatactgtaaacaagcaactggactgaattctctgggggattaaaaaagatgaacaatctaccacctctgctattaaataccttgcaaaaaataagtgatatgagatatcatacatgtatagtatattactttcctattgtagctgtaacagatcaccacaaatttagtgtcttaaaacaacacaaatttattatcttatggtgatgaaggtcagaagttctaaaatccaggtatcagcagggatgcattcctttaggaggctccagggaagaatctgttttcttgctgttcccagcttctagaaaccacctgtattacttgtcttgttgctccttcctgaactcaaaatcatcagcatagcatcttccagtctctgtaacctttacttctactgtcacatctccttctctgactctgactttcctgcctccctcctgtaaatatccttgtgattacattgggcccaccactttaatccagaatgatctctccatctcatgatccttaacttaatcataccttctaggttccttttgccacttaacagtcacaggttctaggaattaagatatggacatctttggagagtcattattctgtcaatcacagtggtatattagagtagcttttacataaaatagtttgatatggatggaatacatctatatcagggcacagtacagaataagtgatgagggagtgtcaggagaaaaggtggaaaaagatagatgggagccatatcacaaggactttgtatgacatgacaagaaatgctaatattatgctctaggaagtcaggaaccattgaagaaattgcagcagagcttagtaggaataacctgaccagatagattggaaagagctctaagacaagagagtgggaaatgaggccagtagtccaggtaagaaagtcatgaactgagccagtaacagcaggaataaaagaaagagagatggatttgattgctagtaaaaactggaagtaataaaaactagcaggtgattgtacagtgaagagagggaggtggaaggtaattccagctgcttttattaagttaaaaattctgttgagaactagtagctaatgttatatttctagtctatatttttcctggtcaaatacatttttgggttttcaaaatgatgtatcttttgcagtgtggattccgactgacaaattgtacatctgaaataaaaatctgcgtttgggtccactgtagggttctttcaaatgtcttctacccttgtgcctataatgaagtattgtatcaatgggtcttgccttgataatctcagtgaagaacttcaagttaacacagggagaagctttttatttttttaagatgtcaagtttcttttagtatgtagtgctaaattgtggtatacctacatgcatacacacatatgcacatgtatccactcaaatatacacacagttaactattaattcacaaaacacacttgtattgcagctttcctatatgccagttgctgaggattcaaaaacaataagaatatatgatcgctgcattttaaaaatatctgttttatttacctaactaaatagtataagctcgttgagtataaaaacatctttatccgtttttatatgtatacatatatgtatgtatatatatatatatcttttgtaatcgctatgcttaaaagagtcattgcataatcagtactcagtacatctttgtatttcatttctggatttaagaacactgaaaaatctcatcacagcactctctattttcctgtggcaatgtacatgcatgtcataactcttctctgataccagaaactccttgaggaatgatctctatataggttaagttcattaatgaggctttacacatagcattatttgaccaattgttatataagcaaatgaataattttaacttacatgaaatgaatagtttcattagagtttacatttctctgaaaaggaggaattaaagctttatttttagttggcagggtgacctgaccattcatggttattgtgtataatcccctgctgaaattgtaatagctgaagctgaaagcactgagactatactggaaagtgaatcttgagatggcactccttctttagctccaaagggcaaattttcagttactttgttataataggaattgtgcagcttttgcctccttcttatctttgagagattttgccatgtctgtacatatgaaggtcattccatgaaggaagagcagatacacaaaaggactcctgcatggaagcgtggctggaaggagtaaggcattagccaaagcagctgctcaatgtctccatgtctctcagaacggatcataacaaaccctaggaatgctggtgaatagaagtggcctacaacattgagggtgtttaattttaattcagaacataaattagttcaatttggcaacttgcgcattcattctgccactctaactgacatgctgctccgtgatgaacagtgatgacttactgtttgtttcaaaggcatgttttcgctttctttgggagacgtgcttggtttgttttgttcaatttttaatgatacatgattttattttaaatttctttggaaactgctttgtatcctagggtttccggcttcctgtgaattgaggagaggttattaccttctaagttttcaattaggaaaacaaagcaagtttggaagctccgttgggaccttgtaaaccctctcaaagcatgttctgaaagagacaatttttgtgcaactagctctaattgtctgagatgagactatctacagaagctaattggagagtgtctcattctgcagcatgtatggagtcagcagaatagtaattttgctttcttgggttgtttttcctttttgttgttgttattttgttttgtccacacttcctttcagtacctagcattttaagataaatctttctcaatttaaaattacttatctctaatggtaaggctcaggatttccatatagacccttcccaaactctgtgtaataatgttcctaaatcctcaaccattctttagacctaatatggaattagtaagcctttgatggacttgtattcccttttgctttacctggatgtgatattaaattctgtttcaattttaatgtttgtgttctgaattacagctggtaggtacagaatagtatttatcacattttctttcttatgatcaccacctgagtgattacgttgttgacatattctgaattagacaagaacatatgctcaactaaattgatgccttacatagaaacttgcatataatgaatttcatttgtgcagttattttaatttttgattacactttttggttttagttttatgttttctcatgcttctctaaagctgttccatcatgacttaaaaactaagacttctctgaaacttggaaatttattatgcagatctcataattatcctaactagaaaccaggttcaatataattaaggaaaaatatttaaactttatagatgtacgccatttgttctcctattcatcctacatttgatttttagtttatagtctttaataagtggggaaaacagaattacattgacactttttggatttaattggaaggttttcagaaaagctcttttgcatcagactatctcttctacaaatgttctagtgatgactgatgactctagaagaaaactccatcaaatggaaggtagaagaggagtcccaagtaggaggcagctgagaatgcagagtaggagaagcttctgaggcagtgtatcaagtaatatgtaaggacagagtagagacttgtgtcttcctccttcttctttctgtgtccaaggctacactttgccattatatgattttgacatcaaataaaaccagttttcctcgcagtagattgaggcaggtattatgaagaaaaggatggacaatgccagtggattaatggcttaactcagacacgtttctgttgtgaagaaaccttgagacaaagtttaagactgggaaaaataacattaaaatcagatgttttgagttaagaaaaaacatatagatgctgtttgagatcattttaaatggaaacacttagtttatgccaccatgtggttataccacaccatctgtaaattagtgttcaatgacacattattaaaacttatacattcaaactcatggttaattttaatctagatgcctacatctctgcgaattgcaagcatgtaaaactgaactcaacttgcattaatacatgaagagttaatgagaaactgttttcctgtgtatatgaatataaatgcatgttttactatttcatatagataatttatacattctttacatgctttatgggattatgtagttacatatttatatgttataatacttgaattggaatgggtattaaacaagacgtaggcttttaatatgaaaatattaatatgctttaatataaataagttaaatattttttggaaaacaaattaggtattcattgccagcttataaatatgaagccttttaaatttatacctcactttagccaaaagaggttacgttactctttgcaattattatttttaggagaaggagggtatttttctactattgttgcttttttctcagcatttttgagtcaatgggtgaaatgcttttactcagtgctgtttttgcaccaagtacattgttattttacccattgtaaattattctctcaatggtttaacaggctaaacccttaaataagaggtgtctttttttaaagaaaatatttggaaacgtgcaaatgaaaagagtaaatctatttttggtcgggttgtccaaactcttcttaggatcttatagctagtatttgcttttttaatggctgtttgaggtgtgtttaatttaacaagaatatgccagggatttactaaattatataagacagttctttttttcaaaaagtagatctagtaattttatttttcatttaatactcattcaacatataatattttgagttgtctactatgtgatacctactattctaggaacttaggataaaatgatacatgcatttctcatgaagagtacagcctagtgggcttaaataaacaagataatttcataataattcatgctatgaataaaataaaacaagttagcatgatagtgattggcaaaggtagttacttcagatagggaggtctctttgcaaagatatcatttgagttgagacttgactctgaaaaaagagcccattaagtgagaacatgggaaaagctcattccaagcaggatagtgagtaccaaagatatgcagcagtagcaaacaagacacatttaagaaatagaaagatggtcattatggatgacaggtagtgacgaagaatcatgcagtgagtcaaattgtaaagttttcaaagggtgcagagcaatgattggaggagtaaaatggaaggaaatgttggagaattagccgtggccccttaggtcatggtttagagtatgcattttattctcagtgtaatgcaaagccattggaatctagcaaatggaagactgagtatatgatttacattttttccaaagaatctttttttttggctgtggagtaagaagctatttaaatcatcctagcaacagatgacagttaccagatcttgggtattaagtggaagatggagagataaagactggttcgggtacagtttggaagtaaaaccaaacaggacttgatggcatactggatataggggatgaggaatatgtaagggatatataccatataaagaagcacagatgacttctaagttttatgagtaactgtattgatggtgggactatttcctgagatggggaaaattagaggagggagaggttcctgttttcgaaatgtagaattaagttcgagattcctattcagtcttcgagtggctttgtcaaggagtctgcaggcagctcagtggacaggttaataatggatatttaagtggaaggagccattggcatgtaaattgtattgaaaaccatttgcctggatgagatcactcaagctaagtctaagtagatataaaaagtagaggttgcaggacagaaccctaggatacttcaacatttccgtagttagtaaagaagtgagataccagaaaagtgagagagaaaatatgagtgtgatttcatgggagctcagaatgattcaataatacgtaattaaatgtattgcatagagctgagaagtgaaataagatgaagatagaagattgctcattggatttggacacaggtataactatcaataatgtaaagcaatcaatgaatatcacagaaaagcatagaatggtgggtaggcagaagtcaagggagcaagcccagaagtcttatttgcaatatgggcatgacactgcagcaaatttaaaatcttctattgaatgtaaaatgcatatgaattttttttgtatgccactagatagctaaaggtgaacatgtaggccaaatggaaaagcaaaaagaacagaagcatagagatcaaactattttagggaacaaaaactagttaacatcaaattgattgaaatttgcttcacaaccccatatttctcatgcccactgtcctatgagatctattatgctgttatgtaatgaagagctgtgttaattattcctgccacctgcatctaatgaaattagatgtgaaatttctgataggtacagatggccacttgaaaaaaacaatccagtttttcttttttttctatcagctggtcaaatctcataagttagaaatgttcagactataaaattaaccccagcattcttcatttgtatagatactaagtataaatgacaacttcctcaagcccaaataacttgtttggatttagagtttaaatactatccaattaagtgtatcatgctgacacattgtcatttaatactccctttggtagagggttaagcttgttgaattatttcaacttaaataatctgataaccctctcccagtttagttcagttaattttatacaaataaaattaaatctcaaaatgcatataaagtaagagcataatacagtatgtaatggggcataataaagttgccaatattataatgaagcgcatagaaaaagtgtgacctattgtaattagtaatgtgcacctctgacaaattgtaaagcatgaattttcctggtaaggaaaaagagaatgtgtggtaatggtagctaaaatcctattcgttttgcatagattgctatcaatattctgaagctgagggttgttgaagttggaatttagatggttgaatgaagatgtgctctggaaattaggagtacagatagacccacatggtcagataaaggaaggctgacagaataaagaagcaagacatgggttggttacttgagttgtggagatgaatgtgaaataaattgaataagatacaatgattagaaattgatacattaagcctggagatgaatacaatgattacgaatatgttcagacccacatatgtaccaaatgcaatggatgtcagacatctcactgtgaaagcaggtgttgagatgtgcaagacttaaggtaaccacaagctgagagaggagcagaaacatattaagaattctctaaataacagtattaaacaaaataatgttgaagcccagaacgtcagagattttctttataactccctcatatgaggtgaaataacctacttaaggttgttcaactggttgtgtggcctactaggttagaccatcagagacagtgtggtcctccttggatgagttgtttaggagaattatacatgatataaagaaaggtcacagccatgtgttagaaaccgacctttgtgcattactccttctgcaggattccaggggaagaaaaatcaattgctgactaaatagcatatttgaattacagagatcagcaacagtataaatattgcaggaaaatttatatataaagaaacttctatgtgcctttattagttttgtccacacaaaatgaaacaatgtgtgtatatatatatttttttcaggcaagcacccaattgaatttcagaaatcagaaaacaaataatttaacctttctttttaattcaattatattgatttgccaaagaatcactctctgataaataattttaaagtgtcaactctctgaatattgtaaaatatgtaattttgggtaaatttaactacatattcttggatccttaccattttcttctcttgaatataaaagatttagaatatgtcttgatgattttttgcttgttgtaattaaaatgtcaaacttaaagttgttaaaatgtacatctctctgatactagtaattcttttctcttttaaaaaacatacttatccagtatttaatttcatatgtctagatttgcttaggcaaaaggtagaagtgcctgctcttcagtttgcacataagctaatatagtttaatatatataaatgaatgtgtataatagaagtatattcataagttagaacgtgacatattacctaacataaaacaaataaaacagataactcagtagtttgaaagggaagcttaagggtaatactatacatatagtgtcataacactatcatgaaaatctctgttaaacgctgtctcctcaggcacattctgttaactcttcctaccacacttgtcacattacccagtttcattttcttgacatcacccagggccctctgaaagaattttctgtattaacatacttgtttaatgttccactgtccatataagaatgtaaactcagtcatagaagatttttttttcttgttcacttctatatcccgagcatctcagaacaatacctggcatatgaaagatgtttgataaataccaatgaaattaatgtttgaatgaatgatagcatttctgtttcgttgtatttttcattaaaaaattcaagtttctctcaactgatttcagatattccttcttttctaacatatgcatgcagcactatgaatttccctctaggtgctgctttcactgatccccaaaactttgattattgtcatttgttcaaaagattttaacattttttggaaatgtcttttttgagtgtggattatttagaaatgtgttatttaattgcaaatacttggagattttccaggtatctttctgttgttgatttccaatttaattccattgtggtctgagataatacattgaatgatttctatccttttaaatttgttaggttatgctttattgcccagaatgtggtctatcttcatcagtgttccatgtgagcttgagacaaatatgtattctgccattgttagatggagtattctataatgtcaatgagttaaaaatgattgataatgtgactcaggtcatatatgtccttaatgattttctgccattttaatctactcattactgatgtaggagatgtttaagtcttcagctataatagtggatttgcctgttttcagttctatcagttttggcccgtggagcttgatgtgctgttcttaggtgtaggcatgtttaggattgtaatgtcttcttgggaaattggcccctttattaagtaatatacctctttattactgataactttgcacatttggaagtctgaaatgtcttaatacattaatgatcttaaataaactaaaactccagcttgcctttcgagcactgcacagtacagtagtttctgatctttctgttttgcctctcttagtgtggaatctctgccctgcaaatgagctgagtcccgagtgaatcaggacccacgtattctgtcctatgaaggctgagtgcaagaggagattacctcaacttcttggttgcactcacagtgattttgcttcttgaaattggaattagaaagaaagagaaatgctagcaaattgctcctcctaatgagttacggtaatctttgattgggaaataaagctagagagtgccccatcttcttagccatatccattagtaattgagcttttgcctagttgagctgtgtggaaggttgtaggaggaaaggagcagataatggttcaaatgccacagactcccactattctaactgaattttagtatgttttcttgaataaatgtttcgttcacttactatattcctttggggcaattttcaggtttgtgtgtgtgtgtgtgtgtgtgtgtgtgtgtgtgtgtgtatgtgtatgtgtgtgtgtgtagtttttaaaaaactgatttcacaagttttgcttgtttcactagggaatggtccatagagctcatcatgctgtcatctcaaaagtggatctttccaactttcctttgattagtgttagtatggtatatctttcttaatcattttgtgtgtaacatataggaatattcatgtttaaggtgggtttcttgtacacagcacatccttgtgtcttgattgtcttaatccattctgaccatctctattttttaattggtatatttagactaggcccatttattgtgattattgaaatagttgggttaatatgtacatgtttgcaactgttttctatgcatttgttctttgtatatttttatttcccctctttttctggcttttctggctttgattgagcatttatatgatccattttatcttctctcttagcatatcaattatacttctattttaaaaaatcttggtggttgccctagtatttgaaatatacattattagctaatctaagtttatcttcaaataacagtatactgctatatgcatgctgctggtactttataatacagtgatctcaaatttttcttgtattacctatgacactgatattattcacataatttaccctcatactatatttacctaatacattgttactattattaaaattagcagttatataatataagaataataaaaacaaaatactttaccttcatttatttcctcccttgatgctcttcctttatgtagagccagatttataacctatattattttacctctgcctgaaaaaacatttcacatttcttgcagggcagatctgctatgatgaaatccctcaagttttgtttgccagagaaatgctttatttcttcttcacttctgaagtataatttcagtgaataatgaattctagattgatgttttttctttttttattgttacatgatagatgtatacattttaggggcacatgtgatgatttgaatacattcatagaatcaaatcaggataattgggatatccatcaccttaaatatttatcctttctttacagtaggaacattagcattattcttctctagatattttgaaatgtataatagattaatgttaactgtagtcaccctactaatttatcaaacaccaggccttatttcttctatttatctgtgtatttgtacccattaatcaacctcgcttcatcccctcttaccccaccctgcttggcctctgacaaccattaatctaccctctatcttcatgagattcaattttagctcccacatatgagtgaaaacatgtgatatttgtcttcctatgcttgtcttattttacttcatttgatgacttccatttccatccatgttgttgcaagtgacaagatttcattcttttttatggcagaatattaatctattgtgtatgtatgtgtgtttatgtatatatatatatatatatatatatatatatatatatatatatataatttttttcttaaccattcatccattcatggaacttagattgaatccatattttggctattgtgaatagtgctacaataaacataggagtgcagatatgtctttgatatattgattttatttctttggggtgtatgcccagtagtggaatgctggattatatgatagttctatatttagttttttgaggaaactccatgctgttttccgtagtggctgtactaatttacattctcacaaacagtatatgaggttttcgcttccttcgtatcctcgccagcatctgttagtccctgtcttctggacaaaagctattctaactggtttgagatgatatctcattgtggtgtttttaaagtaattttaacctttattttagattcagggggcacgtttgaaggtttgttatatgggtatattgtatgatgctaaggtgtggggtacaaatgatcccatcacccagttactgagcatagtacccaacagttagtttttaacacttgccctccttcctccctccttcctcgagtagtccccagtgtcttttgttgccatctttatgttcatgagtatccagtgtttagctcccacttaaaaatgagagcatgcagtttttggttttctgttcctgtgttattttgcttaagataatggccgccagctgcctctacattgctgaaaaggacatgattttattcttttttaatggctgcatattatgccatggtatgtaacattttctttatccaatccaccattgatgggcacctaggttgtttccatgtcattgctataatgaatagtgctgcaatgaacatacaagtgcaaatgtccttttggtagaacaacttattttccttggggtatatacccagtaatggaattgctgggttgaatggcagttctgcttgaagttctttgagatatatccacaagctgctttccacagtggctgaactaatttacatttccaccaacagtatataagcattcccttttctctgcagtcttgccaccatccattgttttttgactttctaataatagccattctgactggtgtgagatggatgtatctcactgatgcctgttcagttctcaataaatctcagctattgtattgttaacagtaacaataatgtaattatgaatcccagtgtaaattatttgatatataaacctaagataaagacatttattcaattatacatatatgaaatttgacctgatagctcttcatgaaacttataacctcttatctggaattattgtgatggtaaagggatcaccattttaaaatatatactcagtgatattttctagaaatatattataagcaacaattgtataaggaagacacaggaaaaaaaatcaagtttttcttatgaccaatgtcttcccactctaccatttctaagacctcagatactggatttcatgtactgtaacctatgagtcagtaaccatcaactcccaatatcatttcatttgtagtaggtccaccatgtatcaggcagacctttcacagtgatagatagtatacagaagctaccatgctgagatagcaacagtttgccataatctcatgaaacaccactaataggagactgctggcagagtcaatataatgcataatgtgcttagagacatttctgaaccaattgtaccagtcatacatctagcacagaatagataagtaaatggaaatattgactttgacacaggagacatgttttaaacaagaatacccaagctggataagatttgaggtcaattttggtaacttttaaaaatatccctgtctaagtattgtgacttttgtcccaagtgcacattactagtcactttatcttaggatacaggcaggtagctaagtaattaattcttaccaggcaggttctgctaagcctcctctggaagatgacctttttaaaatgttgacctcacatatagctgaatgatggatgtgtcacttactggcaagctcttttctgttttgatggggagtgtttaagatcattggacttgtagtccacctggtaaatggtgacaggattgtgagtctggatatgattgagcagtttagtaatatatataattttcatgactgtctgaaatctctagacaccttttcacttttgatcatgatttcaactgctgccgcctgaattacaaatcaaatgttagaacaatacatcatgatgctagaggcatagcttaggcatgccagcaagccaaatattgagttttgtgaggggggttgtgaaagacaactttttacctatttggaactaacttgaaagcatagctttagatttacaaaaatttaaggacacggggattgctattttgttaaggcttgtttagggacattgaaccttaaaagtctcaattttgaagaagtagtgattaatatcatttgggacaaacaaagattttagagatgaaatggtaggtgaccttgaatttgtaatttgtttgcagtgtatcccaattaagagcgtggaaaatctctggttaatatcaaatgtaagtactctacattgtaaaactggcagtaaagatgggaacatctctgtaaaatagttttatcaaatgagtggcttagtgtaagaatttgatttaatttatatatatacattatattttatatggaaatacaacaacataaatacatcaaatgtgctttcatcttagactctgaaaattggttaatgcctgaaaatttctgaagtcctggttgaggtttgctgtttctcaggtgacttagggctaaggatttataacttgattctaataaattctgtatgtaaaataggttaactttatttaaaaggtctcatgaaatttttaagtgattataggacttacacttaagttcctgagctaaatttcttctgtcttataatctgactgatgtcttcagtatgacctctagcttctgaacgtccattattttttctcccgtacactctagtttctctagtactatcttgagaaattacagaacaggtatttgtgaaatattggaagcatgtacatagttcctgtgttattcatattggggatcagtaaaagtattttaaagctagatgtcatagttttattcctctgtctcctcgatatttactccaaaaatgcaggaactctacaagaaccatggaagcatgctactatgtttgtgtttatatgtgagttacaagtcagtccctccaaacacccactccccaggaaatatacctggacatgttcatcatcttaaaactactctgatattatactataaaaataatgaattattcccttaaagaagtatagatgtgtctgagaaaataaaaacccatgaatcttcggatcctttaagaattatttttttggaatcttgatatgtcaagtgattcaaaatgtttgttatatatgtgcatgtttgtgtgttgcagacaagataattatatggagcaagctaattaatttattttttcttattaacaatttcttcatttactgaagggtgttttaaggtaaatatctttattacaactaaaaatgtactgaagaatatgtcgtaatattagcaagatttgcctaagcctgtataaccaaattggctaaaacaaatatatacactcttaagataaactaaagtgaagtttaagccatacacatattgttatgaagtctaaatttttgtaataagaaataggaattcatcactggcaagagatttttagttgtaaatgcttataaacattttgcaggtatttaaaatcccatttagttatataaatcattctgtggaaaataataaaattgtgtaagatcagaattgttccagaaacctaggatgcaggttactttttaaggataactccagaggcaaaattaaatatactcattatcaggttttatatactcattaatatatgtatatgtaacattaagaattgcatagttttttccatttataccaagggaaacaaattggagcttttaaataaagtctttgatttattatattttctccccacagataaagaacttttgttctatttttacctttgtgattactgcataaacatagtgatatatatatatatatatatatatatatatatatatatatatatatacatgtactgtatctacaaatgaaagaacatttaatggaattaagatactttatcagagaacagtctatgtttactctataaaatactacctactcaaattatccttttatattctcaatataaaaatgatgaaaacaaaatctacaaaatgtatgaagataaccatttgggggttttgtttttagtttgttcaaatggatactttactccactgtggaaccagtgggttttgtccctgatgtaacagtgatatttatataattaaatgactatttttgaaaatgaccctcaagataatctatacctgcttcttccttataagtgaggaaactgatgtctgtgacgatgaagtgactgacttaacggtatgcatctaattggttgcagagcctggattaccacttttgatgtttctcacttacctgagcatcagtgacatatatcatttggtgcaatgctggtttacaccactcactgcttcatctacctgccttgttattcaaataggaacaacacattatatcatgggattaatacaaatagtaaatgtacatattagtcaggaaatcagaaatcatttcaggttttttaagtcggaagagtttcaacttaagaaattagagaactacataaccaatggaaaaactgaaaacagagaggtcagggaagctagcatttgagttcacgaaatcagaatgttggatgatcaggaagccattgctggctatatgtgcaccaaagtgggtggttcacaggaggagctcactcaggagctgccacggactcctcatctgtcatctgattttgctacagctgcccttggaaactaatggcccatttttctctcaacccccaaggaaagtacaaatgcttcgagttggctgaaacagttctggaatatacaaggaaaggagttacagaaaatgtagttacaggtttccccttgtgatagagagtacaaaggggccgtaatgatgctgagttgacaataggcaacatataaaccagcatgaaataataacaccggacgctgtcaagcacagagaggtgtttggtaaaaaatattaaaagaaatataactaaagccaatgcctgcatttttaaaagaacaaatttaggacaaattgaaacattttaacttgatttgaaattatctaaccaggaatggttaggcatttacttgaatttagatttaattaatacatgcacatgtatacatataaaagttggagaagtttcatgatagttcttcttgtttgtggggtgtttgtctgaacattatctatatttactttgttcctagatttttttaatggagaatatccattcagtataacattcaaaggttcttgggattaggatgtggacaaaattgagggtccattactcagcctacagcagaaattgtagttccagtaacagtatgtaaaattacaaaaatcttttaagtttcccaaagacatttctcagtgtactagaacactttctaagcagtattgtcagtgtacacagaaatgcagatatgtatggtaaagcagtacattgtgatgtgggttatttggacttgagtcattttgcctagacaaaaagaaacttttttcctttgcaagtaatattaccaaaatatttcctagcctcatttgatctctaagcttcaccacacccctggctttcttcagccctagtgtaaggtgagtaatgggttgtgcatgtaaagataatgcgtaccacggtgtaagggccagaaattgggtgaagtttactgatggaaggggttatttcttacacattgcttcagttagcatccttttggtcagaagaaacaaaatctaaatcaaattggcctaaattatgacagagatgaatatgtttattatttaaccaatatacacagacacagggtcggctttaagcgtggttcatagtttgagttagaggttttgatagcattaggtctccagcttgattcctctgtgattatgttggctctgttccctgctttcccctcccaccatccacttagtttgttttggggtgatatacgattgacttggaagatactaaactgtacacaggaagggttccctcaaagagctcctcatcatgtacattccagaactctcctaaaaaggattcatctgcagtctcatagtaccttgtctgcagtttttccttaacctcctttaaatcaaattttatattagttctctgtgtacacattgataatgacttgttaaaccagggtttagaaagcagttgcctgtggaacacatgtggcccacagcgtgtttttgtgcagcccacaagctaagaaaagtttttccagtttttaaaaggggtgtagaaacaaaaggaaaggaataagtgactcagacctcatgtggcctgaaaatcctaaaatatttgctatctgaccttttatagcaaaaggttgccaacccctgtgttagactatcagatacaaggaactgtcttattcctgacacattgctgttgtgcctaatgcagttgtttccacatagtgctgtcatccttaaattgttcttcccatctaccctccttggtcaagcttttctgtttcattcggggaggacatgttgccatgggatatcttattaattcaggaggggaagacttgtgggagatggctggtggacatagatgagataaaaattctcaccaatgataaagtatctgggaactaaaaggaccttgaacaatgccctgtccaactgcatcttgctacagaagaagaaataaggacaagggatggaaggggtgtacccaaggccataggtcataatcagctgctaaggcatcatcaggaccctgcatcttggtccagtaccacttccaccaacccctgttattttttgtgacacaacatcttttccttataaccaactcagatatataccaagctgctgtatccatgcgaggaccatccgagactgttcttttaacccaagagtttcccagaattccatagttactgctgaaaagagtgagagtgatcaagaactttcttaaaaggattttctctttcattgtgtttcattttcttcaacccatctcataatacctcttgagatttctatagtcctttaatgctatgtccttgttccttcccggtagttatatttcaatggccctagcttcaagatgtctttggctgctttctaggagatctcgttgatattatctcatttatttattgaataaaggtggtgacaaaaatgtaccagatcttgacggtaacttatgtgattgttcattcaaagattgctaatggcctgttaaagcccttagatttattaatttcctcatatctcattctccttgattgccctctcattccaactattaactggctttgtaactatagctattatggtacttcagtctccaacttgccttccgatttttctgatagctccttcccccttcttagttctaattttttcttccaccacctaagtatgataactcttagtatatttatttcctattactgctgtaagcattatggctaagtgacttaaaacaacagaaatttattgtcctagatttctagaggtcagaagtccaaaatggggtatatgggttaaaattaaggtgtcagcacaactgtgtacttttggaagctctagggaaaaattaatttccttgtcttttctagcttctaagagaggcctgctttttttgccttgtggctccttcctccctcactccaagctctgtttctgtaatcacatctcctttttctgactttgaccttcttgcctccctgatcacattgggaacactggaagaatccagaataatcttcccatctcaagttccttaacttaatcacatcagccatgtcctttttgccatgtaaggtaacatgttcacatattctaaggattaagatgtgtacactttgggggccactattctgcctagtctacttagattgccaccattggatctcagttgcattttatttttcaatcttactggtaccctctgcctgtttaaaaatgtaaattgttttacaaaagtatgccttgattcataaaggttatttatttgcatttcaaacttgttttctgtaaaattattccaatcgattcttactttaatttacctacacctcaatttaagctcctattaccacttgaattgattccattcaaataatatcatttgaccccctgatttcatcatctggaccatctgggtactccaaaagagtaacctaaattacttttcaaagtttttccctttactttatgtattctcaacatactttattctctcccattgctatgctttttctttggtgtctgaaattccttctttgaaaactctagtcagaatttcttatcattattcaaggtctgtatctcaatggtgacttcttcaaattaataattatttataccacaaatcctatgtgtctcaaccccttttaaattctgcccttccccctattgaattttgttattgtatctggcagtagtcatttttctttgctttgtgttttatgtaactgtgtagtgttctgtcctatcctcctaccacaccacccagggaagagaaaacacatcctgcccagattcatatctcctaagtcctgctccgatgttttgtacatcaaagtataaataatagcattactgtgatgttatttaaaattacactgtatgtggctgtgctgatttaagatatgtgttgaagaattcacctgccagccaactatacctaaatgactgtctcctgaatttatttcattaggagactttttctgattttaagaaacaccttctggcatagcttctgagttatttttgaaaaccctattatagttatgttggatagatcaagtaatccagggtatgttatgcaacataccctttctgtatttgtgtattcattagttgcattcatattgactgagaaacactgtgccaatgttatgaagggtatgcagatgtgtatgccaaggtggctgtcttctaaaagcttccaggaggatatgttccactgtgacttttccaactacacaacagcagaattctagcatttagcatgtttgtgaaactcctagaggcaattaacacattatgtgacagaacctagctccttaatggtattaaaaatgcttttttgaggccaatgagaacttgatatacagcaggataattctttagaagtatcttttatttgacatttattagaaatgaagttgtcatgaaaaggcatggatgtttatatgctgctataagatagtcatctcagcaggcattttgatcagtcattacctttgacagagaatggcacaatagcatgagagcctgcagagctttctttaaagatggttcatataataggggcatcgtgatacttggagtattaatccaatattgagggaaattccgtgcccctaatgcttgaatatctatgcagattttggaatatgtcattttcagtagctttgacagatatgtaaataaccatttccccaaacttcataattgcccatgtcattaatttttctttttactgttgcagaacattttcctctttacactcaagaggataaattattattgtggttccatttcattggaaagcatacacctgcatatttgagaatctttaacatttgaatgtataatatataatataattaagtaaatcttcaggtattgaaaatgtacttttgaataatcacgttggcctcctgataataagcagtgaatagtaattgattagattagtatgctatttttttgaatatagtagcagtgactcaataaggtttaattgcattcctgtaaacatatggatggttcaagaattacttctttgtaaataatataaattggtaagactctgaagtgaatgacacagatttgatatagtaagacatttgaatttcagcttctctgagcactgatactatttcatcattgaaatacaaaattatggaaatgctgaggaagaatgaatgcttatttataggcacaaatcaccaatattaagctgttatcaaaatctttacctaaatttgttggttgcaaagttctgtaataggcttaaaaatgtgcagtgttcagaaagtaaattcttatttgatttgccagatgcaaataatgtatttgttacgttcattcaattattaaagaaaatttatatcattcttcctatcttgtagggttgatatatattacttggaaatgtgagacaaacgaaatgagtgtaaaccctaagaatatccattggtggactaaaatgtaaattttaatttctgtattctcatgtagcttaactagcatttagcatgtttgtgaaactcctagaggcagtttccacattatgtgacagaacctacctccttaatggtattaaaaatgcttttatgaggccaatgatgtacaatgtacaataatgtacaatgtttatatacattgacttgctaatttattaagtatccacattttagcctcttagacctactctgaagttgacttaactttcaagatgaacagtcatttttgacaccctgccatccccttgcaacagagaaaggtatcctgatttttgtgattctctggcacctaatagatgcctcagtgatatagtgttcttatgggaaggttatattgtattttaaaacatgaaaataccagaacagagtcaggatcatgaagccaactctttaggggggtacattagctggttctaaaaccttttacctgtagaatccctattcttgctcccagatgctatattgttattgcagacatggatgttttagctccgttagcactggagacaagcttccctacaccatagtagtaatatagggagagagaaccagtacatcttgtgtgaaagtttctttgcatattcaagtagtttcagaggcagcccaattataagaattaggtctataatcttaaatatgctgtaaagatcattaattatctgtgtaaatattggagaggatcagcatggataattaaattgaatttatttgaacataggcagttttcacattggctgttgaagttgctatttgtgcaaaatatataatttactataattaggacactttctgagaagttttttttgatgtgccatattttcatgctcagcagaaatacatataaagcataaatattttcttcagctacatatttttatttaaataatctccattattttaaattcctaaacatttatattatttaaaaacctgaactaatctcattcttaactaggtttgtaggctgggagtgtcagagctatgtataggaaaatttgctgtctttttactcattagtctaatcaagactagaatagactacgttgagtgtttactcatattacagatgggactaaaaatagaagatttccaaattacacatttaatatgaaacaggaagtgattttgatgtagactatgtaaaagttttcttctgactttattaggttattttttaattcataaaaagaacccccaattgtcttgatcttttttctaaaatttgaacaattaaattttacctttacctacagtggctgtgaagaggatctatattacgtggtagttatttgtacatttaattaatttctcctgtcagtaggactgaaaagttttattcatttatttgtacttacagcaaagataaagttagagaagtaattaaaatgtgggttgttttgctttcccacaaatattgaatgtcattgacatttttgtatctcttctgttagcttaattaagagttgaattattttaagcaacagttgtatgttttagtcattctaaaagtttaatctacctgtgaaaatccacttttcacctgcggtattatgtcaaattgttttctctaataacacttttataagtacagtttatctctccttagcagtataattttgcaaatgtcttgaaagtttctgatttgtatgtgtctccactagtttactcttcttttttttgacctgggactagatcttagaatggtctgtacatttagtaatactcatcattttgctacttttagagctacatcctggtttcattgtcgtaaattgaaagataaatttagaattcatcttgccaatgagttcagacaagaagaacatcaaagtcaacatttaatgtgaggaaattgaatataaactagtacttttcatgaaatcgttatatgtgaacatcagtctatatgaagtcccatctcagtgaaatatctaacaaagtatggcctgttaatagtttcactatcatttcaagtaattttaaaatataacacgtttctagcattataaaataatttagaatataaaaggctcctttccatgtgcttattgccatttgtatattttctttggataaatttcttttcaaattctttccccatattttaatttggttgacttgagagttttttttagttgtccctagactatttgttgaaaagattattatttcccacattgaattgtcttgttagccatatcaaaaatcagttgactgggatttctattacctcaaacattaatcgtttacttgtgttgggaacattccaaatcttctcttctagctattttgaaatataaatatgtacaactattatttatcaataaaaaatcaattgactataaatgtgagggtttattttaggaccaccgatgtctgttcttttgttcataccacacactcttgattactgttgctttccagtaagttttgaaattgggaaatatgagtcctccagttttgttcgggttttcaagattgtttttgctattcttggtcgctggtaattccagatgaattttaggcacatcttgtcagttttggccaaagcgatgctgagatgttgaaaaggattgccttttgatagggattgctttgtcaatcaatatgaagggtatttccactgtaatagtgttaaatcctttgatccatgaaagtggatttatttaggtctttaatttctgttaacaatgttttgcagttttcagtatacaacttttgcacttcttttttaaaatttatccataagtgatttattatttttgatattattgtaaattaatttgttttcttaatttcattttcagattgctcattgtaagtgtatggaaatcaaattattctatattaattttgaatgctgtatccttgctgaacttggtttttagctctaataggtttttcatgtatatgtatagattccttagtattttctgtatataaaatgatgtcatctgttaatgcctatagtttttcttcttttccattatagttgcctcttatttctttttcttatctaatttccttggctaacgtctctggtacagtgttgaatggaaatggtgagtgtggaaactcttgtcttcttcctgatcttaggatccagccctttaccatttagtatgatgttagttatggttttatcatagatgccctttatcaagttgaggaagttcccttctgattccaatttattgaatgctttatcatgaaagggtgctggaatttttttttttttttttttgagatggagtcttgctctgttgcccaggctggagtgcagtggcacaatctcggctcacttcaacctctgcctcccaggttcaagcgattctcctacctcagcctccggagtagctgggattacaggcacccgccaccatgcccagctaatttttgtatttttagtagagacagggtttcaccatgttggccgggctggtctcgagctcctgacctcatgatcctcccacctcggcctcccaaagtgttgggattacaggcgtgagccaccgtgcccggcctggaattttttcagattttttttttcatcttttgagatggtcatgtggttttggtttcttattcttttaatatggtgtatgacattgattgaattttagatattaaataagccttgcactcttgggaaatattcctgttggtcataatatatgctttttatatactgctggattctatttcctattattttcttgaggaatttgcatttatatttattagggatattggtcagtagtttttacttcttgaattgtctctgtctggttttggtatcagagtagtactggcctcatggaatgaggtaggaagtttatcatcatctttgatgttttggaagaatctttgaaaggttgatgttaattcttttttaaatgcttggtagaatagaccagtgaggtgtgggaggtttaaattttatttgtgtcaagttttaagttactgatgcaatgcctttacttgttacaggtctatttacattttttgtttttgttcttcagactgaataagttgaattaatctattttcatgtttgcagattctttcttcttccagctcaaattggccatggtgtatctctggagaattttttgctttagttgttatactttacaactccagaatttaaatttgcttcctttatttaatttttatctctttattaatattctctggttgatgagatacaattattaagctgtcctttatttctttaactatggttttctttagttatgtgcatattcttgcaatcgctgatttcaagtctgtctagtaggttcagtacttgggctccctctgcaacagttattattgatggcctttttcttgtgtatgggctatacttttctattttgtgtgtatgtgtctcaaattttttttgttcaacatgggacactttagatcatataacatggctactttggaaatcaagtctgtcctcctccctgaagctccagggtttgtgtagttgtttatttgtttagcaactttccttaactaattttgcagagtctgtattcttttttaaggcacagccactgaaatatcttcttggctaattcattgctcaggtaatgattgagaatttttaaaaatgccttgaaccagtaattctcccaacctttgcccagggtttctctctctctctctctctctctctctctctctctgtgtgtgtgtgtgtgtgtgtgtgtgtgtgtgtgtgtgtgtgtgtgtgtgtctgtatgtgtaagcacattttcaatattctggcaatttacaactctgccttagccttttcttccaacttgtgtagaggtgggagattaaggtgatctcacgtcttttctgggcatgactatagctctgaacttactcacagcctactagatccccagaaatatttcagagctttgcaaggcctcctatgaccatctcattttatagatttttcttttacattttttgtctatcttcttgtttgtcccatgtggcttcaccacctaaggcagctgcaaggctaaataattgagactgatagtttttgccatattagggatagaactttcctcattgagcaaattctgagtcaggtgaaataaagagaaattcttgaatggggtttttcagccagctaccagagagataaaatagtagtagttctctggggatggagctttgtgacgagctccaaaccagtttgtcctctttattggctcctaggctattgtttttttcaaggctaatacagacttggggaaagagggatggaaatagggaaagttaaaatataacagtgtttgttatttttactaaaagtcagccatttttcttgaataaatgctgttcagattgttgctagattttgtttaattttcagagttctgaaaaagttgattttgataattttctggatttttttatttcatggaaacaagaatttcagagtttcatactccactattccagaagtacttctcattttaatatttttgttttctttatgatataatattttgacaatttttgattactttgtacttaactttttaaaaaagctattaatggtttcagttttttaaataattacaatagtgcttcatatgcttgaagtacttattcttttttattattattttatattgatataataattgtacgcatttattgggtatagtatgatattttgatacatgtgtacaaggtgtaatgatcgtcagcgtaattagcaaattcatcaccacaaacatttatttctttatgttaggagcattcaaaatctttcttctagccatttgaaaatatacagtaaattgttaattctagtcaccctgcagtgctatagaacactggaacttattcctcctatatcaccgtatttttgtatctattaacaaacctctccatatcctccctccctcctacccttcccaacctttggtaatcactattctcctctctacttctatgagatcaatgtctttatttactcgaagtactcttaaaagtttaggacttaagtatttgaagaaattcacttgctttttgtttttattctactcaatactttttaatataaagatttacagtcccccaaattctcttttcagaatcttaatataattattcatttcgtcctgaaaactgtttctttccaaaattaaacatttgttgtcatttaataaaaataaaccagaagtagaagagctggaaaatccctccaagttcatctgaactggagaaaaatcaagtctaaattactaaatattttgaaaagtacagagttttattacagtaaactttgacaagttgcctttatttggaaaagaaataacctatttttctatattctattttagagaattaaaatacatttaaagccttatattgggttggtcaaggttttttttttttaaaaccttagtagtttatttttgtattcaaagtatcttccagcatgtctgttaaatttcttatttttttcaattttttttttttttttttagattcagggggtacatttgcaggtttgttgcctggctatattgtgtgatgctgagatttgggatacaaatgatcatgtcatccaggtactgagcatagtacccaacagttagtttttcaaccctccctacccccttagtaggctctagtgtttattgttaccatctttatgttcatgagtacccaatgtttaacttccacttataagcgagaacatgtggtacttggttttctgttcctgcattaattgacttaggatgatggcctctagctgcatccatgttgctgcaaaggacatgatttcgttattgtataaaaaaccatacagctgcatagtattccatggtgtataggtgccacatattccttatccagtccaccattgatggggcacccaggctgattccatgtctttgctattgtgaatagtgctgtgaagaacatgagggtgcatgtgtctttttggtagaatgaattgttttcttttgggtatatactcagtaatgagattgctgggtcaagtggtagttctgttttaagatctttaagaaatctacaaacagctttccacagtggctgagctaatttacattcccaccaacagtgtgtaagtgttcatttttctttgcaaccttgccaacatgtgttctttcttgacattttaataatagccattctgactggtgtgagatggtatctcattgtggttttgacttgtgttcctctggtgattagtgatgatagcacatccctttagatcaataccaattcaatataattcaaatatctatatttactgaatgttatgatgtaattgagtttcttcacaatctccacaatcctttagaaaatttctaagctttaactaccttctatagatttcatgtacaacatgtaacataataagggatagcagatgaatggacataaaaagcaattgggccttttccccgatatttcatgtgcaactaatgaaggagaaatagactttgatttaaaatctactggtgacttttatgtaatgtagtgggcttgagaaactttcagtatttatgggttcaaatatcattttataattttaataatgcatttatgtaaacattaagttaatgttttctgaaaagtacagcatgtatttaatgcaataaccactttcaaattatttattgaggtgaagttttcttgtaatgaaatgtagatcttgagtgagtaattcgttaagttttaataaatgtatgcatatgtgtaactcacatcctgattaaaagattacatttctatcactccacatctttacttcatgctccttccagccatttcctaggtacacaccaaaggtaaactacattctgatttctattaccatcaattaattttaactgctctagaacttcatataaatggaattataccgtaggcaatttttgtgtgtatcttcatttattaaatttaatgtttaaaaaattcatccctcttgttaggtatgttggtttttcatttttatttctttattgagttttttcacataaatacacagtaattttttattcattcttttggaatggagatttttttggatatggcttcaaatttgggactattatgaagaacattcaggctatgatttttcaaaaggggcatgaagtttaaacaaaaagccttcttataattctgtagaaagtgggtaatgtgtgagtgtgtatattatgcattaatatgcttacaaaaatgatatatatacacacatgctaaatgtctaataataatagtaattataatgacaagtaacatttgtttatgttcgctttgagctgggctcttgcataagtactgtacatgtttcattccatttactcctcacaacaatttgtaaagtaggtaaattaccatattatctctgacaagtagactgtgcattttggaggataagtgatttgcctaagatcatgcgcctagggagcggccaactggggatttgaaatctagttcttacactgtcaggcattgtactatgcctgctacttcctaatagttaacattatttgagctccactgtgtgccaaatatctgcatgacacacacaaacacacacaccgataatacagtgtagaaagataatctatgtaaagattagcaagggtgcagtggaagaataccccacatagaggtcatttcctcttcagaggattaaggcaaaggccaccaaagtgacttattagaggcagaagccagtcagaagaggtataatgtttgacctacaaagggcttaaaacttatattctgtttgttgccaacatttaaaaattaggatatcacgttaatatctggatttctggcatcctcctacacatcatgatatctgaaaaccttgcccattgccatggtctgaagctgaccctcaactacttcccttgggcctgcagccagccttgatggcttatgctttctgaagagaggaatatgagtttatgaatattaaataattttttgaggagtggctttaagctttaccttaaagaatttcaatagagatttccaggctgtgtgagggaatagtacaatgcaaggaaagaatggcacttgctgggtgagctgaaggaataggaattaggtgggaactatctcgattgcccaaaatccagcacagtggggggaactaatcagaacataagatctgaccttaatatcttaggaaattctatgttttgaaagcttttatagaggaatgacaaaatcagagctttaattttctaacaggccaaatgcagcctaaacattgcttattccagaaactgtcatttaagtgtggttatttgaattgaacatataggctgaaatgcaataaaccgccatttttgtaggttaaaaggaataaagtatcaagtacatgcagtttggcattacaagtttgcctagtagcactttaaatgagtcactaatttaatatattatttcttttataaagttcatttatactttctgaaccaagacagtggagctggtacaaatatacactgtaatgcctccctatttgttgtttcctttaaatctttaaaatgtgtttttatatttgttttttgagatgctgaatttccataatatttattagaatattatatgtattgagatgatatttccctatgttagggagaaaccatttgtgttatataaacaaacaataaagttgtctaaaaatagaagatccttttggaaatgttgatgcctaaaagacaaaattatgtggatgaacatacgtaagcttcagtgagcttttcttgtactaggcatttagctgtcttgcaactgttaatcagcacaggccttaaaacagctgctatcagattaattagagggaatccaggaaataattcaactgaatgtagcattcatgtaagtgtgttgaaggcaattaagagtaactatagtcattactgagacttccaggaagtatgccaaagggcttgaaagttataaaatgccttttgcttcccaattttatatatatatatatatatatatatatgacagagagagagagagagagagacagacagacagagagagagagtccatatataaacacacactaatagcaattaaaaataaataaaattgaaaagcttgaattacagggtgttaactcacttctctctttgaaattaaggggccaagggaaaacaagaccatttgtctaaattcatttagaaagaaaaggatttatttaaagatgctgtggcagataaaattacgtttcatttttgtaatcctagttttcatagccaatgaaaggcttaaaataaaggaagttgatatttcaccaaggtcacacgatctacgagaaggaaacttaagaaagtttcctaatgcgggatttaaatccttaaaaacttgctgtggtcatcatcggcatcatcatcgtcatcatcatcaccaccaccaccaccaccactgctgccattaattattattattatcatgacacaaaggttgattacctggcatctcatctcatttctactgttcttaggtttcttgcctgtcttactgaatgacagtatgttactcaaaactcagcatggcaaaaaatctgggttttttaaaaccaattttgcctgtggttggcaccttgaaaaaaaacgagagaccaagaaagagggagccgaggatgggagtggaagataaagatttaaaagaataagtattgatattcttttctctttatttttaagtgacaaaacttatatatatttatggcattaaatatcatgttttgatatgcgtatacattgtggaatggttaaatcacactaatataggcattacctcacatacttaatatcattgttttgctatttaataggtctaaaagctgaagtcagagaactcatttatttatgagaattttggtgtgcaactgcattttgctatgtgttacagtcttttaacctacttccaaatctcttcttaaggatgagctagaaggagagactggctgacactcctcatttttgaagccttggcttttataaaaggggccttcagtgtagcaaaaggcctacttataattctgtaaaaagatgttcatgtttttcaggaacgtttgtctctatttagaaaaaataaaatgtagtttgggaatagcggaaatgattgattagagtgttacacatgagacaaaaagatagatgggcaataccgttcctgtgttttcatgccctgttcctcataagcaacagggcaagagatgataattcccaggagaagcaggagaggcttctggatcatgaggtgctattctcttacagaggtgctaccacagttactaggtactcattccacttcttttttttttttttttttttttttttgagacttattttgattaccaggcctctggtttaccaagtgtcaagcccaccacggtcccatcttttccttatctccctcttcaatattcctgtctaccaccacccttccctcacccacatagcaataccacataccatcatttttctccaagccccatctcttaccccttgcaaactctgccattgttttcatcccagttcaaatttcctccacacaataaaatgttctccccatactgtgacttccttgaccttacgttttcctaggtgttattatcttcaccaaatcactaagtgtagattatgtatctttgagtgttcatggattcatgtggttagctctactttagcacgagaaacaaatgccctggaatcactctaggaagaacgttagttgctatgtggaaataaggagaaagaaatattttagggatggaaactgtatcacagaacttcagtttttgaaaaactggaaggagtcttagaatccatcccgtctaaacccctcatttgagagttctagaatctgagagccagagggcttgcacatctggtaagtaatggagtatattcttttgacagtaagtactaaaaattaggtcttgtaattccctggccagtatactttccacaacactacacagaatctaagctttggcttatattatttgaacaacttgaacaaaaatgaggtaccagattttgacagctggaaataaccggaagtaaaaggggttagtattccccaaacaagaaatagacgaaacaaagatgcagaaaagagaaatgagtgtggtcctgttagggaagaacatatgggtcagtacaccatatagtaccaaggctgggtaaaaggagtcttggtgaaggcaataaaaggaaatgtttttctgctaaagaaattaaaagtaatattaaaacaaactcgggtttttgtcttccttttttttgttatcaccatgacctggcaattgcaaacaataccagtgataaactattcctccttgaaaaaaatactttataatctaaattctaaatagtatctgctgttataatcagtatttaataatatatgtataagcattaaattaacccatatttattatatgcttgaataaacattgaattctacttggaagtttactaggggaattcctaattgtaatggtgtctctgacacatgcacactgaaatacgcacattaattttgagagtaaatttataaaaatttcaaatgattggagcttgcttcagaaggacttcatgtctccagctcctatggcactacataatcctgcatttaaacagaagctttgaaataaaccatgtgaacacattgattataaaggtgaggaaaaagaacttgagttagaactcaaattagaacttcgttctattgtgttattctgtgcgaacacttggaatttttatatgtgcttaaagtttaaaacgatgaaacagtgcaaatgagttataatgtttttggtaaatgcaaatttcaggttataaattttccagaattttagtaatatctctaacattgaaatttgaccttcttgatgctagaacctataccaaactgtggtggacagaatttactgtatcctaagcaaaatatgcttagaagtaaaattaatattacctatgttttttcttatatttataattttataaatctgttgataattaaaattaatgaaatgtatttcatgatttagatggactttaaaatatgactataaagcatcatttgtttagtgaaacaaaatataagtaattggacactattttgaaatgatattttaaaataataattacttttaattatatgtgataccaaatttttaaataaaatgtctattgaacagctagtgttcaaggcattgagcaaatgcatgttgacagtgagagctacaagccacatctaaacatcaaggattaatccatcatgatgatgaaaaatagatagcaactattatcagtacatatttttaaaaaatttatgactatttaaatgggaaataatttgtttaagtttttacattgcatatttcaacaacttgtcttgataaaggaaactcaggatgtaagcctgacacccaaagagagttggagggaattcattcattaggaaaatataaggaagaaatcatgacatcagttacctctgttaataaaaaaaatcagaaaagaacaagtaagtaaagtggcattttagaatatatagtagagtttaaaactgttaaatatttgagcataagtattttgctttgagagagaagaaaaaaatactacaccaagtaagaagtgctagttgcgtctcttagagtgtaccaaaacgatattggacattggagcctcgttatttgtcacctgaagatgactcatgggaatagaattctaaagcaatggaaacaggcactttatataggagtaaatatcacaaaacacatttttaaactcattattttgaaatatatacttaaagaatttgcaaaaatactagagttcacccatcttcctctgatagtggcatttcgtataaccgtagtacatgaacaaaatcagaaaattgacattggcacaatactgttaccttaatatagaccttattcagatttcaccagcaagcacattttttaacactaaaactttaaaaggatttaaaatatatatcctgtttttaaatcttattttttgtgagtccatagtaggtgcatatatttatgggttatgtgaaatattttgatataggcatgcaatgcataataattacatcagggtaaatggggtatctatcacctcaagcatttatcctttgtattacaaacaatgtaattatactattttagttatttaaacatgtacaattaatttaattgatttaattttacatttaaatattttttgtggataaaagtatttaaactaaatttaacttaataataagtatatatttctatactcattttctgaatatgagttataagatggttggactttatctctttattctatgtcttaaaagacttaagcttccgtgtctaagttgtacttcccaatggagtcagaatcactgagactagaacccctggaagctagaatgagacagatacagtagtaactggagctgtggggaaaccttaggttatatcctccaaatcatcttaacagcaacaagtatggaacctaatttccaatggaaatatgttttatatgtggtcttgtaaaatagtcctgtttatgaacaattctatttcagtacgacaatagacatactgaatattaaaccttaaattccagcagagaatttcagaggaaaatatttttttcaatataatatgaaaaatagtgtcaatgtttgtcaaaatgtgactctttgaatattctaatatactaagcttgaaggaaaactataaatctttttgaaatgtcttttccattttttattttagcaaagtatgcaatacttaatattccagtagtctaccagtagacaaatttacacttattatgttcaccacaaagtcttttatgactaggagattcagaacttcttataaatcttataccataatgcataacttagaataatttacataagaaaaattcaactcaaagactaaacagataccaagaataacatattacatatctaaaattagaaagcacacagacacattttagagataatagcaaaagctttttagtgcacaaataaagttagtagaagaaaaacaaggtaaaatgatacatatttttaacattacagaacattactaagaatacattgcctaaaattgatttataaacagagaaaagtcttatgctcacaacccctctattttaatataaatttaaaaagagagaaattgcaatgaaattgataatcatcatataagccatgatttgcacctttggtacacatcataattgcttggggagtgattttggaatacaccagaataaaacctggtaagtggtagtttgagataaatcaaataaaacacatttttttttctataacaaacaaaaggccaagtctggaatcattggtttctgtatggtgtattttatccaggactggcttatagattatttaagagttaaaattatgattacatggtcacatatatttgactttagacacttttaaatttagctatatattttaagtagagattcttatgaatatggaaataaaataatgtacaatggtatgataatctgatttatctaaattctgagttctagacatgccagtgagctacactggtagtaggactcaaaagtgcattatgtagggaaaaacatgatgaattgatttcttaaatctttctcagctagtggtcccttagtggcttaccctggtttgtcacctctcccatgatatttatcaatacttatgaacattttagaacctttctagccataatttggaacctaaaatgtttacctatgcatgtacttcaaggataaatatgttatgattatgttatttgaaggacctggctagagtggagcctacagctgaagtaaccagagttgggagggtatgttacgatataaatttcaaaaaaaaaatagttttaaaatatggctatgtaaaaataacttctattacttgtattttatgaacgattcaacctgtataaaaaatatagttctgtggaaaaagtttgatattagagagttctgttctttaatctctgccacattttcgctaaacatcttttctttgacctcggccaaattccttaactgttgaatctcctggggtgcctgtgagaattcaaaatgcacctcaaaacagcctaatacatggcagacattcagcaaatgttccattctcctatcccctaattatcacacaagacaattacttttaatctgtacatattgaggagctttgcatgttgtggacactttgtcaatattcgttgaaggaatgaaattgtggattaaatttgctgtattataaaactgatatcttttacttaataaaagcttggcagtatgaattgatagaaaatgagtaagtctatttatttggtggtaatgaagattactgggataagtttccaaagcaagttataaaatattgttccattaaacttttaaaatgggatttgttttcctgctttttgcctcatacagaataagtatggctctgtttcaagattctggtgtgttcatgatgacctctcaagatcaattctgaatcacagggagaaaacgttgaaatgataaagacatggatactagaaatgcaagcaagttatagaccattttatttacccatttttttttttagctcaagcaatttcgtgtcttatatttatggataaagttgaaataaaatttccctttttttctgttaaatattaagagtctggggattagttatgcagcatctatttatttatttctgtcttataaaaattatcttaaagggcttggcttaatttctataccataaagaaaaaatgtgtaagataatccctcgctatcgggatcattttcttatataattaatgagctgaacgtaaaagataggtgaatctacaaatttatttattttctgtcttataaaaattgtcttaaagggcttggcttaatttctataccataaagaaaaaatgtgtaagataatccctagctagtcgggatcattttctcatataattaatgagctgaacgtaaaagataggtgaatctacaaagaaaatgccccaggtaccatccattaaagcatgttgctgctatatgtgcaagatgtccagggtatggcttccataattataaacaatttactatgtctcaattattatttcaattgttaattcccttgtctctggattgatgctttagtgcatcatttattgtggatattttggataaaatgaatctttggattttgtaaaaacaatatttcaaatttgtatgcatctttgaagtctaaatagcatgttatacaaattgaaaattgactgtaagagttgctacagattcaaattttatgtagtttattttttatatcttgatttgtgaagaaacaaaaaccttaactttgcttggtggcaagaacaaggggattagaacatgaacacacaggatattcagagcagtgcgtttgtaaggcatgccttatttgagtttcaggtgcttgctcattaagatgaaatttttgtcaggcagtgtgtattgggagtttgctacttgaaaatcaatagtctgcattctctgccttattgtttcaatagcctcttaactgatctccctgctttcgctattgagctccctgctgcctagctctttgagctcatctcctaacacttcccctctctccagccttagtaaatgcccccacccacatccatttgtgatatcttttcattttctcccaccaagaggtggagtttaagctccccctttttgaatggcatatgaccttggaaattcatatggtcggaaattcaaatttcccaccaaattcccaccaaagttcccaaaaaaggtgggaacggaacgtaaacccccaccaaatttgaatttgaaattcaaatttggtgggggtttacgttcccaccttttgaatgccatgtgaccttggtaatttgccttgacaaatacaatgtggtaagattgacatcatgccatttctaggtttagaccttaggagaccttgaatgcttccatttattctcttggaaccctgctatcaacagatgatgaaagacttaacgttttactcaccccattcgacaggtggccaatcatcagacatgagcgaggccattgtagaacaagaaatcccctaatcttggctaggtttcctcataggtctgggttagctgttgtgggtactcatgtcttactttaaaatatggttatttaatacctctgtattgttattcctctaagaagatgtaataagtcctctggaagatatgacattaatggacttcgctgaagttttctgtgactctttatgtctcttgacataaaagacaagaatctctttaatagaaacaaagtatttgtctctatatttttatggttgaaaatgtgacttaaactagctacaatgaggaaagaacatgttacttgattgagatatggtgtttcctttagaaaagagaaatgcagttcttattgatattgtcttactggcattgtgtacagtttgatagcattcagtattgagtcttttgtgtcacagttcttgaaaaagctttgattcttgttttaagattacctatatcttgagtgattttgaaagcaagtgccaagaaaagatgttctattgatgtatacatgacaggtgaaatatcacaccttttcagaaggcttctctggtgaatttaattccaaagacaaccagagtggaggtggaagtaaaagatacgatttgtcatgttattataagtgcattacaaaagtaaagaatcatagcccatgcaggaggaatgatgtagggtcttgtttattagacatttttccccagggtttacatagcttagggattatgcaaacaaaaacaaaatatatatagtccaagataaacaagccatattgaaattgatatgtatgtatggtattaaatattgttagatttttctgaaattctcattttttatatattcaacacacattactttaattgtacgtattaaaaaaatttatcaaaataatcaatgatataaaatctctccttatatgatttaaaataatctagctatgtcagattaaaggaaactattctgtacctctatatctggtcaactcaggatttaaccaatagggcccagggtatttttagtctaaataatatacatttatgtttaaatcattgatttgaatctaatggcagcttgttgaaacatcaactgagtgcttgactttcacagacaagtaacacatttttgactgtagcatttcatctgaacaatacaaggtcaatcctcatataaagtataaataaatcaggggattctattgtatacttataacacatattcatatattagaattttatgaagttaaaaagattttattttcttaaagattatttttagagcagtttcaggttcccaacaaagttgagaagaaggtacagggatttattttacaccctctacccctacatatgcatagcctctctcattatcaacatcccccaccaaagtggtgcctttgttacaatggatgagcttattgtgttgacacatcattatcacctaaagtccatagttttcactagaattcactcttggtgttatacattctatgctttgggacaaatgcatccaccattatagtatcatatgtattttccctgacctaaaaatcctctttagttctcctattcatctttccatctgcctagcccctagcaaatactgatattttcctgtctccacagttgtgccttttccagaatgtcatatagttggaatcactcagtatgtaaccttttcacattggcttctgtaacttagtgatatgcatttaagtttcctccatgactttttatgacttgatagctgatttatttttagcactcaataatattctattgtcgggatgtacccaggtttatttatgtgttcacctactgaaagacatattggttgcatctgagtttttgcaattatgaataaaggtgctataaatattcacgggcgggtttttatgtcaaaatacagttccaactcctttgggtaaattccgaggagtgtgactactgagtcatatggtaagagcatgttcagttttgtaagaaactgccaaactgtcttttagtgtggctgtactattttgcattccaaactacagtgaataaaagttcctgttgctccgtattcttgccagcattttgttgtcagtgttctgaattttggctattctaataggtgtgtagtgatatctcattgttgttgaagatttcatttttagtcacaaaaatcatatagcattggaaggaatgttagatagcatctggttaaaatcaccacttaatgtataaacttactctgcaatatttcgttttaagcaatcatctcatccagaatccttttaagaccatctatggaatgcttcttgtcatgagatgcagaaaagctgtatgctaccaaacattagaaggccccagggctcagtccttggacatctttgctttgtgcacttactgccttggagatctcttccagtatcatggctttaaataccatttttatgctggcaattcccaaattttcatcaccaacctggacctctcccctgaactccagacacatgtatcaatctgcttagttgacatctttattttttgtctaaatgggtatgtcacacttagcgaccccaaacaaattccttactttttctcccacacctgacccttcacattcttcctcagtagtaactttatcctttcagatgatcatgccataaccttcattccttttagctcttctttttcatgcactccagtctatcagcaaattctttcaactcttccttgaaaagaagagttgaatggactcaaaatttgactaattctcaccacacctgctgcatcttagcccagtgccccttgtctctcacctgttttatttcaatagtcttgttactgttttctctgctttctcccttgctccctttaactgttttattctgaatatggcagccagcgtgattccttcacttaccaattgtatgatattcttctctattcagcctctacttataatggtcttttatctctctcagaataaaatcccaagtccccacagttgctcacaaggttctcatgcataaacatctggctccccaatgcctcttagtatatccattagtgttttccccttgtttgctcgactccagggcacaaggctcctctgttacatcagacacaccccctcccacgtcagtgccttgcacttgctgttccttttgcctgggatgctttccacacagctatctcatgagtcattcccgctcccctgcctgtcacagtcagctccttcaggtcttttctcaaacacctctgcttagtgagtccttctctagccacctgattaaacttgcaacctacttcttaactcttttcaccaatgactttttatatatatttaaataatttcttattgtctgtctcccttcacttcagatgtcagctccatgaggagagagttttgtctgttttgttcactattatatcctgcatgcctacaaaaggccctgctttatatacaccatagaatactatgcagccataaaaagaacgagttcacgtcctttgcagggacttggatgaagctggaaaccatcattctcagcaaactaacacataaacagaaaaccaaacactgcatgttctcactcataaatgggagttgaacaatgagaacacatggacacagggaggggaacatcacacactgggacctgtcggggatggggggaaaggggagggagagcattaggacaaatacctaatgcatgcagggcttaaaacctagatgacaggttggtagatgcagcaagccaccatggcacatgtatacctatgtaacaaacctgcacgttctgcacatgtatcccagaacttaaagtaaaataaataaataaataaaatgaaataaaaattaagtcccctgcttagtaagtattgattgacagaatgaattattttttatacattctaaatattagggaattctgtacttgtagggttttttttttctcaactgtgtattttaaaggagagaaagcaatcaacaactcctttgtttttaatttgggttttctatatttaacagatttatcattttattttttccctcagtgaacttgtttattaaaaagaaatctgtcactagccaaaagctgtctaccttttagctactcggcaatattggtgcataatcatgggttcttgggatgcttccaactttggtttgacctttacagattagctctgaattagggaccactgctgggtgagaagtaaggtgtaggaagaagacagatattccaacacaatctggaataattagaaggacgaagacaacaaggaaaggagactattttcagtgcttcaggcctcatttttataactgctgacacaagcctgctattaaaatagtcacatttcctcaaatattggactttcagatgcaaacggcgcagtcaaatagttctgttaacatgacctaattttcagagctaggtgttatatgtgctttcattctgagtctgtaaacctttagacctctgattctttcagccctaagctgatagtattattgtctaaaacctagcaattttctctgtaaactttatcattttgcattttataaaatcctttatacttacctatgtagagcttggagtttactatcctagggagaaggagtacaaggcaattaaaaaaaaaaaaagccccgtattcaaagcagaatgtttcaaaaagactctacttctgaaaaggggaaaaaatcaccattgttctgttggctgaatgtgttggaagtatctcaaagaagtacaattgaattaattatattttcatctctgtgtacccattcaagtctgagaacatgcacttcactgtagttttacctccttctggattacacgagaagctgcaagattatcaagatgtcagacattcctattgggataacatgacatctttactaaggacttctgtgggtctgatgttcttcttcctagaaaatcatatgaaagatactttaaaagtgccatgtacccacttgagcttattttttaattctgatttttaaaaatattttactacttaaagtgacatttaaaaagcatattaaacaacgatataagactctgacttcacaaattagtttttctaagaacatctaattagacaacttggattgtgtcttaccagggtgcatagatgtaaccaacctaagccagcccttttgacaatctgcagtatcaaagcaaaatggaactctcgtcttatacttacattagtacataggtggtctttcttgctcatctttatcccctttttaaaaaccatagcatagtgagtaacacatcttatatactgcgtattagacacatttctgtttatctttgtccctgtcttatgaatcttcattttgattatctgagcagtgttgctgatttgctctactggctttattcaactaatgccagtactcccttattggactaaggtcttaaaactaccgtgtgcttatgtgtactaaaggtagttactgtctgcaagtgaggaatacatttgatggaactgattaattagggtgattttctgtttttgtggtcaattgaaatcttttgttaattttagctttgctaattttagctgaattttctacagtaatttttatttatccataagtatttgatttctgcaaattggaagtaaaatcactcatgtttgtttacctagttggagctcagatttttattaaaatattgttaaaattttattaaaatatgcctataaaagcatagtgactggctgaatgcattgtgatgctcacgaaaatgccctctcacatctcctaccgcaagaaacacaactgagtactgggctcgagatgctgctttctggatccatcacagctttggtgctgaggccccactcttcttaggagctgcttctagtcagtgacagagtgcagcagcaggggtactaaaacgggcccattgctgagggatgtgggaactccactgatggcaatgtgagctcaagaatccccatgaactttacactgcactacagtgtaaagcttgttttccttcctccctctcttccccctattcttcaaagaggttagacccacatcgaggtgagatcggtctcttggcctcctctggcttcctcctgttttctttcataggtgttcctctctgaccctgcctctgataactcttgggtttgtctaatcttatctttgtgtctgcttttccaggaggagaacctggattaccacatgcaaaaaagatgcttttgtccaaataatttcatgtttgggccccttattcgtatttggccacaagttttaaaaacctgatctgtagtcctaaacttatatacccctatggttttttttttttttttggaagctgttaaataagtctgaatattctcttcatttatgttgttgaacctagcattcacttcttttcaatttgaactccgccaaccagtatggaaaagtatagtctcttctgtgtctgccagtcaaaggtagtttgtttaccccatttagcaaatcatgacaacttgatgactctttactaggtccactacaatgttgatatgtcggaaaacactttcacaggctactagatcctattatgcaattttgtaacagaggctcaggctggagttaaggactcacacttgccttggaagacgtgacaccctgctatttagaatgagtggtgctttgttttgttgtgcctgttatccaggatcaagacaatgagacatttaccatccccctgcatatcattttggcatgtatccttgtgaagggttgtaggaggcagcagttattaactccttaactgcacacatattttgcaaaaatagaaattttgcttgtggatagcctcccagagttgttatggtgactcatcaacaatcatttctaacacctggatatcaatacaaattatttgggaactttggcggttaagtattacctaaatcttggtgaaaattccttccttattaaagtattatcggcatactaacagcttgctccatacatccacaattaatatttcaattttattaaaaacatctgagaatgctgattttataatgtcaactttaaatctggagaatctctgagcatgaaatggtacagtagttaccatcgaaggagcagctgaaggtcagcctctgaggtgcattaattcttccaacattaactcttgtaaaaatgtcactttattgttattaagtagaggttcttaaaaggcccattaactctggtggctacaaagtggcacatcaattataaatttgttttatgtaaacggaacccccaaatgacaccatcaacatattgctttgtacttaggatcaaaataatcaaagccactatttgaaaatgtatttgcttgatttctcagacagaatctggggatagctgagcaatcatatctcatgcattgaagacaaattgcctcagtgaaatttctattatagtttaagaaaattatcttcctgaatttgacacactgaggtggctgggaatgtagttatccagcaacacctgcttaaaatgccaataggaggtatgtggtaactttgttccactcagttgctacacatgacctttggaattgccacagctaccttacagcagagaacagggacgcacacagggattttcagagaagcactaaggaaaatttgaaatgaagctaaattcaagaagtaaatgatacttagaccttttgcaaagaaaacccagagattttaaaatagacaatagcatgacaatttataaaaatgaagctatttaaacagtatgatgtatagtattcacaatagcttaaaatattttattcccaggagcaacctaatccataactttttttttttttgctaaatgttagatgttgatatttgcaatgcattgccttaaattggaagattataacaaatttgtgtattttatggtgtactgtctatgtattgtctcacagcagctttgattcacttccatattaaccttgataatttgcttctttcaacattcaggatgaaaactacttaatataattaagttggcaaagcctgcattttggcattttatcccactctacattttcttggtactgctttttctaccctcttaatttttacacatggaaataactcatgtgcctcattgtaagtcagtgtgttatttgccaagagatattctgcatgaggtctctaataagatattgaaagaatgaaaggcattttcttattggacttgcagtcatcagaatccacagaaggggtaaattacggccaaagctttacagggtaatggttaagcatgcagaattggtgcctgaatgctcgccttcagatatttgctgtatgatttggggcaagttccttaatctctttgtgctttcctttttttttttacttctaaaaagtgatgtataaatagcatttagcacaatccatctagtacactgagaactctttattattatgggcttctcaatatcctgatatagatagacataaatgcaaaccaatcacagaacagtgcttggcacataggaagtgctcaataaataacagctaccattaaaaatagaggcatgggattgatctggattttctaaatccttgaagttctaatagttttgtacagcatggggtggaaatgagcagagcagtttacaaaagagaaaacaaaattatgaatgcagactgtctacagcaacttcaatgcaattgcataaaataaattataaatataaatgcctgcagtttccacggggaaagctcaggttagtgaagggggcctaaaatgtaggtatcattggtgtcgaaataaatatacctttgaaaacgaccttttccaaccccattgaagttatctacctctcttatgaattaagtgtagaaacattgtgaggagcagggccaaggttaataagcaaagatttcggaccaagtttttatacctttttatcctgtttccccattgcaatcccctcagtgcatgtgtgtgcgcgcgcacacacacacacacacactctcactcatgcttctaacaaaaatatgttgttacagtacagattctcagtaaacatttcttaaataaaggcagccataatgtatgtttgttagcctatattagtgtgaggaaataaagtagggctactttataaccaaaatgaggaaaataaacagtaaaagaaaaataacgccaaaacaaatatgatttatttatttatccaggaatcacttatcaactacctacagatatatagatcattaagatagggtagctgcctttgggaagtttatagcttaaaaagaattataagatgtataaaagtttcaaagtgtggttaaggactgtcatagaaactctgtaagatgagagtgtttaattttactgactgtggttatgaggaaagttttaaagagaaggtacaatttgataatatcatcatagtgaggttttcattgagtaggcaatggaagggcacaaacagaagatatagaagtgtgaaacatggaggaacactcagagaactccaaatattttgaaataagtaaatcattgggctttcccagaggtatcacaagagatatggtcagaccagagtcagattatataccttaccaaggaatactgattttctagattgagtagtgtgaaaccagagacataaaggcaattcaattggatgtatactttagtaagatcacactaggaatatagtgaagaggaccagaggaggaaagacaaattaagaaaacaccagcatgtcaggtgagagaaaatgagtagtagcaatagggatggggaatgaggaatgcataaaaagaggaagaataaacaggatttgatcatcaattggacttcaggatgaaggagagaaaggaatctaagatacccctaggttttttggtttagagaatatagatgtgaaatttaggaagatgtgaaatttaggaagatgtgaagtttaggaagatgtgaaatataggtttgattatgctgtatttaaggaacctgtgggatgtctaggcatagatatcagagttggagggtgggatcagggaatgtggctagaaagatatatttcagcaaataattagtaggtaaaatcactggaatgcatgtgatgacacaccagtaatgtgtggagtgggaagagaccaaacgcaaaatcctaggaatccaatttaaagagcaggaacaattggggcaggggaaggggagagaaagagaattgttaggaaagtaagacaaaactcaggataagagagctgtgttgtggaaatcaaagatagagttgtgctatggagagattaaataaaatgaggtcatcagtgaccttggcaagaccagttcctgggaacagaatgcacacaaatctgatgattgttcttgaaaagggacagacatgagtaactggagtcagcaagagtaaatggttgtattaagcaaatgaatgaagttgtctcagatcctcttatcttgtagtgttgtgcctagcatatttgacatgcacagcatcttttttgtttgtttatttgtttgtttttgagacagggtctcactctgtcacccaggttggagtgcagtggcgcgatctcagctcactgcaacttccgcctcccaagttcaagtaattctcgtgctttatcctcccaagtagctgggattacaggtgtgcaccaccatgcctggctgatttttgtatttttactagagatggggttttgccatgttggctaggctggtctcgaactcctgacctcaggtgatctactgccttagcctcccaaagtgccaagattacaggcatgagccactgtgcccagcccagtgtatcatttttaattacttccgtcctgtctgcaacattagttttggaaataagtactaataatggctagaaaagaaaaaaaagatcatataatcattccaagaaaataaattaatgaataaattaaatattacagtacaccaaagaagggggaagtaatggaataataccttttatttttcctttaaatttatttttaatttttgtgggtacatagattaatatatttatggggtacatgagatgttgaaataataccttttagtttcattaatatgttttctgaataaagacaaaaaacttatatgcacttattgatctgttgcagtcatttctagttgtttctagtttcagtttctttacagttcattataatgcatttacttctagtgcaccatagttttctagtttagagccttaacgcctacaaagttgccaatgactttgtctggagagccctttttattaagtttcattttgaaaagtttctttcacatcagcaagcagatatacaaataggaaaaatcttaattataaggtaagattggaagagatttttaaaaatcctactctacagtaaattctggaaattgcaatatagtccatatctttgtttctttgggataaattctaggggctttcaaatgtctctatgtcaaagaatatttaatacaaaatctccaagtggtcatataaattgttagcagtgaagaaactcaagttctgtttcttggtcttcataatcatggtgagattattgtttattttaaatctacctttaaaagtgaaattatgtaatacctgtgctttggagatagcagctgcatccaaagagaccttcaatgactttgagacattaggaactcctgttgaaatgaacctatgtaggcaaatctgtgtttgtctgggttagaatatgtgactgagagttctcccgataaacttccaggtagaattcaatgtttactcaaggataagtcataaaaatgagttaatttgaagcttatgcaaatgttgttaaaactcaacaggaaccacagcaaattgcttaaaacttggaacaaaggagttttttttccaagagtactattttgacacagatacaccgtgttttattgtgctctactttattgtactttgcagatattgtatttttaacaaattgaaggtttgtgtcaatcctgttgtacagtacgtctatcaatgccattttttcaacgcatttgctcactttgtgtctccgtgtcacattggtaactctcacaatatttcatactttttcattgtgattatgtctgtcatggtgatctgtgatcagtaatctttgatgttattatgaaattgttttggggcaccacaaaccatgcccacataggaacttaataaatgtgtgtgttctgaccactctatcgactagccactcccctatctttctccctcttcttgggcctccctactccccaagacacaaaaatactgaaattaagtcaattaataatcccacaatgtcttccatgtgttcaagtgaaagaaatagtaacaggtctctcactttaaatcaaaagctagaaatgattaagtttagtgaagaaagcatggtgaaagctgagataaggtgaaatctaggcctcttttgccaaacagccaagttatgaatgcaaaagaaaagtgcttagaagaaattaaaaatgctactcagtgaacacacaaatgttaagaaagcaaaacagccttattgatgaaatggagaaagcttgtgtaatctggatagaaaatcaaaccggctacaacattcccttacgccaaagcctaatccagagcaagatcctaagtctgcaattctaagaagtgaggaagctgcagaagaaaagtataaaggtagcagatgttggttcatgaggtttaaggaaaaaaagctgtctttataacataaaagtgtgaggtgaagcagcaagagctgttgtagaagctgcagcaagttgtctggatctaggtaaaattattgatgttggtgactacactaaacaatagatttttggtgtatacaaagcagccctctattggaagaatatgccgtctagaacttttcatagctagagaggagaaattagtgcctggcttcaaagcttcaaaggacaggctgcctttcttgtcaggtgctaatacagctgatgattttaagttgaagcaaatggtcatttaccattctgaaaatcctagggcctttaataattatgctaaatctattctgcttgtgctctatacatgcaagaacagagcctggatgacagcacatgtgtttatagcatgggttgctgagtattctgcatccattgttgagacctattgctcagaaaaatatatttctttcaaaatattactgcttattgacaatgtacctggtcactcaagagctgccatggagatgtacaaggagaataatgttttcatgcttactaacacaatatccattctgcagcccatggataaaggtgtgatttttcaagtattatcatttaagaaatacatttcataaggctatagctgctatagatctgctatagctgtgatagatctaagcaaagtaatttgaaaatcttctagaaagaatttaccattctagatgccattaagaacatctgtgattcatgggaggaggtcaaaatatccacattatcaggagtttggaagaagttgattccaactcttgcagatgattttgaattcttaagacttcagtggattaagtaactgtagatgtgttgaaaatagccaaagatctacagtgaggattggagcctgaagatatgactgaattgttataatatcatgataacattttaacaaataaggagtcacctcttatggatgagcaatgaaagtggtttcttaagatgaaatctactcctggtgaggacgccatgaacattgttgaaatgacaacaaaagattcagactattacatagacttagttgattaagcagtgacagagttgtagaggattgactccaaattttaaagaagttctatgggtaaaatcttatcaaacagcattgcatgctacaaataatcctttataaaaggaagagtcagtgcagcagacttcattgttgtcttattttaagaaattgccagtcacctcaaccttcagtaaccaccaccatagttagtcagcagccaccaacattgaggcaagaccctccaccagcaaaaagattaagatttgtggaaggctcagatgatcattaacatttttagcaaaaatgtacttttaaaattaagttatgtacattgttttcagacacaatgctattgcaagctttatagactacaatatagaatacacataacttttatatgcaccgaggaaccaaaaaaatttgcgcaactcgcgttattgaggcatttgttttattgcagtggtctggaactgaatctgcaatatctccaaggtatgcttgtattatttagaactgccagcacatggtgataacggaaagcaattgactttaagtgaattttattattactttaaaaaattatctgcagaagatacatttgtttgttgtctgctccctatgcctggtctttggaaaaagcctctttttaagcaattaacatcctttttcaaagttaaactttttctttgataaaatttaaatgataaatatgttaaggatcacctatttcttaaaatattgaatgatttcaaacatatatgtcatctttactaagattacttacccatgttttccaattctgctagaaaaccagtggatcattctttgaagggtagacagtgtaccttataggttagatattatttcttatgcaacttatagtacacagaaatctatttttaaacgtacagtaaaagttaaacatacatgcagttataatatgcaatgatggtctcctacaaaaaagatcttagctattgattgattgattgattgagacggagtctcactttgtctccaggctggagtgcagtggcgcaatcttggctcactgcagcctccgcctcctgggttcaagcgattcttctgcctcaagcttcccgaggagttgggactacaggtgcgtgccactacgcacagctaatttttatatttttagtagagactgggtttcaccatgttggcgaggatagtctggatctcttgacctcgtgatctgcctgcctcggcctcctaaagtgctgggattacaggagtgagccaccgcgcctgggcaagatcttagctatttaaaatacgtatttcaaaatctctccttacctagtatctatctttgtttacttaagacgttgtaatataaatttgaactaggttatggtatttatgtttttaaatcatttaatttttccattgagtaccactctatggaaaaattattattattgatatacaataatatataattgtgtaataattatataatattgatatacaataataatatttattactattattgtatatcaattatttattgatatgcaatggtggtctcttacaaaaaagatcttagccatttaaaagatatatttcaaaatctctacttagtattcatctttgtttacttaagattattgttataatataaatttgaaataagttatggcatttatgtttttaaatcatttagtttttccattgaaggtaccactcacttcatattagtaagatttctgtgtgtttcttttgaagaattattcagaagcagacttcattgttgtcttattttaagaaattgctgatactagctagatatttacataaattgctttgactaaactataattaccttgtcactgttttctagtcaattgtaatgcagaaaaaaataattcaaactattaatatcatggtgaaaagcatgggctctcataggacattatcaagctaaaattccatatgtgctactaatcatgttaattaatttctatgcctaattctcttcatctgttaaatggggctaataatactacatagctcattactttgttttgagggttaagagtaaaaacacacagaaagttcttataataatatctagcatattgtaagcactcaacatgtataagttattttaggagataatatataataattatgtatttatttcattttcttttctttttttttttttgatggagtttttgctcttgtttccaggctggagtacagtggtgcaatctgggctcactgcaacctccacctcctgggttcaagcaattctcctgcctcagactcccgagtagctgggattacaggcacacaccaccacacccggctaattttttgtatttgtagtagagacggggtttcaccatgttggccaggctggtctcgaactcctgacctcaggtgatccgcccccccgcttagcctcccaaagtgctgggattacatgcatgagccaccgcactgcgcctggcctatttccttttctttgcttatgttgcaaagtgagaaatgcctcatatttaaccaagttgtccctaggactttaccaatctaagaatttttttttctgagaaaggcattctgaaagtcaaatctagatatactttaaatcaatatcactttaaacatttacgttagccatgttttttacagtgtaaaagactatcatataaattctgttaactatgttttattgttccctgttgtaaatttttatttatttaataaatctgtttataagaatttttttctcaataatactactgaaaaaatagatttcatccaagcacagtgttaactagataagaaaccaacccaccctattttaatagcagcattaatacttttccttaagaaaacaagacagccacttatagtataagtaagctaagaatgtcaaaagggcgctcaatatgtctttcttcaacataaaaagtgatgacaatcgatcagtctgactttcacaagaggctccctaggagagaacagcatactgataatagtaagggcaggaagcctatttagttgttttatattctgtagctctctgactgtcccagtagttacaaggcagcatgtttgacacatagctaaaattcaagatgaacgcaacacacaaaaagagggcaaaacatgatgggaccaataaggagagatcatttcttattataaaggcattaacttttttcaagatgagtgacttggagttttgagctgaagggttggctagaagaacacttcggtttacaaagagaaatgcaccctgtaatgaactgcagtggactctaaaatgaaattgctggaggctacataagaaatagaaaaaacctagaagcacaatgaaaaacatcccgatttacagcatccctaaaggcagctgagggttgaccccattactttcattgagcaatttgttccatctctcctcacacataccctcactaggacttctaaaatagaaagatgcacaacatcccttagccctttccactgtctcaaaaaggtccccaaactttgtttactaaagttttagaactttatgttttactgtgtttagtatttatttaattttctattttttttttccccttgacctagatcatagaataatatacttagaggacatttttctaaatgcaagttgctagaaatgacttggcaaagattagtacaattcacagtgtcctgcagcaatagaattaacgaggagtttttttaaagagagactgatttaattttttgatgattttgaaatataaatgctaagaagaaaatttgaaggaataattttagataatttatatctaaagtgttacaagcattttatgaaacactagctatcagattagtcaacagctttggttttaccgtcaacagatattctttaaaacattcatacaatttattgtgtgcttatgtatatctttatgcaatctttatgtgaacactcataggggactattgtataatgctatcattgttagcaacatttgtgctttgtttctgaagtcttttactgtactagtaatttttttctttgcagaaactaaagttttctattagaaaaactttagttggatcctgatttataagcagatataacaaacatcatgagagtcctagagaatatcatgtaatcttcagttgttcaatctgatgattaaattgggcagagaaaagagttccagttatgtgaaaagtatttaccgtgttaatgaatctgtgccaaaacgttcatagaggctcaacttcaggccactccctgtgttaattgctggggtaagatgtgtaacgtagacacttgcctctggatgggtcaggctccagtgggaccaggtgcattgcaggaggaatgcattactttgcccaagcgcttattaggactttgaaaagaaatgctttcattatattatttgatgttttgtacatttcagtgtcctggctagctttgaagatttcagagtaaaaagccacaatttggagattgatatttaatatttagaaacaactatgcttctgtttctctctctgatactactaaaagcaataaaccaaatatttattaaataattagttcatgggaaattatgccatttttttttttttagttggagtctcactctgttgcccagtctggagtgcagtgggaatgatcttggctcacggcaacatccgcctccccggttcaagtgattctctcacacagcttcccaagtaactgggattacaggcacatgctaccacacccagctaatttttgtatttttagtagagatggggtttcaccatgttggccaggctgtctcgaactcacgacctcaggtgatccacccttcttggcctcccaaagtgctgggattgcaggtgtgagccactgcgcctggtctcaaaccttgtattattagattaaattggggacctgcaaactttttatacaaagagccagatagaaaatatgtttggctttgcaggccgcatagtatctcttgcaactactcagatctacctttgtagcatgaaagcagtaatagacaatatgtttaaaaaaaaaaaatgagtgtggttgtgttccaataaaccttgatttacagaaacagatgcttggaatgatttggcctacgggccttttttttttttttttcttgtcaatccttgaattaagtaaagaaagtgacaggtttcctgctagaaaagggtttgttatgaggattatgtgatttaatatatgtgagatacgtagagccatgtctgcatgtagtgaatgctgtaaatgtgttatttattataataactgttagagaaatgtagaaacacatctaaaccatttataaggattacatcttgaatatatatttctttaaaacctggatcagtgactactactatacctagatttcaatttatcaaccaaccaaatacactgtgaaggattttgtggatgaaaaccttcagatgattgagtgtttcgattgcatattgcatatataagggttttctctaatagtagatatgaatagattcaataatatatgcttttttcatttgccattcatatattctttaaacttctaaccatttccccaaacttggctcattaaactgatatacattggtttactgtttatactcctgccttattttttgcatattataaatataatacaggtgtttctcagcaagaaagacaattgaataccaatgttctgaaatattcttgtttctgtcaaagacatgttcatcacaactctaccacatacactatacacatatatactattttttattttaccagatttttagaaatatccaaaacctaaaatattccagttgggggacaattatgttctactgggataagagaaagacagaaaaatgtggctttagaagcctagaaaagcagtgatttagttaagcatattcaaattttagtaatgcacagtcctgactgacacttaggactttttaatgtatctttttatttgtaggtaagattaaatagaaaataccatatttaaatctgtgaattcaaaacgatattttttgagtgcctataccatgtccaggttaagtttttctactctaatggagctaacattttataaaataacatttataaagtaagataacaaatgagtttttaaaacttggatataatttttactagagaaatactctcataaaaaccagagagactaagggaaagagttatgaaaaatagagtgaataactattttagatagggtggtattgaaagactgtttagagaaggaggcatttgaacagagagagttctaaatgaagtgagagagcaagtcatgtgaagatctagtagtagagtgtttggacagtgggaactacagtgtgaaaggccctgagatgagaaaaaagctgggatatttttagaaaagaaggaggctagtgttgggcatgaaggaaagtgatctgaaataaagtcagtgatcatttagggcctcgtgggctgtttttagatcagtgtagctctctgaggcagacatgagatggctgtgggtagggcagtgctgtgaacatcattaaagttttcccaagacccttctggtccatccagtggtagtagatataccagtagggaagctattatagcatttccctgggaaatgatggttgttagactaaagtggcagcagtgacaagggtgggaagaggtgattcaggatacatgccaaggtagagctaataggaattgctgttgagttgaatgtagagtgttggaaaaagagctgagtcaaggatgttttctatttgcgtcaggtagattctggtgtcatttactaagatgggaaggtttatgttgacagggagttgttaagaatcacaagttcaggccagatgcagtggctcatgcctgtaatcccagcactttgggaggtcaaggcgggcagatcacctgaggtcagaagttcgagaccagcctgaccaatatgatgaaacctcgtctctactaaaaatacaaaaattagccgggctgtggtggcatgtgcctataatcccagctactcaggaggctgaggtgggagaatcacttgaacctgggaggcagaggtcacagtgagccgagatcatgccacggtactccagcctgggtgacagaaggagaccctgtctcaaaaaaaaaaaaaaaattaagagttcagttttaactgtgttaggtttgtgaggctttctctatattcaaatggagctgttgagtaggcaattaaacattggaatctagagttcatggaagagatctgaattgcagatatacatttgagaggactcggtatgtaaatggtatttaaaaccatgagtctgtataaatatcatcaagatagtgagtgtagacagagaagtccaaatactaaatcttgaggtatttaaattttagttgtttggcagaagagatgaaccttcacagaagaccaagacgtgcaaagcaagttacaaggaaagctaggaaagtgtcacagccctcaagccaagtgaaatatgcctcaagatgaaatgtgtgatcaattggcaaaagctgtatagaaattgagtaagatgagaactgtcaaaattgctcattggatttggcaagatgcaagagaatgttggccttgaaaagaagagtttcaacagagaaattaaaaactgcagttaatgaaaaaaataggtgaggaagtggaaacaaagagtataaacaaatatttgactgagtttgctataaaaggagcagagaaatgctcttgtagctgactaaagacacgggacttaggaaggttattttttaaatggatgacattataatacgtttgtttgctaataggaatgttccaaagaaagagggagaaatttatgatgctgcagagaaaaggaaatattcaaatagtaaattctgccataaaaaggaatgaattaatggcatttgcagcaacctggatggaactggagactattattctaagcaaagtaattcagaatggaaaaccacacattgtatgttctcactcataagtgggagctaagctgtgaggatgcaaaggcataagaatgatacagtggaccttggggactctggaggaaatggtgggaaggaggtaaaggacaaaaggctacaaattgggttcagtgtatactgctcgggtaatgagtgcatcagaatctcacaaatcaccactaaagaagttactctgtaaccaaatgccacttgttccccccaaaaactatggaaataataaataaataaataaatagcaaattatttgagtaggcatgaagaaatggaatccattgcactagtggagggcttggactcagataatgacaataatggccatcattttttatgagtcatttacatatattaactcatttaattctaaaaataaccctgtaagctgtattttattaccacctctattttacatggacagaaaaataaacacagcaggttaagctagtaattggtagaggtggtttccaaactcaagttatctcattccagagtaccactctagagagttatatgttatacagtagatgtacatattataactgggaaaaaaggcagactacacagataaagttagggaattttttacatgtcttcataacaagatgatatagtatagtttttattctatttttcactaaagttaagtgcaagattatcatctgagaataagaaggagggatgggccactgagggatggacaatatgagagttgaagaagggatgggcaatgtagggaaagagcaaaaggtatgaaatatttgtcaagtacaggagtaaaatggccatggaaaatgacctgcaaaatctgccagtgccaaggtctcttgaagatttttgtcattattttaaagtgagatgcatcatcatgtgaggcagagagctaatttctatccatctttgcttcaaggtgtcaccagtgaaatatcgatggtgggactgacaggtaatctagaggaatagagcatgcctttcgttttcatatctgtcatccttttatctggcatggaggtgtgatggctagaactttgctagtcataattgaccatggagataagtaccacactctaggggtggtaggatattgagccaggcggcagaagtttgttctctgatgacttcattgaagtgccacagcagtcctggacttttcgcctgcagacatctctaatgggagtcagaaataaatgtgtatcttgtctaagcctgtttaggagtctcttcttcttatagtcagacttaatcctaacttattccagaatttgttttcagaagcgggttgctaaagggacaaaacctaaaaatatgactttggttaaatggaggcaaacaggtggttagcagcaagactcagatgttgcagtttctctcaacataggccactgttctgatggacacatggcatatagggagaattattttaaatatactttgggttttttttcaggtgagtaaaatggagagagaaaaggagattccacaatttcctttagtaacaaatttcactgtctagcaaactttactttcagggattgctttcaggtatgtcacttaatatttgtaccacttcatctaatttccattttcttatatactaaactcaagagacacatttagttaaaatttttaataaaatcttacacttgtcagatatttcaaatattttactttactcctgtctattataggaaatccaaaactgacttatatttaccttcttaaaccttgatatgttctcacaatctttttatttttcaaagatttatatcagtttatgacagtataactacaaaaaaaagtatagtcaccaaagtaaacaatgacatactccttgtcaaatcttagggcctatttccacgctcttggcccttatttcttatcttgcctttttcccctaaactgagagccaacatcatcatgggcgtatcaagtagagacagatcaatttgtgttggaatccagttagtcatttactagttagttatgtacctttagctagtcagaatttctttctaatcctcagttttcatccacaaaatgaactgtgttaaagactgaataaactaattttgtttactcacatttagtttatactttttttttaaaaccttcctttctttggttcaatttacaccatgcaccacctacattagtacctattgatatttgcgagggttttatgtctttgccccttctccatttctataaccatttctcaagccttcaacatggtactccttgccagcaatcattctttgctacctgtgttcctacccattctctagtttcttccagaggttccttgtccctcagcaggtctgccttcttactgcctcctgcataccgcccacttgcaccattttctatatattttctcttgcatcaattttccattgcatataataatctctagttcacaaacctgtatttgtaactctattttaaagacaatatttagtcttacttcatcccagaaatcattgactaacttcaccacaattgagacatcacttacatgaagttcctctttgtatgtgtataatttatcctcttataccattaaatttcttgtattgatcgttgattttattttaggcttgtcttaattatccatttaggatgtaaaatcttccttgtcttcatgatccgctgatggtataaaacttcctttgtttaaagaaagataaaactatctctgctgttccctgtcccatgctttgcagtgctatcactatgaggagaatttattaatttatgcatgctgcatttaatatgtaaaagcctttaaatacatgaagattggtactacaatgtcctcgatctttgctttcttaaactcaaatagtcttagttactttaaaacattttgcctagtgttatttttgtgtgtgtgtttcctctaaattcaagtgtttatattcttctttagttgagatccagaatcggcctcactgccatcatataatcaaattcatgcagagtggattggggagtttaattcctagcatctcctcttacctttgcttccatttaaaaatttaattatttctaaaattcaactaaaggccctcatttattataatttatatcattgttgaattattaattggttatttatttgctatacattatagtcaagcctgtagctgaataaagtataccttgatacattggaatacttatataaactgcataggcactaaggggctaaaagaaagtaaagtgggatatgataataaatgaaaacttattggagtagaaaatgaaaaaaatttaggttatattttatttcttttaattaagatggaattcatataacataaaattgaccactttaaagtgaacgccaatggcatttagtgtagattttattttactttatttttaacagctttattgaggtataatttacataccatacaattcaccctcttaaagtttaaaatttaatagcttttcatatatttacaacattgtgcagccatcgtcacagccaattttagaatattttatttaacccccaaaaaaccccatacctattagcagtcattccttattttcctgtatccactatacctaggcaaccattaacctactttttgtctctatagatttgcctattctggacatttcatatgaatgaaatcatatatggccttttgtatctggtttcttccatttagcataatgttttcaagattcatccgtggtatagcatgtatcactactttgttcctttttattgctgaataatattccatattgtgggtataccatgttttattatccatattatgccatattatggatatacattcatcagttgatgttcatttctgttgcttccatcttttggttattatgagtagtgctgctataaacatttgtatgcaagttttacttttaatacctgttgtcagttcttctgggtatatacctagaagtgtagttgttggattatgtttaatatgtaaacatattctatgtttaacattttgaggatctgccaaacagatcctttcctgatttctaaaatggaatatttatttttttaactgtaggctttacattccttatatatctgaccactagtttattgtaccataacaggtatttcctgatttcttttgtgctttgctttcatcaccaaataacaacttccttgaacttttaaaattacatcatttatagaatagaaatatgaaaagagttttgtgattcttagacatgaacacttccataattaaagatattcttacccctatggtaacacatggaatgaaaaggaaaatttgattcctaacattctattaattttattttctttatatatctcttccatgatgctgccaaaataattgggctcaatttaaatgcccttgtctgcttgccagtgggatgcatctgagaattcaactgtgctacattttgtttgaccacctatgtgttctactaacccctctattaactaaatgcctttttgatatagtcagtgttacttaattccaagggaaatctggggaaaatattgtaatttactgtgtacagtggagataaccacagtatgtaatatccattattgtatgggaattgtactcaagttagtccaatatggagtgatggttttaaaccttttagttaggaattaagtaaacaaatatttgtgaagcacccacccactaaatcatacaagtcactgaattaaggagagaaagtgaaaatattaatttgtggcttaattattaatagcatattaaaaatgtaaaggtttattatggttttagtcggagtttatccttcattacatatacaagtatgaaaggaaagaattatagcactaagccggtaagagaaaagcagcttgattctcttcagagtgaatagaaggaacataaccgtaaaaggaatataaacaataattccgagtgggagagaaataaattatttttaaaataattcaaggacatggcttaatgcaatgagataacatagacctgctaacctcattccagttaacaaagcacatttggttatattgtatcttttacagtttcatagtttgctgttttatagtaggaacaggataagctttaactgccttgttttcctttattcttccttttttgaccctgttaaatttaggaaagcacacacttggctcataagtgcttgttcagataaaacagtgtgcttccaaatgtagcagcaacccaccttcatcagaatctcctaagagggatgtgattgcaaaaatatcatttttcttagccctacatcatggctcttagatcagaacctctaagagttctgagctgagttatgatatagggctaagggagggcccaggaatgtacattttatcagtaaccccaggtgattagggtagggtccaggaatgtacgttttatcagcatttccaggtgattctcacatatgctaaagtttgagaaccactatactgtactgtattccctgctgtagtgactatgattgagcagaatggttaaaagcatggactttggtgtcaggcttatttgaatttaagttctgattctgttacttcattgtgatcaaaacttggataagcctcttaaattctttcagcctccactgtattcagctataaagtttaagataaaaggtgattataatctctatttacctaaagaataaagacttattaacataattctgccttatcattcttactattattagagatagggtcttgctctgtcacccaggctggagtgtagtggcatgaccatggctcactgcagcctcgacctcttggactcaagcaatcctcctgcctcagcctcctgattagctgggactacaggggggaaaccaccaccatgcctggctatttaaaaacaattttttttttttgtaatgacagaatgtccctatgttgcccagaatggtctcaaacccctggggtcaagcatcctcccaccttggcttcccaaagtgctgggattacaggcatgatccactgcacccagctgctgcccaattattaatagaatcttcctttattcttaaaactatcccactttagaggataaattatgtgatctagcatagctatgtaatcatttactgtgatgattatatgacatcacttatttgatttgatacagttggcacataatacatattttttaaatgttcttataattaatgctatttttaaaaatcaggccaactctgggcccactgcctaggagttagcccttctccataaggagcagtaaaagcaaacaaacaaacaaatttgattttttttttattttaacagagtactcaggattatctactgctttaattgcttttaaaaattgatttccatggaaaagaggtcactgattattgattgttggctagttttgtcctccatgggtacaggtctttaagtcattttgtcctcattgtttttactagcttggccatgccagttggcattgtcttgtgctaaaaggcattttgtagtagagactttggggaaaagacattcaagagaaggataataaaagtctgtacagtggaactatagtattacacaaatattattgtctataagccctattacctacaaaagataaatatgacattttccttctcttattagcttcatgatgaaacaccttgctattctgccttcagtttgcttttcacttccaagtaagtatattctagccatgggagagaggtatttaggtgtttttcttgtagttagatgggaatcctagactctctactcagactgctctgagcctaagttttttttttcactttttttttttttttttttttgagatggagtctcgctcttgtcgtccaggcaggagcacagtggcacgatctcggctcactgcaacgtccgcctcccgggttcaagcgattctcgttactcagcctcccaagtagctggaattacaggcactcgcgaccatgcctagctgatatttgtatttttattagagatggggtttcaccacgttggccagactggtcttgaactccttacctcaggtgatccgacctccttggcgtcccaaagtgctgggattacaggcgcgagccaccgagcccggcctctgagcctaagtttatcagtaatctcctaagtggtgccataaggatatgagttaatgtacatagagttcgtagcagcacatctttgttctcaattattgttttctttctttcttttttttttttttttttttttttttgagacggagtctcgctctgtcgcccaggctggagtgcagtggctcaatctcggctcactgcaagttccgcctccggggttcacgccattctcctgcctcagcctcccaagtagctgggactacaggagcccgccaccacagccggctaattttttgtatttttagtagagacggggtttcactgtgttagccaggatggtctggatctcctgacctcgtgatccgcccgccttggcctcccaaagtgctgggattacaagcatgagccaccgcacctggcctattgttttctaataccattattaagaagaatattggtggtcttaaaattgagcgagcagcagattttagggtaatatgggacttatttggctcattggcttctttcagccaccttgttcagattttttgcttctccagtaaaaaaaaaaaaaaaaaaattgttcttctttgtgagatggatgggggaaaaagaagtcatatagtttaaggagaataaggaaatcccaatatctgaacatttgagggagaagaactcaataatcaagggccaagtgacatagcagatatattgtgttttgcagtgtctgactgtcaacacgtaacaataagtggttgagattttcatactcaaggccttattcattgctttttagaaagtgtttttgttccacttccaatgaaggcataattctcaatgaaatatggaaagtgttgtagtcaacatgaaaatacatatattcaaaatagcatagcattaagcctgaagtatccaccatcatttttattcacatactactggtatttaaaatatagaaaataaatagaaatatagaaatataaacttctacagctattgccttcataaattacaaccttcatggctatcatatgtcccaaatatatgtttcagatatgtgcaaatgatgataaagaaacattcaatcatcagttatctaggagacaatgatacacactaggttatcttgagttaattatttcatgccaaacttaagtgactatgtgagaaccatatgtttggtgtgtaattcacactttcaataatgtttgtatcaactgaaatatttttcaatgaaccagcatccttataatgaacatggtgttattataaggaagctggcagtacaagtggtactttgtgttttctcatttcatgctttcatttagatttaagatgttcttggtttcatttccaagttggcatgagttagcagtaaataggaatctgctggcttgtgttacatttgcttttctgatacctctaaagaaagaatgggaagaattcagaacagtaatcagttttaattgaggttatccagatagaagtctttgttctatctaaatatcaagccaaatttcttggtatataatcagaaggaaccatgttgatttctctacttattgatgggtgtatgctttgattaaggagtcacagggaaagaagatggtaatattctcatagattaatgattgtggattttcagcagttaagaattgtattcaacctagaaaacaacttctaagaatcattaatagtgcaattcatagaagtagggttgattaaaattatgaataatttataaaatgtaatatatggatagaaagagcacattggctttatttaactcatgattaggcatacatgattattccattttcttcctttagcattgacttttagattatggaaggagaatgcctctagagagttaaagaataggcacagcacaaaagtaaaaatgaatgctccaaaagtagatatatgttgtgcttctgatgactttgcattttgtaatggatttccatcaaactgccttgctgtatcagtcagaatagtctaggttacattgtagtaatgaacagccccgaatatgaatgggctaaaactgaaaaaacaaaagatgtgtttgcatttagctcttgctatatgtctatttcaggatggagttgctggctgatatggtttggatatttgtctgctccacatctcatgttcaaatgtgatctccaatattggagatggggcttggtgggatgggaggtctttggattatgggggtggatttcttatgaatagcttggtggcttggtggcatcctcatggtaatgagtaaattctcattctattattttcttgagaaactcatatttaaaacaagagaaatgtaggtatctctaaagactgtagtaacccaattttattgatgatcagaggccaaaaaagccttgtaaccttacatgttgcttaatcctgatcatgtaacagaatcgtttggcaagagtttgaaatgcgtgaattcttggctcctattttcaatgttcctaatttaggaggtttagggtgagacccaagcatctatatttattcccttaagaactggttgttaaaaagagcctggcacctctctctttcttcttctcttgccatgtaatgtctgctcccctttgccatctaccatgaatggaagctccctgaagccctggtcagaagaagatgctggcttcatgcttcttgtacagcctacagagccaggagccaaataaatctgtgttctttgtaaattaacccagcctctggtattcctttatagggccacaaaatggactaagacgggacatgggctgtgttgcatgctatcccagactcaggcctgaggaagactccaagtggaatgctcctggtcactgtggcaggaggaaggggagtgctagaaaatcttgcaatttaattaaatgctgtcgtccagaagtgatgtacagcatttctgtccacaactctttggccagaattattctcatgaccctgccaagggcaaggtggcaaagaagtaccattctttcatgtggctgggagggaaaaaagaaccagatttagaagagcattagatatctctgtcacatctgaggaacaaattagccatcagagcaaaggtccaggcatcccatctcggcaaacaaagcatgattaaccctagagctgctgattctgagctcaccctaacttgattccctccactggccccaagctggcagctgtagctttgcaaacatgataatgcttctcttgttagaactgaatttagaattggcagcaacagaaacctgcaagctgcagttcatttgtgtatccatgcttaatttaattcttattgaatgaaatgcaccctcattttattcttgctggaaaaaaaaaaaactaacaacataaaagccagtccaactattaaatcaagattttctacaagatttgtgttaattattctctctgtcctttcacaagaataaaactgattttatttatcagttttgattcatttttgatacttgaaggaatgaggagtacagaccagctatggactatgtttattttcctgagaaactcatatttaaggcaagagaaatgtaggtagctctaaagactgtagtaatccaattttattatcagaggccaaaaaggctttgtagccttacatgttgcttaatcctgaccatgtaacaaaatcacttggcaaaagtttgaaatacgtaaattcttggcctctactttcaatgtttctaatttaggaggtttagggtgaggcccaagcatctatatttatatttaaatctcaccaggtgattccgatgggcagccagaagtgagaactgtcctggaatgttatgtaaaagaaagttattatttttgaacttgttttctaaatcaaataactatccaaacctaattttccaactttaagaataaggccatctatttagcagtacagaatccatgcttacaatgtttctggttcacttcttatgtgaaaacactgaagttgttaaataattcatagattattttgcaatcctgccagtctttatgtgtttcatgttcttgtttataagtcagtgagtagggaatacatccattttgagaatgccactctgttgtagttaatagatacagatcccattatcatagttattctaatatatgattcaccaaaataatggacaaaatgatgtaactaacaattgatttgcctgctctaatacctttctttaaaacactgtaataaaacaggaaatggttttttttaaatcatatattttgagtcaggagactagagttaaaatgaatcctagagatggaggatagtaaacgccaattgtgaagccagtaattacaggaatccatgtagtaataaacttattgtttctgtcttcaaagtacctttacttcatcctgtttaaagcttctgttgcaagcatgtcattttgaaagtaaattagactaaacatcattctgatgtccatagttcaataaagtagataaaatgcatattctatgaaagactgtcaaataaatattatgcttattcatctctctgtttgctttaaaatatactttaatttatgtaaatgagcatttaatagaaataaatagtaatgaagccacataatgcagatattgtcaagcttaaacaatccagacataggtaaggagaggcactattcaaaaggattattttaagagctgggagagggactattgcagtagaaagaatgctctagctatgagatctgtattttcaaagtcagataaaaatcttttctttgcctggccctcacctgagcactgcatatgcttactttatctcaaccctaggtggtatgaattactatccatttttagctgtcaaaattgagacacagagaagccaaatatgtcactgatattttggtttatgggggtagtgagcaaagttaggaagaactaggtgtagggaaatggtattgaaagggtggcatgacggcatgatcatacagttgattagggaatgctttttcctaacgtaagtcaatggtccagaaggcctcttaaggagaggttgtatgccgactcaggcggtgtgcatgtgtcacagttcagagacctgaaggaaagagagaagctttagttaaatttggtgaagccaaactggtaggtattttatccagattagtcagaggtataaacagttcatctaatcatttatggggtaaagactgggaatttggagggtctgtgtctggccttgtctaagtaaacaagaggggcatctgtgagtcttatctaagtcatacaggaaagacagtaagcctccagaagtaaaagggtgggaagacatctttaaccatcattgtttttcaggatcagagggctctgggaaagttcatggttcatataaagcaatagggtctagctaagtctcatccaataataggtatcatttagtgattgcctggccctcagttgagcactgcacatgatcactttatctcaaccctatgtggtatgaattattatccagttttaggtgttgaaattgagacttggaaaggccaaatatgtcactgaaatttagtggttaatctagaattcaaacttgaatgtccatagtaaaaaaatcaaactcatagtcatttatactatgacatcaaactgaagtagaaggtgcaatagtttgtttttataatttataacaaagtcattaacatttttaattattaaaagctaatgaatttttatggttcttttatttttctcttgcattttcatagatgagttccattcagacagtttgacaattaaccatgaaatctaaaaatcagaaatgattagtgccttgagttatacaatgagaccccatattgcttaacagttagaatctattgaattaaaaattaagagaaatataaaatattcttcaaagctactgagttatgcttaggatactggtctttgtaaaggaagaggaatgcaaaatgagtcatgttttattcaaggatttaaagtccagtgggaaagctatgacaatacctaatatataaataattataataataaaccacattgtcaaaagagaggtataaataagaaaggaaggtaaataaagattaatttacatttggtcaggagtatttttaagaaattgaaaaatcatacataaaaactaaaaatattggtagttttattaatgtggaatagatgattgctaagttagcttaactagatttagtaattctgtgaatgcatgatatatgtcaaatatagtacagtctttcagagaaaaaagtcatctttcaaaatgtgaaaatgctttcctattattcccaagtttcagtcattttagtgagaagtattagtaggttgtggaatacatatttcaagaaaaatgcactcaacttttaatattactcttggatttaacattgaggcagagaaaaatgctctatacagtttcaaacagatatgtattttgtgttctgaaatatagagattgaatgagagacaggaatgaacaggaccctaaggctgaaatctttacaaaagcataactgtggaggaattcacctcccaagtgaacttctctgattctcttgcttttaaacattatggcaggctctgttctttttctttggaccttgctgcgagatcctgctgagaagttctctctgcagtctgctaacagacatgtacagtgaaaattaaaattattcaattcatatatgaatgagcatattatatccagaacctacagattgtatttttgtcaatgtatggttttaaactgtttgaatttaaaaagcaatggaaattaaaatgtgactaggactttaagctaaattgttttaaaggagagtaatctgtgaaattaggacatctagagttgaaccatagagtttagaattgcaagaggacttaaaggtcatggaatccaacctcccacacagtgcaggaattcccttgtaagaaattcttagtaactagtcagctaagctctgtttgaatatccttagtgttgggaatctcactacaggggcagacatgccacttttgaatagctctaattgttaagaattttctgaactcagaaataactacctagcaaaagaggagtacttaatttgcatcagtgctttgaaaatttaaaaccaaagaaatggaaaatatcaaataatttctaaattgaataccagctccaaggggcagaattagtctcaatcattgtttggtaacttttaatactgtttccctcatgactcataatttcataaatttttgctattttgtttactaatataggggaaaatatgtgtttcagtggaagagcatgcattgtcacatatagcacaggcttgtggattattagattctagtctatcattgcctttcagctattttataactataaattttgtcttatttcacaaaatttccaatgacttctctcccaatcatgggtaagctagctttgcctccatttgcaattcagttcccttactcccagaaatgtgtgctttttaattttcctttgaactggttataacatctatctggttttcttattgaatgaataaaaataatatttttaatacatgctcattttcatttttatatctgtattagtcattattttaccttttctgaaaattatcttttaatatttgtggaggtattcccaccaagatgcccaatgatttgcttactagagccagatatactttctcatcagagaagggcacctattgagcagtttaaacctaggcttctacctaggatttctgactaaataattttgttgactgtctttcttatttttattttccactctactaattttgtgttttgcttttggtttgttttcagccagtaagttatttctgattgctggcaggaaatgttgggaatttggttttatggtctgaccatttggtgaagttattgcacatcactggcaagagtagttggaaatttggcctcaacgtcttatcatttgatgagttctgtaaatgcagtaatggtttaaagagttattttctctgtcgggtgtaagacgacagagaatcttgtttggtagggttttctatttgtcttatttgtctagtttgagctcaagtcagtgaagaatttcatgcccaccagaaagtagatatctagactaatgagtttttatttctgtgttcgtgttgaaattttagaattaaagataaccattttaaagatgctcgatgagctaagagagaaaacagataattaagcaaaatcaggaaaatgaacaaaatgaaaatatcactgaagacatacaaactataaaaaaagaacaaaaattttggacttgaagaatataatagctgaattgaaaaaaatcaccggaagggtttaccagcagacttgattgactaagtggaagaaagaatcaatgaacttcaagacatgttatttaaaattatcaggtcagaggggcaaaaagtaaaaagaatgaacatatatgaagagagactacgggacttatgggacatcaggtgggccaatatgtgtattatggatgtgccaaaaggagaagagagagatggacggacagagagctcaattaagaaaaaatggctaaaacatcccaaaatggaggaaagaaatacaaatataaattcaagaaattcaatgaactctatgtaggagaaaccccaaaagatccacacagagacacactataattacattttagaaagtcaggtacaaagagagaatcttaaaaattaaaaaaatatatatatatatcttgaaataagtcatactatatctttaaaaaatcaagagaaaaatgacttatcctgtacaaggtagctttgacaagttatcagtgaatttcttagcagaaaccttgcagaccggaagggagtgggatgatatattcaacatactgaacaaaaaagaacagccaaactagaatactatatctggcaaaattgtccttccaaaatgaaagagaggccgggcatggtggctcacgcctgtaatcccagctttgggaggctgaggtgggcggatcacttgaggtcaggagtttgagaccagcctggccaacatggtgaaaccctatctctactaaaaatacaaaaattagctgggtgtggtggtgcacacctgtaatcccagctactcaggaggctgaggcaggagaattgcttgaacctgaaaggtggaggttgcggtgagccaaaatcatgccattgcactccagcgtgggtcacaagagtgaaactccagctgagcccccgccactgcaaaaaaaaggagaaattaagattttcccaggtaaataaaagctgcaggaattcatcaccagtagacctgccctacatgaaatgctaaagagtatcctgtaagttgaaatgaaaggatgctagacaacaacatgaaaccatataaaaatattaaaatttttgataaaagtgaatatatagacgaatatagaatcctgcagtattgtaatgttaatatgtaaatcacttttaattctggtatataatttaaaatacaaaaccattttaaaaacctataaatccataataatagaaacataatataaaaagatgtcatttgcaacatcagtagcatacagtgtgtgtatgggagagatgtaaaggggtagagatcttttatgtgattgaagttatcagtttaaaatagactcctataactttatttaatccccataataaccacaaataaaatacctatagaaaataatcctatgaactggttacaacatgtgccagtttcctcactgaataagaagaaataaaatcttcggcatgtattcatatcttttaataaaagcctatgcaaacctctctttttttgtataaatgaagtagtattggataaatagatatttataataaaaatactggcttttgtcaatcttgttaaagttgaatattgataatatagtgtgatctaatatagctctgtccaatagaaatttttgtgatgttgaaactttatctattgtccaatagggtaatgactagctatgtggagctataaagcatttgaaatatggccattgctactgaaaaatataattcatttaatttaacttaaatttaaatagtcacttgtgatcacatattgtacagatctatggagtgagacttgtaagtattgccagtggcaaggaagtaacaagcctaaccatgaagagtttttgctatgtttctgtagtagaaactttcaaaccaacttacattctttttgcctgcttatatatgagttaagtaaataaaaatgaaggtttttagaaaagatcctttaaaaataatgactttgtgtattttagcatataaaaatttattttaaaatcttataccaacacttttaatcatataaaataaaatgtaacagacatctttcattatttgtaactaatatgtgtatttaattcagtttaaactgatagcattccttggaaaccaaatgcttttcaaatgataattcttagaatttttacatatcttagaagtgtttcttttgttctttgtttttttgtttgtttgtttataaaataaagacatgttacacttttgtgctagtgatctaaatgatgcaagacatgtaatcttgggagaaactagatttggaattttggtgttaaactaataatatgaacatatagcattgggagatatacctaatgctagatgacgagttagtgggtgcagcgcacaagcatggcacatgtatacatatgtaactaacctgcacaatgtgcacatgtaccctaaaacttaaagtataatttaaaaaataaataaataatatgaacatataggtaattaaatgacagtcagaaattgtcatctagaagtagatgtattggtcatctcagaaaataaccatacacaaaatacagaaatacataaaaatgcctgggatcaactaaaatttttataaagttatttttgattatcctacaaatagggatttgatgaatactaaggtatagaactttggaaactttatacttgggaaggtgttgaattatggcttctgggaaattataccaaaatagcctgctgttgaagtgaagctaagtttattgcttattgtgataatgaggattattagccttgacagaatctcattctagagaaggaaggacatagactgtctgtcatcttcctctctttcacaaacagtgccaggaataatatcacagaatcccagagtatctatattcgaaaatatatttgaaattattttggcaaatctccttttataaacaagcttttgaattctgagattgattactaaactaacatgcattgtttcatctaggtttgtatgactgatcagataacataccttattattttatcattcagacttgaacttaaaggcagagaaaggacaaaaaataaaatatttatagattatttggcaaagtataagtatctcacatctgtaaaattttaataaaattctgcaaagtttttgtgtcatgcttgcctaatgtgatttatctgtcaattggtatatagattccattaaaattcatttttaaaaaggtggaattatgactgtcataaatgtaaaataaaatggttaaaaattttatttagctcaacagttaatgaggaaaccaataagatgttacaactggtaaaaagagaattttaaaaaatacaaaacacacagatacagccaattaggaactgtgaaatgaatgtacaaatagatgcaaaaaaaatgcttcgtatccacaagacagtaatcagttgcatctacaggaggcacaattcatttacatatctatggacaataatcattataattattataatcagttttctacaatttacagagatgtaaaataactcaaagacgatgaaaggcggatatgactcagaagggtgctctagagagcacatccaattaactttttgcctatttcaaggactttcgcagtgtttttcttataaccccaatgaaaatgagaaatggtttccactttaccctactctccatcacgtcatattagtgttgcctatttgactcattagtgttatttgcctgactcctgcagccattttaatataaaaatttgaaattcctactctcaagttgaacatagaagatagtcaatattctaaatttaaaaggttaaaaacttaacgtatttgtttttaattttaacatatgtttaataaaataagaaacttgaacaccgtagtatttatggtctgcataatctgttggatttacctaattcatggattttaatacacatgttgtctttaggttacccctgagggcaattgtttttggcatacctagcataaagcaggtattccctgtaagattttttcccatttcatgtaaaaaggttaaatgctggtttggtggatcctgcttcaacattatgaagatagcatttgaactacatgtctttcgggaaattatatatggatatatctacagatgtagatataatagatacaaaccagtaagaaaggaaatctaactttttagtgatttcctttttacttttaaaaaattgctattgaattttttcagttaaatagtaacaaaaataactaacaacataggctccatacaaaatttaatttgccactttataactttttcaattcctttatactgtataaaccacagattttttgtttctagcctatagtttctgcctaaaatacaggaaatgatacttacaataccaaaatgaaaccattaaaagttttggatgctggattaagtgatataccacttaaataatgatccaactttgtctaaattcttcaagaactagaatatatataattttattatattatctcctttttacattgtttttttttcctttggatctgatttttcaaaactttagtctaataatgtatcactctgtaaagtaacattccttgtaagatttttaaagtagaaaatcttttcacatgaagatatatatgtactatatacatatatgtatatatttctaaaccctgtgttctttgtgtaattgatggaggattggtctgtagagaacaaccaaagttgcaaatcatggagaaaatctctctgaagtgcaagtaagataaagaataaaataattggagcattgttgttttaaaaaaaaaagcttctcttggaaaatgtccttaagtatacgtggttagaaaaataatgaatcctagctttaaatttgtgtgatttaacttagtttacgaatgtttatgtttttcattaatggaaaaacgtttaccaatgaagaataacatgaattgatttataataattagcatgtttaatttcaaggatactgcctcaaaacactgaattaagttttaaattattatgcatttgaccacagagagtctataccaagctattatgatgtagttatgtttgttttaatacttcagtctccacataaatggcataagataacctcatattcataatactctaagtacgtgcatgaaaaaatcaaaactgttatttgaataacaaagctcatgggacaaggaaatgatgccaaactatcttttaggaaattacagagtaaaataagttatttactttaggtacagtatttaacttgtacctagtacattgatttaacattcacatctctgataaagagttacctactagtgtcagaaatcccatatatctccaaggttttactatggctcgaatgcctcctccacacattcaggtgttaccaatgtggttgtattgagaggtggagcctttaaacaatgattaggccatgaaggctcctcctgtgtgaatgagattaaggcccttattaaagaggttacactcagtgttcagcgatcttgctcttcctccttccgccatgtgagaactcagccttccttccctccagaagacagagtaagaaggccctcacctgacatcaaaatgccagcgccttgatgttggacttcctagcctccagaactgtaagaaataagtttttgttctttataagttaaaaatatataaatacataagttatttatcatgcaatatttaaggaatacctaagcacatgcgtgctcaccatctagcttaagtaataaaacattgccaaagcagcgaaatcccctcctctttgtctgttcccttccttccctgatcatctctcctgtcttccagatatacttaccattctgaatatagtgacaatcatcctatgcatttgttatttctttttttaaatatagctgtctatccccaagcaatatatagtattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatcagcttttctattgcctttgcatcaataattaaaaaataagtaaataatgcactgattcaatagtcaggtgctatttatcccaattctacctaatttagaggtaatatattaggtaggaaacctaagagtatcagtactgattagtgatttgaggcagaaaacttgcaaattaggctgggaattgctagtaaggttctggattcaatcatgatgaagtgacttggttttatgtgcctaaggaccctgtctaatgagttgtatcgtcttaataggccacgtactggtaaaaaaaaaaaaacaaaaacataaaagcaagcaaatgttaatgatatctcaaaagagctcattaattaggcagtcggcacctcaacacagaaaaaatttctggccatgtggccctcaccccactttagccttagcaggtagaaaaactaaatgcttgaggagtatttgttactaattacctctgattggtatgccatgtctggtctcgttttgatatagagggcaaaaaacatgaaagccaatgaacattaaattgccaaagtgagtgtaacacagcaagaacatttaccatttccaccatgtttcatcataaatgggagaaataatactggagttgtggaggcaggggttttggagatatcacagatttgagtcatggacagctatgtagtgctatccattatcttaaaaaaaaaagtccttttaaaacagtattagtcatgtctacaggatattttctcagttttgcataaaatgcttcctgacattttcatgctaatataacattaaatatttctgttgtataacaatctcactagaacttggttttccttttttttaagacgtgaattttaagtggtggtcattatgatatcattgaaaggaaaccagaactaacaataattaccaaatacagcccttttattacctgtttcccaaagaatctccattttatgtaccatttgacaaatgcaacctattgtgtaagtagcaaaaactctgcaggcagagtgcatttttaatactttattacattaagactcaggtttaaaaaagtaagttatttctgttagctttagtatttttcacttcatagaaaaagcttttgtctgaattgtcctattttggggttcctggatttagtaagatgatataaaatactatactattttaagatattattaatactccactactaagaatataatattaggatttaattattttttcttgcctatacatattagactatatatttgactttgcatttgcataaagagcatattattacaatccctaacatttcttagatcgtaaggcaaacctatattcaaatgagaatatatattgaagattccatatctataagcctgagataaatgtatgatttggtgagagggagaagagaatttataataatgataaaagctattaacactaaaatattttaggatttttagcacagtgtcattatctacatgaagaaattgttatacttgcaagtgaaatagttccacgtgaattcgaatggctgggctagaaattaggaagttggtactatttggaatgaagcacttatcatttttctttttctgaagacatattttttcactcatctcttctctccaacatctttcaacttattaagcaggtcgcctaaaggagaaaccatctccagaaaaattgcaataacttctttagggctttcgtatttggcttcagtttctcctaccttccgtaatagattcaccctctttgttcacctttctaaaggaggcattgtaaggaagctttcttacagcgaatttacaatatctggtgacgtctgactcctttttttttcttaggctagacactttctcactgaaagaagccttttgtcggcatctattatgctactttcccaccgttataaatcctctatattttcttaaataggacagatgatattaggtatccagttccaatgccatagcacttgaatttaaatgtagacagtgttttattctcctaatctctgtaaactctgatagttgctttaacagaacgtgccttttttgtttgctttgttcagtggttgagctttaatagtaagtgaggagggaacatagataaaagaatgtctttaaaggccatgaaatcttccctcagtttggaacaaacaccttagcttcaatgtctctgccacttagcatatttaatttctttggacaacattgtccacagtgttgaaatgaatctgacttgaaaagctcaggcatttttaggatatatattggcattaataaatagtgtgttttgacttcagagctgtgaattacccctagttccctgataaaatatttgtaattggattttttttggtcagtattaaagtgtgtttgagtttcaagagagacatgaggagtttttaatatagaacaatttattttacttaatatcttacatttatttttggaaagtgattcattgtatttaaatttctcaaatattcaaagcaccaaggaaaattatagacaatagtttctattattatttgcttatttttctattggaaaaacttttgtttttttctcactatacaaataagttttttcaattagcttaataactttgaacaacacatttatttgacactacatttaactgttgtcaaaaatgttattggatcatggttgaataattaataaaccattgggtactttctacagaaccattttagttattttataataaagtccctcataggagatattagttgaggtgaaaattgttcctatcagtataagcccaagaactcttgtctgacaattaagcaacaaataattattgtgccctcatagaaaccactggtagctctttcatgaatgaatgacaatatttcactttgtagttaataatgtatgaagacagatgaaggtgtttgtgacagataatactccttcgtgaaatacagaatcactgctctgcaaatagtattcattaagggtgtggtatttgtctggattaagtagtttttggtggcatgtatgtataaccaattcaaaaatgcttaatgaaaatttatcactatgatagttataaggttgttttatagaatacaaagtttgcaaatgcagacaggattcataaaggagagaaagtagaataggcatgctatcaggaactcaggcagaactctcaatgtagtctctgagtttacttggtctcttgatttaattaattaattcagtcagtcaattggtcatgtgtctatttactcaacaggtgtttattaaggaccgtgtgtctaatccagtcactggaactatgtataatacagacttgacttaaaaataatatataattcacaaaccatgctactgacccatttaaattgtataatttgatgatttctaataataaccatagagttgcataagcatcactacaaacacttttagaacattttctttactccattaacagtcaatccctatccccctttcccctgctactagcaaccactagtcttctttctgttgctatggatctgcctgttttggatatttcatatgaaatgaatcatgtaatatgtggtatttcatgactggcctacttcacttagcacactataatccaaagtacttcttcctttttttgcagaataatataccgttgtatggatgcagcacattttatttatcctttcatcagctggtagacatttaggttgtttccacctcttggttattatgaataatactgctatgaacgttcacttgcaagtttttgtgtggagatattggtggtttgtgtttaaagtattgaggaaccagatttaccaaaacagctgcatcatttttcactccagctaatagtatctgagggtgccagttcctccacatccttaccaatacttgttattggtctttttcattatggccatcctagtaagtatgaaataaaatatcattatagttttaatttattatctctctaatgactaatgatacagaacatattttcatatacctattggatattcatatatcttctgtggagatataaatctttatagcgtttggtaatttttaaattgggttttctgtgctattattgaattataagagttctttatatattctagatgcaagttttcactcgcgtccgagtgaagagaccaccaaacaggctttgtgtgagcaataaagctttttaatcacctgggtgcaggcaggccgagtcctaaaagagagtcagcgaagggagttggggtggggctgttttataagatttgggtaggtaaaggaaaattacagtcaaaggggggttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcctcaggtaaggcaggaacaggccatttaaattttacttcttttgtgattcttcagttacttcaggccatccggatgtatatgtgtaggtcacaggggatatgatggcttagcttgggctcagaggcctgacattcctgtcttcttatattaataagaaaaataaaacaaaacagtgttgaagtgttggggcggcgaaaattttcgtggtggtgtggagagataatgggtgatgtttctcagggctgcttcgaggtggattaggggcggcgtgggaacctagagtgggagggattaagctgaaggaagattttgtggtaaggggtgatattgtggggttgttagaagaaacatttgttgtgtagaattattggtgacggcctggatacggttttgtatgaattgaaaaactaaatggaataagagaaggagaaaaacaggtattaaaggcctaagaattgggaggacctaggacgtttaattagagaatgcctaaggaggttcagcatagccttgccagcaaagattatttactttaagagttaagagtggcggtttggggatagcaccaggaagtatcagctgtgatgtcttggagaagcagtgtaaacaagagcagggcatttatgagtagttgagactggtgaataggagtatgactagacagaagatagcagggatgacaagttttttggggtgcagtctaagttggtctggtgtctggaatgagactggggccgaataaaaaggagcgtctatacaggagcttaaatgggctgtaccttgtagcattctgaggacaggcctgaattctgagaagggcaagtggtaaaagtattgtccagtcctttttaagttggtggctgagcttggtgagttgtgtttttaaaagaccattagttcactgaatactaagagcctgagaaactgcttgggtgatttgactaataaaggccggtccattataggactgtatagaggtgggaaggccaaacccacgaattatgtctgccagaaaggaagaaatgaccgtggtggccttcttagaccctgtgggaaaggcctctaactatccagtgaaagtgtctacctagaccaagaggtattttagtttcctgactcggggcatgttgagtaaagccaatttgccagtcctgggcgggggcaaatccctgagcttgatgtgtagggaagggaggaggcctgaataatccctgagaagtagtagaatagcagatggaacactgagaagttacttccttgaggatagatttccatgatggaaaggaaatgagaggttctaagagacgggctagcggcttgtaacctacacagaagaggttatgaaatgatgacagaacagaatgggcctatgaggctggaaggagatattttccttggtctaagaaccatttgccttgtgtgggaagagattgataggtggaagtttcagcgggggagtaggtgggagtgaccgatgtgaaggagaaaaactggccatgagggacagaagttggaaggctagctgcttgtctagccaccttatcagcataagcgttgcctagagcaatgggatctgacgccttttgttgccccttgcagtgaatgactccggcttcctttggaagtaaagcggctttgagaagcgtttttttattaaagaggtattaatgatagaggacccttgtgtagtgaggaaacctcttgcatggtggtgcaggatatggaaggcatatttagagtcagtataaatattgatgtgtagtacctttgcaagagtgcgggcttgacttaaggcaatgagttcagcttgttgagaggtagtggaggagggcagagctgtagcctcaatgatagatgtggaaggtactgtggcacagcctgcctttgctggtgagtggcgattaggcctggtggaactgccatcaataaaccaagtgtgttcagggtgaggaacaggaaagaaggaaatatggggaaatggggtgaatgtcaggtgtatcagagagatacagtcatgggggtcaggtgtggtatcccgaataatgtgggaggccagattgaagtctgggccaggaacaatggtaattgtgggagactcaacaaagagtgaatatagctgaaggagccggggagcagaaagtatatgcgtcaggtgggaggaagaagatagattttaggagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggtgcggtcctggctcttgtgtaagaattctgaccgcactaaccatgcctaggaaagaaaggagttgttttgtagaagggattggggtttgggagattagccggacacgatcagcagggagagcacatgtgtttttatgagaattatgccgagataggtaacagatgaggatgaaatttgggcttgactgaagtaatgggggctgtctgtgaagctttgcggcagtacagcccaggtgatttgctgagcctgatgggtgtcagggtcagtccaagtgcaagtgaagagaggctgggatgaagggtgcaaaggaatagtaaagaaagcacgtttgagatctagaacagaataatgggttgtggagggaggtattgaggataggagagtatatgggttcggcaccacggggtgggtaggcaaaacaatttggttgataaggcgcagatcttgaactaacctgtaaggcttgtctggttttaggacaggtaaaatgggggaattgtaaggggagttataggctttaaaaggccatgctgtagcaggtgagtgataacaggctttaatcttttcaaagcgtgctgtgggatgggatattggcattgaggggggtaagggtgattaggttttaatgagatggtaaggggtgcatgatcggtctccaaggagggagtagaggcatcttatacttgtgggttaaggtggggggatacgagagggggatgcaaaggaggctttgaactggggaaaagggcagcaatgaggcgtggctgtagtccaggaacagtcagggaagcagataataagggaactgggcaggtggggataactaaaaaagagtgtttaaaagaatgttttctaagttggcaccagagttggggagttttaagaggtttagaagcctggctgtcaatacctaccacagttatggagttaagggaaacaggcccttgaaaagaaggtaatgtggagtgggtagcctctgtattgattaagaaggggacggacttaccctccactgtgggagttacccagagcgtctgtgatggtcctgtaggcttccgaggcaatcaggcaatgtcagtcttcagctgctaagccgagaagatctgggaaggagtcagtcagagagcctcgggccagagttccacgggctctgggagtggctcccaggtgagttgaacagtctgattttcagtggggtcccacacagatggcacgcggcttaggaggaatcccgggctgtgggcattacttggcctggtggccagatttccggcacttgtagcaagctcctgggggaggaggttctggaggaacccctggcagctgcggttcgggcatttggagttcttctgtgctggagatgtggctggggtttgtctcacagtggaggcaaggaattgcaactcagaaatacattgctacttggctgcctctactctattattgtacaccttgaaggtgaggttaattaagtcctgttgtggggtttgagggctggaatttaatttttggagttttatttaatgtcaggagcggattgggtaataaaatgtatattgagaataagacggccttttgaccctttagggtctagggctctaaagtgtctcagggttgctgccgaatgagccatgaactaggctgggtttttcatatttgatgaaagaacctaaacgctaactgatttgggagaggtcggataaagaaaaaggagcattagccttgactatgcctttagcttcagccacctttttaagaggaaattgctgggcaggtggtggagggctagtctcggaacaaaactgtaagctggaccgggtgtcaggaggggaggtgataaaaggattatagggttggggagtagaggctgaggaagaattgggacctggctcggcctggcgaggagcagcctggggaggaggggagaggtcagatgggtctgtagaaaaggaagattagaaagactcagcaatgcttggggttgagactgagagaacaagcgggagggaaagaaggaagatttgggacgagttgcattgggaacaaagagtagggagggaacaatgtgtgaaagaatgcctggacgtcaggcacctcagaccgtttgcccattttacgacaagaattatctagatcttgtaggatggaaaaatcaaaagtgccattttctggctatttggaaccactgtcgagtttgtattggggtcaagcggcattgtagaagaaaataaggcgtttaggttttaagtcaggtgtgagttgaagaggttttaagttcttgagaacacaggctaagggagaagagggaggaatggagggtggaaggttgcccatagtgaaggaggcaagcccagaaaaaagagagtagagacacggagagaaggggttgggggggttcttgccctccagaaaagcagagaaggggtagagacacggagagaaggggtcgggggggttcttgccccctagaaaagctgtacttgccgctaagggtgaaggaccaaggcaggcgtccctgcgtggccagagacctctgaaacgtgggtgaataatcaggcaggcgtccctgcgtgattaaacaccaagggaagactgtcttcccgagcccgtgaccagcacgggagttttgggtccacggataaaacgcgtctcctgtctctaccagaaaaggaaaggaactgaaattaagagaagggagagattgaagtgtggcgccaagattgaaaggagaaagaggttgagggatagtgagagaggttggagaagagaataaaaagaggccacttaccggacttaaaattggtgagatgttccttgggctggtgggtctgaggaccagaggtcgtaggtggatctttctcatggagcaaaaagtaggaggacaggggattgatctcccaagggagttcccccctccccgatctgagtcacggcaccaaatttcactcgcgtctgtgtgaagagaccaccaaacaggttttgtgtgagcaataaagctttttaatcacctgggtgcaggtgggccgagtctgaaaagaaagtcagggaagggagttggggtggggctgttttataagatttgggtaggtaaaggaaaattacagtcaaaggggagttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcattagttaaggcaggaacaggccatttacatttcacttcttttgtgattcttcagttacttcaggccatctggatgtatatgtgtaggtcacaggggatatgatggcttagcttgggctcagaggcctgacacaaatcccttatacatatgatttgaaagtattttttctcattccttgggttccctttttactatctggacagtgtcctttgaaacacaagatttttaaattttgataacctctaatatatctattttttgtcttttttgttttaagtgaataactagtaagtctgcctaacttaagatcacaaaaatttctcctgtattttcttcaaagagttttatagatttagctcttacattgaggtctgtgatttattttgaggtaatgtttgtgtgtggtgtgaggatggagtccaatttcattcttcaaacttctttttttcccccttttttttagagcaaggttttgctatgttgcccaggctgatctcaaactcctgggctcaagcagtcctaccgcctctgcctccctatgtgcctggcgaatttcattattttacatgtggatattcagtttttctagcttgatacctatttttataatctaatagaaaggactggtgctcctcaaacttaaatgttagtaagaatcacctgaggttcttgttaaaatgcagattttgttatggtagtgggacctgagagtctactttcttacaaacttcctaggtgatgctgctgattctggtactgggactttttttttgtttatttttgagactgtcgcccaggctagagtgcagtgttgtgatcatggctcactacagacttgacctcctgggctcaagagatcctaccacttcagcctccagagtagctgggactataggcatgctccaccatgcctggtgtattagtccattttcacactgctataaagaactggctgagactgggtaatttataaaggaaagaggtttaatgactcacagttcagcctgtctggggaggcctcaggaaagttacaattatggtggaaggcaaaggggaagcaggtaccttcttcccaaggtggcaggaaggagagtgaacacaggaggaactaccaaacacttacaagaccattagatctcatgagaactcactacaagagaacagcatgggggaagcagcccccatgatccaattacctctacccggtctctcctttcacatgtggggattataattcaagatgatatttggctggggacataaaacctaaccatatcaccaggctaatttttgtattttttgtagagacagggtttcaccatgttgcctgggctggttttgaactcccgggctcaaatgagctgccttccttggcctcccaaagtgctgggattgcaagcatgaaccgtgcctggccattcctgggacattttgaatagcaaggaaatagacaagtactaaacaaagaattataagtgcattctaactgtgcatctgttttattttcacctgtctgacaactggctttctttgctgcttcccgtatgtgggagactataacctctatactgcttccaagatcacatcccattaggtcaagccataaacttaggagttgcaaaatggcattgctaagcctgagtttttaattcccagcagagatgagccaattggctaccttagacctatcagctcttaggtgttcagttcttagttctatcagctgtggctaggggtctggcttgtagagggctcagtgggtcagtggcagctcagagagaagagagttgtgggctggccagaaactgaatgcttttctacagatgtacaattgaccttctgtgtcatttcacagaagtgtgggcatctttgactttaaattgaaaattgttaaaggcatggtaattagcaggagtcaggaattctccaaatgactgttactgaccaattctgggcagaggagggggaaaaagaattttccttgattaccagctaaactgtgtttcatatttagcaacatgaatgatttgtgtgacttcactaaggactccgattggaacacaggcagtcctagtgcagactattgagtgggcagtcatgggtaaggtactgagcctttgtggaagctttctcatttatagactgaggaataatagctgttctgcaaagacatttttaatcattttgtttctggaacaatgtgtaggtgctgaatctgttagttttcctctctttccccgccttcctacttccagaaaagattttctgtgatttacatataaatgatcaagtataatagggccattaaattacggataaaacaagagccctctaatggaaagagaacatagtttttctacaaaaatcaaggctaagatggttactctaactgaataaaaatttaactatgagctttctggcacacatcataaaaacagaatagatgaaactgtttttaatatataaaaatcttaaaataccagttaggagagagaaaatgtttttttctaacattaaaatcatgtttacatagaataactaataagaaaaatggaatgacataattgacaatgttttaaaagtatcaaatgataaaacctttttctagtatgctccttgaattctagcctctgcacactgtctagtttctcatttttaggtatttgttacattagcatcccacttccaggtatttttatttggaagtatttttatttggaagactgggatttttattttagaagcatttaaacaaccagctttaccttatctattgaatgtctctgttctagctccccctttctttgtcccttataaagggaaaccagtagtctgttagtgaagagtgggaaaatcactaacttactgtaaggatattaactcttatatatcacataaaacatatactaggtccattacatagtacaaagaataagttgctacagtgccaataagcatgcaaataaatttgataattaacagctggtaggatttatgcatttattcactcatcatctattgagcatctattgaatattggaattatagcgagtaacaaaacaatggaccatagattatatcagaaatcttcatggttgcatgcaaatgaaagaaaaaaatagaatgaggatttatgtgcttagggcaaacactaacatagagccatttcttaggcacacatcaactaattttatactatataattacagtgcttaggtgaaaacaaataatacaatgatggttttaataaaattaaatttaactccctcttgtttcactgttactgtttttcaattaggaagcatcatgccatttgaaatttgggtaatacatatattattttcaatatttagatagcatgtatgttaaaaatattttaacttttccattttgcttttcacttcatgttatcaccctatttggacatttaatttttcttgcttgtattgttgcctgtgctgtacaatctctttattgctgcttttcttcaatccttcctgcatattgccattagactcttttcctaaagaatagtctttgttgtgagagtctcttgcccaccatctgaaatgctgatggctgaaattcaaggctttctaagagatggcagaaactaacttttttgcctcttattttgtatcactacattcatgaaagtttgaggtataataattcacacaaattcatcacataaaactttaatttgttttcatttgcggtattctccatgagtaggatagcgatttccatcctcactcgctcaaatattactcagcctttcttgtatagctcaaaggtcacttttgtgaagctttccaagttgacttcagctttcaggaatttccttcatctaactctttaagtaatttgggttagtttatatataacccagaaataatggctatgtgactcccactctatagagtaacattttttaaatctgcatctaatgatcttaaataataaggtgtactttttgctagattataccatgacatgcacacatttctccagaaatcgtcagtaagaccttcccaaagttctatattcatgtcagccacaaaattatctctctggcttcctcccattcatgtttgttcattgcctagattaagccacttcaccttccttatcctttttttttttctttaattactacagtttggttctgttgcccaggctggagtacagtggcatgacctcagctcactgcaacctccacctccctggctcaagccatcttcctacctcagcctcccaagtagctgggaccacaggtgcatgccaccatgccttcctcctccattttatcacatcatgacactctgtcttcttgctggaagttgtcattggaacttctgctgtttcctacttcctagggaacccagaattttcataccttactctcaacccatcagttcccctgagagttcaagaaacttccaggtaatagcagttcttctctcactctaaccgatttttgttgtgagacatccttgtggagactttctggtaaataaaactttctactactgtcttttctatatcattttcaacaagtactttctacacctggtaatagtgcatgttttatctactcttcaaaactaagggaaaaaatgaggacaggaagtacttttttattactcatggcttaactcagaggtccccaaacgtcgggccacagaccagtaccagtatatggcctgttaggaactgggacacacagcagagttgtgcagtgggtgagtgagcattactgcctgagctctgcctcctatcagatcagcagtggcattagattctcataggagcaggaaccctattgtgaattgtgcatgccagggagtgagggatttaggttgtgtgcttcttatgagaatctaatgcctgatgatctgaggtgaaacagtttcatcctgaaaccctccccaccgtctgcgggaaaattggcttccatgaaactgatcccttgtgccaaaaagattgagggccactggcttaacctttagcaagttctcttctttgggtgaaatacaagtaggaaatgaagcttcagtcacatattttctttccttttttttgtttgtttgtttttttgagatggagtcttgttctgtcacccaggctggagtgtagtggcgctatctcggctcactgcaacctctgactcctgggttcaagtgattctcctgcctcatcctcccaagtagctgaggttacaggcacgtgccaccatgccctgcgaatttttgtatttttagtagagatggggttttgccatgttggccaggctggtctcgaactactactgacctcaagtaatcctcctgccttggcctcccaaagtagtaggataagcttcagtcatgtattttctttctttcttttttttttttttttgttttgatcacaggcatgagccaccatgcccggcccagtcatgtattttcgatacaagccgggtgtcattgacatctaccacatgtccacacggcatttcgttcttctgcatgtagtgttaaagaaggtgtagataaaattcctgtcattccttccttttctaagcttgcatttcttttcctcctcctaaaaagaaatgataatagcttaaccaaataaagcaatttctgattatgcatgatataatagattatgttatcaggactaggtaagacaatcaacaactaaccaaatatcttaatgttggaatttattatgcgctacctatatgcatatattctatgggcaaaatattatattcatataatgcatacatatgtgtattttaagatactttgtggtttttctaaataattgtattatatttaaattatgagaaaagttaaaatattaactaatgaataaaattacatgtgtatatatgtatctgatatatataaccatatatattatatatttatatatgtgtgtaatatataacctatagtcttccctctttctccattacaagatagacctacagttatagtttttttaacacaaacttctactgaagatgcagagtattagaatttcctttcttgctatcaaactcaaacattatcatcctcatggaaacattaataatagctgtttactgtaccattagtaggtaccaagtactactctaggagatttataaaaattaaattgtttaatcataaataaataattgtgaagtgaattttgagaacatggaagctcaaggacacactgtaagtgcaggagatggaaaaaagggtatataaaattggtctgaatatccagattaaaatttctagcattcttagttggaatggtatatataacgaaatactgtgtggaactcaaaacaactactattcatcgtaagcatatttctcacagtagcatcagccacagcgtcactgagcaaagtagagaaagtggttgtgaatctgacaggccgtagcttaacatctggcacaataaatcattattatcacattcttaaggttagaaaggagtgataatttaaatgtttacataaaagaagtcacgttttaaatttctgttttcttggtaagttatacttcttagccacagtttccttgttcataaaatgggggcatttgttagatctgtaaggatccttcaagccttacaatttctacaaatttgtgattcctttcaattaacattttatcaccaaactaaattatcttaaaggttgaaagaatatgagatttaaacccaatgagttattctattgcattagattcagaagaccaatggagaaaaaagtataaaacaaatatatgcaatagagaaatatcaaaagttttccataatatttctacatgtatgtatacattgaaataacaattttaatacttaccatttaagtaaaatcatatatcgtaacttagagaataaaagcttttctaaggaattcaataattagagactttcatggtatgttgccttatgattctcttttgatttgctttgaggtatctgttacttctttgaagtttatgtttttcttacatttagttttggatattttctcccattacatttttcttccataatctctaagataaacacatttattattaaaatgcagtagatttcactagatctttaaaactcagtaacaaagtatcattttctatgcattattattatcactactaatctgtaattttatagtattgtatatacttatattattttcaggtttttggatcacatttcctagacaataatgagaaataagggcttctatttaaatggatattcaaaaagtatcatatatttgctgtggaccttcatctcagtgaatttgtgaatgtattatttataatgaaaataaaataagtgaatgctaaaaaagtttttccttttgccaggggatttaccagaaagagaacaaaatggatcatggtatgatacttttctgtgtaaatatatagagaagaaaatctaccaaagatttaacaatgattttcctacaattggggtgggaatggaatggtgagattcagaacaggttcaactctctatgtggtatctttctgaattagaacattttgaatgaatttgtatttctttaataactactaaaatatgttgttatattaagatagtcatatttagagtatttatactaattcttgaaatcacaacaatttatttcatatgtaaagaacaattgcaaaaacctctgccttgatggagtttacggttcagtgggggagagggtgataataagaaagtaaaagatggtatgtagaaaaataaaaacacagaagggcagtaggaagtgtgtatgtgtgagatataattcttagtaagagaaagaaggcctgtaactgaaaaattaacatttgagtgaaaactgaaagaaggcaagtatattattagtccagacgttctcacactgctataaagaaatacccaagactgggtagtttataaaagtaagaggtttaattgacttacagttccacatggctgcggaggcctcaggaaactcacaatcatgatggaaggcaagagggaatccatgaccttcttcacgtggcggcaggagagagaagagtgaggagtgaaggggaaagagccatttataaaaccattatatctcatgagaactcactcattatcacaagaacaggatggaggaaaccacccccgtgatctgatcacctcccatgaggggtctccctagacatgttgggattatggggagtacagttcaagatgagatttgggtggggacatagccaaaccatatcagcaagggaagaaaccacgcagttgtctgtaataggaatttcaggatgaaggaactgctaggacaaaggctctgagtcagaagcacatttggatagtcacagtaagtgggagtgtggtaggagatcaagtcagagacgtaatgaggtaataggaaacttgggccatggtgagaaattttatattggctagatgagttaagagtgaaataagcattaagaaggaagtaagtggttgggtaattgagtaaaatatggtttgagtgcctcaaaacaaagagcaaatatgaatagagaaaatactatttccccagctagcaaagtatttttggaaaaattaatatcttctcactagacatatgtatatatccaagctatttaggtaaataatttgatttaaactgataaataaattaagatattttacaatctttcattcttttcatttttttcatttatttcttgagtatctattatgtatcagaagacaaaatcacatcatactctcaagtttacagtctaagtctacaacgtaagtctaatatatccagccaaagttagatttgcatttattttgcatgataatgttagaatggtttcaagtaacacttggaaagataacctaaaatgaaaaagtttagagagtgaaatgcatattattttttatgtgggaaacatgaatcttagttgtgaaaaatagccttgatgatactctgaggaaaagtaaccaggttttttttttaaccattaagtgtgatgttagctgtaaattttttgtgaatattctttgtcttgttggggaagtccacttttattccaaattttctgacagtttttattatgaatgagtgctggattctgccaagtctttctttacatgaattcatatgattatatgatttttctttagtctcttgttgtagcggattgcattaattgatgttttattatttttatttttattagtattttttgagacagagtctcactctgtcacccaggctggagtgcaatggcacgatcttggctcactgcaacctctgcctcccgggtttgagcgattcttgtgcttcagcctccctagcagctgagattacagacatgcaccaccacatctggctaatttttgtatttttagtagagacggggttttgccatgttgaccagggctgtctcaaactcctgacctcaagtgatgcgtacacctcaacctcccaaagtgctgggattacaggcgcaagccactgtgcccaacctaattgatgttttaaatatcgaaccagcattgcatacctggtataaatcccacttgttcatggtgtatgtaattttttatgctttgttggattagattatttaatagttcattgaagatttatgcatatatatttatgagagatagcttttatttgttgtaatgtctattagggtttggtactaagttaatactggcctcttggaaaaagataggaacaattttctttacttctgttttatgaaatatattggaagattaatatttcttccttaaatgtttggtagaatttcctggtgaaataatcaggtccttgttcttttgttcttagaaggttattagtaattaattcattgtatttaatagacatagacctattgagattatctgtttctccttgtatgagtttgtgtctttcaaggaactggtttatttaatataatttatccaactattgaccatagagttatttctactgttgctttattaccatctaatatctgtgggatcaatattttacttttgatattggtaatttttgtctctctcattttttcttggctagcatggctagtggtttgtcaaatttattgatctttccagagaaccagcttttgatgtctttttttctattttccttctttcagtttcactgttttctgctctaaattttgatgtttatattcttttttagatataaagtgttgttttttctctggtttcctagggtgaaagcttagagtttcagatcttttcttcttttgcagtacatgtacctaatactatacatttcccttaagtagtatgttcactgcatcccataagttttggtcagttgtattttcattttcatttagtaatattctagaatttctcttgagaattctccttgactcgtgatttatttggaagtatgtttaactttcaaatatttggagattttcaaactgtctttctgttattgatttttagtttaattccattgtggtctggaagcatacttcatgttatttctattcctttatatttgttaaagtgtgctttatgggccagaatgtggtctatattggtgaatgtcccatgtgagcttgagaagaatgtgtattctgctgttgttggataaggtactctataaatgtcgaatatatcaagttaattgatgatgctgttcagttcaactgtatcctaacaaattttctgcctacttgatctatcagttactgaaagaggagggttgaaatctccaactttaatagtggatttatctatttttcttttcatgtttatcagcttttgcctcgtgtattttgatactctcattaggtgcttacatatttaagatgttatgtctacttgaagaatttacccttttttgttatgtagcgtccttccttatccttgatacttttcttgatctgaggtctactttatctgacattgatatggctattccagctgtttttttaaaataatgttagcatgcgatatcattctttattcttttattttcaacctatctgtctttgatacttaaagtggtttcttgtaaacaacatcaagttcagtcttgtcttctcatttactcttacagtctgttttttaattggtgtattttgaccattcacatttcaagtaaatattgatacagatggattaatgactgtcatatttgtaactgttttctatttattgcatctgttctttggggaaaggaagttaaagtcactaggtttattattccttgcaacataaattaatggctctggggggatatatgcaggtctctctgaaagtgtctattgtgaacttctagttttctttttttcgaaagccttgaccatgcagaaacatgaaactgttcatatagcattgtttcctgacagtttatagccaatctatgtcagttccataatttttaaacttagaacatttcattaacctccttatttcctttttataaacatcttcatttttcaggcattgcatttaacttgattctgaaccttactcagatgattaactcaatcctttaagaagatattgaatttctgaagaactttctcaataatgttgatttaaaatgattaatgatagtccctttacttcccattcatgcttaaattttataaaatacaatcctttttatttagaatttaaagaattttccttaaatattgtgaggtgtagcagtaacagctttttgttttgagcaaaacttttctctggttatagtaaaaactggtttattccccttcgcaaatttgcaaactcaccaaaagccctcaatctgttcttccacaaagatgtaataaagcaatttgctgttgaattctcaaaatacaagtatggctttaaaaacaacttcttctggatatattttgtgcaacagcattttaaaattcttgtttattcttttgaccacctgtgaaatttggagtattgtattttagccaggctaatataatcaattctgccaactctatgtcaactacaaggaaatattcttacttaaaacaaataaataccactaattagctcttcatttcgtgaagtctgagaatgtgaggctcagatagtaaccattgaaaaaagacaactcagaatgttgttatttgagcataattctattggttctctgacatgaaaggaagcctttctcccccaaacttcaagggattttctttatttgatctgagaatcactgataacttttgccattctcaacccaacctgattccttgtttgttatgattttaacagtgacaacaaggaaaaacatttgatgttagtaatatgtgaaatcttaggattctgtgtcattccctttattttataggtcaatacatatttaatacatttctactgcatatatagaaaaggaaagtgagatttatatactaaagcatgaagtacagtgtcacaaaagcagaagaggaaagaatttcaagaaggctgaaactgtcatcagtgttaggttcagcactatgttttcattaaaaaaagaagaaataattttcatttgaaaagttaaaaaaaaaaaacgttttgtaaagcttttggaatgagtcttactatactacacttgtttttgtaagactgcctgaccctaggaattctaagatagatgactaatatagataatggttgctgcttaagtgtgcttatgtgtaaccctaattcatcactgtccaatggttaatagatttagagtagctgcattaaaaaaaaaaacacgtgaggtctttttttaaaacataatctgtcttgtctttgtcattttggcaatagaaaatgtagttttattttgataaaggttgaagaatttattgggagaagatatctgatggcattaaaaatgtctccctcaaagcaatttaagatatcaaagttacttattgaggctcaatctgttgacacagtcatacaccaataatttcctaaaagcagtacagaatactaatgggtgattattttttagcaaagaaaatgcaaatatattctgaattgaatgaatgttatattaaaattagatgacgaatatttgaaatgaaggagaaaaagttcattagcagaaaaatctcatgaatcattaatatttccactatagagcaagttgattttttattttagtacagtaatgcatagtatcacatcaagtcatcttttgtttatacggttaaaaggaatttttcaggaaagtatttacttcataaataaagcttttttttctggaagtaattgaggttgcatagcagtgtcttcagtacggttaatgttcaaagtgaaaagaaaatatacacaaactttgggtggagaataatacagatttcaaacacatcaataattcatttgacatgaagcaaggaggggcggtgtgtcctacatgctctgccattttctctgctagaattccacttcccccattgtatcctctcaactcccacaactcctctttaaattttagttcaaatatcacttcctcaggaaggcattctcagattctcagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttgagccaatggataagatgaatggtaatggcattactgaagaaaaggcaattcaagaaaaagagcatgtttggggagggataacagtagcaacaaaggcaacaaattgcctcttaatgagaacatgctgtcttatatcatagtagatactacacacattctttctaatttgtgcagtaattcagtgttactcttccatttgaaccgttatggaaggtaaggctcttagaggttaagaaacttgcttaaagtcaaacagttaggatgtggcagaatttggattttattccggattttatgctggctccattatgccatttttgagaggataagatgttaaattaagatagagaaatgatagaaaaaatatgtgtatatatacacatatacaaacatccatgtatataatgtctgtatatataactatagatgtatgagtgtgtgtgtctccgtgtgtatatttgttgtgtatgagaaattgaaacacatttatgtatggatatttagcaagtggtgaggaactttgagatgaggattctgcagtgatattgatgttggaaatgggcaatttattcccatatcaggttctaacatttaaaatgcacctgaatttgtattaagaaacttgtcttgctaaattttaattctatcagattaataatagccacagagcttgtaaagggaatcattattctaaccttttgaaaaaatttttttgtagctcagtttaaaaaaatggaatcatcagcaaaagtttatggttgttttgtcatccagagtgtttccattaaaaaggttttgtgattattttattcagttatattaataataaaattcgttttaatttatatttattgtgttccatcagattcttctatttgtggtgacaggtaacttaacacccttgaaaacagctgtttacaagatgccattctgtaatgtgggtttctttctcttctaatgggaggtcctaatgagcaatgtaatgatccaggaagatgagcaaaaggacttaataattgaagattgagtgcaagaagtgttctgtagaagtttattaaaaataatcattgggtattttggagataattatttcacattagaatggagaatatgattgtaccagaaaggaacatgggcaatcattctgtctatccttgtaaattcttgatctgcacctctagaattttggttctggccagtttatgctgactacatccatttttgaattacatacataattttagattgtacttcatagtcttatgcttaacagtgtgttgcctttgaaaggtatttcagtttcaatgtaagcatttcttagctcctcaaattgatggcaagctcctcctttaaggtcagcatatgttttctggagatttttatatcctttaaactgcctaatggtgagctgaatacaaaataaaaaataatacgtaggccaactatttggaaggctgaggcagaaaaatcacttgagcccaggagttcaaggctgcaatgagctatgattgcatcattgcactccagcctgggtgacagagcaagacgctgtttctaaaaataaaataaaataaaataaacttagggaattagatacagcatctcttatggcatagaaacatgaagatatttgtttctgtcaactcagggtgaaaataatctgatgaaatggaacaatctagttgaagttcagctctggctatatgacttccgctttctcacctataaaatagtgataatcaaagcatttaccagttgtatgttatcagaaattgaattttaggtactcctgtgagcatttggaatcttgttaatgttatcatttttcctaataccatcatgtgatatataatactgagaacttggaaatactaccttgtgtttttatacccagaaaactcaagtagatacaaataattagggtaatttgaatgagataaatttcagaaattaaactagtcaaaaatttcaatatttctacattttttatgtgctaagtgaagacctaggaaactcagtgggatgacagcaaatacctagacattgtgctggatcggtacagaaagataaatgaggtatttacctcatttatggactctatacttaggactctatacttaggaaatatggactctatacttaggaaacttagggaattaacataagcacaggaaatataacacacatatcaaatgtagagtcatcaattatttgaaaaatgtaaaatgttcatcatatagccatctaccattgaataattttagatgatctcaagtctcattattgtaagtcacttcccctcctcccacaaatgaccttaaattattccaccaactctgtatcttattacttcttttgtcaaagcgaatatttggtaagtaaaattttaagtaaattgcttcagaatgtcaccatcttatttcagactttcatgtacacttcaacatttgaacctttttttttgtacttaatgggactaaaaatatctgcactacctgtacgacacattgttatttgaatactttgaaactgtaaaacactttgcaaatactgagtatcattatttaactccagctaaacaaacaaggttgatatagatgttttcaatgttgctgcctgacagcaaaacatgtgttagctcagcaagagatattctgtatatactctatgaaaatactcgcagatgaactttccattaataaaaactaatcgcttggtaaagaggatattatttgtttcttcttctatcccatttgttacaaatttaggcatatgaactacaggcatatgaaaatccaggttttacagtgaaaactgtagatcagtggcccccaacctttttggcaccagggaccagttttgtggaagacaatttttccatggacagatgatggggggcaggggcaatggtttggggttgaaagtgttccacctcagatcttcaggcattagttagattctcataaggagcatgcagcctagatcccttgcatgcacagtttacaatagggtttgtgctcctgtgagaatctaatgccactgctgatctgacgaggcagagctcaggcggtaatgcttgcttgcccaccactcacctcctgctctgcagcccagttcctaataggccatagaccagtaccagtccacagcctgggggtcggggaaccctgctctggattcttgcttcattctctgatattttaccatgttttaagaagagttagggaagattataggtctaggcaatataatgtaatggcaagtcctcaggctccaaagtcatagatttccctttgtatcttggccccaatgctaatgatgtttctttagaaaagttgcttaaaaataacgtttattgaatgcgtataacatctcaggtactgttgcacatactttacatgtatgggttatttactattcccagaaacactagaagtacattattattattgtttctatttgatagattaggtagctcaggtattaaagagttgacgcgagatttgatcccaacagtgttttccagagcctgttatttttttacaccatgcttctcaggctctgtttattatctataaatgagattaaaaggtgatctactttatcagtttttgagaattaaatgagacaataggtgatgaataaattacaattcaacagcacctgtaaatgctcttgatatattccaaacatctgttggccaacatattcattttttttaacttgggtagcagtgttaacactagcatagcttctaaatagtgaaaaagaaaaaacaaatatatctatctatctatatatgtatgtgtatatatatatatatatatgcttgttaatttgaaatagctaataaagaactaagtgaaatcagctacttacaagtagaatgaaaacattaaaactaagtacaatttaagaggatgtagtgcattttgatgggctgattgttagtgtggaagagactttatttcttccctactaacattcactgttaaattggattaagttcctaattttagtcagtcaagcatataaaacctagaataaccacagagagtaggagcaaatgtagcctacaccttggcccccagcatccctaatgagggcacataactcccagaaacactgtttccccattcttaggtcaattcttgctgggacactggctttttattctcccagcttacgtcatcattcaggaagttgtaaataacaatctatgaacatgcattcaaagggaatggttacaagctcagaatcaaccagggtcacatcttcatttgggtttaacatattcaagaactagtgtaccccaagcctaaaggtagagactacctccagcgctctagcccagaatagctgtgtattgtcaagccctaacagtttatgaatagatgctctgcatgtgttctttagagctgtgctagaattgtgtgtttgaaactttaatttgtgtaggaagcacctgcagagattgttaaggggatggtgatctggttggcctgacttggggagtgagttttctgcatatccaccagattatcagaggatgcccatgcagctggtcattggagcaaacttggaataccaagcctgtaaagcacagatgatgcattacctaggtgagcttcacacatttgtaaggaagttttaagatcgatcttgtcagatacccagagccagatgactgcattttaaatctgtgtgctgctctgttttttaaaactaacatttctattctaggaatcttttattataatttagatctggaatgacttttttctaaatggctcccaatgtaatgactgtgtcttcagattcagcaaccatgttttcattatcctctgaatcacagagtataattgtgcattacagtttggggtttgtttttcctactaagaaactccttttccttgcgtcctttctgataaatatcattaatttttccactatggaataattctacttcacttttgaaacataacctcatttgaatgtattttaactgggacttcattgcctgagggaagatggattattagtgacatgtgtcttgcttcttgatacagaaaagataatataaaagtagtgtttctactatatcttaaaaaaagcttcatataagccaattttctttaatgatattgtagcaagggaaaatattgtacaactcatttaccttcatttttacatatttttcaacctcaatgataattctggagatattcatgtgccttatcttgaaatcaaattaaatcattcttttgtgatatgacacgcaatttgtgacattttgagccaacagtatattaagatttaattttcagttcattatagacctagtgcctaaatgaaatttattgagactaagtaactctgcagtgattgtgggctgatggttcaagtacagtgattcagtgattcttagtaggggagaagataggccatgtaattgaacttatctctggatttttgaaaggttgaggcaatacctgttcttccaacccctcactggctccacatttcaaacacactatacctgagttggaaatatcagcaaatgtgtttctagatggatatgtgaaaataaataattattggcttactgtgttttttaaaattgtggtataccatacgtaacatttactgctttaaacattttaagtgtacagttctgtggcattaggtacattcacattgttatgcagccatcatcaccatccatgtatagaactgagctactattttttaagatgtattttttcccttagattcttctcttctgagtttgttaatgatgtccaattaaatgtatgcttattttatatgtatgaggttactttttaaatgggaaagttgagctccatctgcctgagggcactgtaaaaatttaactttcaaaatataattcctgttttgctgttgttgttcctcatgatttccttttttatatgaatattttctttaaacatattgacagtcaatttgacaagctgtcacttctggcaaatgccactttttccattagtaacttccttctttcaagaaacactattagtcactatatcttattatattaaacatctccttttaacactggtaacataaaaatgttttactaacagttctcacacaaaaatatcatattgaaacaaaaattagaggaccagaggcatttactcagaaagaacaaactttttcttagtaatgacagtgacccaaccaatcaaataaattgaagaagtaataaaatgaatgcatttttatctgaaacggatgccaccagtaacattttgggaattccaatttaaaaggcccaatgccccccatgcaagattagtttttcaagatacttttacagggctaggacattaaaatatttgcttctctattggagcagctctttcaacaagttggaggactgatcacatccctttgccaattgcagttcagataggctctgggaaggcaaagtacaggatgtcatgcaagtgaaaacagaagtgattaatcttatggatagatcaaggaaatttatctgaactttagaagtgagacttgatgctaaataggtgtttggtgtatgaaaactaaggatgaagcattcctggtaaatagaaaggcctgattgaaagctctgagctgggaacacagcagagggaagcctactttggaaggagggattggtctggcaaagtgctggataacacaggttgtaggtcatataaaaccttgtagggggtttgagcttcttgaagcctatgagtgcaatgagaagccactgaaaggtttttagcaggaaattaacattgtttctaatttttatttttaggaaaataacttgctactaagtggtgaatgggagacaagagtgtctgtgaggctaaaggctgttcttgctgaagccccaaaatacttatttactctttcttggtgtaaatgagatgaaagatactacaggaacatcacatgtgttcaataactgcgcgagtgatatacttccctacggggacatgaacagtacttgaacagctgttaatgtctgttgcccttaggaaatttatttcatcaagcatacagtgtttcaacccttattaacttatttcataaggcataatatatctgactgtgatctgttcacttaatgctactctgctctttgcacgagcatgggacaaccagttgctctctgtagtcgtagtttattaacgtgcaattaaagacatttatcatatctctgaaaatgtctcttctcccataaaattaacatcatctcctcaaaaagatgcttacgatatatgctggattatagttactgttaaaatgtattcagaaacaaaaatagaattgaaaactatagaggaatttttttaaagcatgggctttggaatcaaacttgtgtttgaattctagttctgccacttaccagtcatttgcacttgagtaaggtacttatcccttctgaacttcagtttttcatctggaaataggcataatgacatctactttatgaagttgttggttatgtaaagccatctatgaaaaatggttagaccagtgactgacacatacgcattccataagtgatagatacataaataatataaataaaaaatgaatgctatagctgacaaatgtgattaaaaagtctacaatgcaaattatttttataaagtataaaatccatgtgaccatataatatactaggacaagaatgcctgttagatttcagattcaagacaacatactaagtttaagtgtagttatctttgctaggttagctttatgtatttgcatgaataattgtttaaatttgtctgattgtactacggactggcaggcaataaatttcattatctagtcttaaaatgtgaagagaagacagctcaaagttcatttctcatgcctgatctttctgggggatacaatgtacaacatcagataattcttttgccttcttttcttttgtgcatccagtaacagttatatcatttttttctgaatcagccttttcacaaaaccattatgtgataagctcttgtcttggaaaacctcaacagcttcctcaacacctatattttaaatcctgcttaaatgagattaaaatacggcactctgttaagctgtaaaactggctttttgcttctcagttgagtgttggtttgaatgtgtcatttgacctatattgctgctctgaatcttcctcggttgccccaatgatgacagtttcaatgatgtgggtgtttgcagcagagttgttcctaataaggaagtaacgctattgtctttcagacatcattcagcctgaaaagtactatttttcccacctagagctataaatgtctgtaaaatcttttcttcttttggtagcatttgcagcagcagcaggaaaaaaaaatagtcctagtagatttgcagcttttgtagttttggggtgttgtggttccaggctaagattcactcacccttcttcaaaagttgtatacaaagggttgatagctaaatggtgactgaagtacttgatttattagtatctggcagtcatccaatatgtactagaatacaagactctctgtcaacaatagctgcataaagagcaaactgctctgcctgaacctaaaataaggccttctgctgtctgcccgttaattgaagacaagtgggccaggagtggctgaggaaaaacgaacaaagaataggcaattgtcatgcacatggaggcactacctgtgcctctttgagaaacagaaatcccctgacctggttcttacattgagagaagctaacccagcccagtaatacattttagctccttgcatgtataattatgaccattgaaaaataggatactacctttttattgggtcaggtaagatgcaggaggagggagagcaaagtgccctacttgagggtgggattgagattagaatgtgaagagaagagcagaaagcttccttcttacacaaataaaggttctgtggattcatctagaaaaatgagttaaaaaaaaaacgagtggaactatagtttctaaagtctgtggagttgggacaaatggtaattataaagactaaatgtgaatactcatagttctttaatttgattgtattaccacttaattcatagttttgaaggaaatagccattatattagatggcacattaattttaagatgcaacccaattttcaaaatgttaaaatggaaaagaaagttaaagggtgattgttaggacaagcatctccaaatactctgtgtggaggcattttaattccatgctcttgcaaaattaaactcaaaaatgtttcaaattactgggtgttatatgcccttctggtggaagccacattttctctttcctttctttccctgtctaccctccctcttccccttcctccccaaatctatcagtaaagaccaccttgctgtgggcagctagctgaaagagaccatctgccttaggaatagcctacactagattcaaactacaaagaagcaggttgggggaaagaggaagtgaggatttcaagtcaagaaagcatcctgcctactctggcaaagtattctgccagcagcatatttggattcacactgtgggtttaattctttccgtttaatactttttgttgaccttataaagccaaaaaataaaggaacacccatggcactgctggaaagaggtaactgatttctgatgaaccggtaggcattttagccactaaccaacgtatcaaagtgggcacaactaacacatgttaacagttttcccaaagtaagaagcttggtttggagtgaacaggccttgtacttttgagattttattttatgattttgtgaattgatgttctgtggggaaaaaacttgccttagttttaatataatggtcaatgactaagaaaaatcaaggagttgggctgggtgcggtggctctcgcctgttgagaaatttacatgtccatcagtttcttgtattgtagtttgaaatcaagaaactacctcagtttcttgtacaagtagtttgaaatcaggcggtcaagtttcattctaccctgctagaatatacaagaatccaaagcaataatgtaatttatacatttcaaaaggctaatgccaaattttatcagcaaattggtcataagtctccaactggaacaaagtgagtgattgttgggcaatgtagtcctgcaatgtgaaattcttgtatgcattccttcttaaaaggaagcaaaataagcctttcctatagaatttccacttcaagattccatcatcggcacatatcaaatactgttggcaatgctgaaagtaaaagcaaggactcacataaagtcttttgttgctgaaattaaaaatagttgtcactattttcaatatcaaaatcctatggtttttgacaggtttaaattctctgttgattcatttcagaacagggtcatctttttatacttctttgacattttaaaaaataagtagtttggctagaaattgagtgtttcaagccatcttggccctttgcaccctaaaatttcagtagcactgtcaagcgaatcagttcttaagagctggaaacacaaagaagacaaatatcaaagaattaattaaaatcttttcttgaatgacaaaattgacattatctactacttatataaggagactacattgtggattaaccctgaaatcagtacttggaaagtttattccagtgtgtttcactgaaatttaaattcatgacatttgaaaaatgtaagttataattaaacactgagagtaattcttgtggttattgtatatttgttaagtattccatggtaaatgtgacctgtaaatctgttaaattaaatacttgggagtaaatttacttttactttctgtggaaacatttggattaccccaacagtaaaagtaacagattaaaaatataatattctttattttcaacttttatttcaatatatatgccagtcaaatgccagtgaataataatcacatttgattgtcaaagctcatggaatggtacacctaagatttgtacgtttctttttctttcttttctttttttttgagaaggagtttcgctcttattgcccaggctggagtgcgatggtgcgttctcggctcactgcaacctctgcctcccgggttcaagcgattctccagcctcagcctcccaagtagctgggattacaggcaagcaccaccacacccagctactttgtagttttagtggagacggggtttctccatgttggtcaggctggtctcgaactcccaacctcaggtaatccacccacctcagcctcccaaagtgctggaattacaggtgtgagctatcgtgcccagcctgtacgtttctttatatatgaagtttgcattaagagatcatgaatattgaactctagtgaatgatatgcctgctgaagtgttttaagggtgaagagtactgatgtctgcaacttacactgaaataaaatggagtgatatttggattaaacgatgaatagatgggtgggtatgtaataaagcacatataatacaatttattattgaacctagatggcgggtatatgggtgttcactgtaaaattcttccaacttttctgtgtgtttgaaaatttttcataataagatgcgaggaaaaagcttaaaacatgcttgaattataattctataatatattaatattaaaatactggaagtactcttgcttcatcaaagttactttcaaaaatattggtttttgtcatcttcaaagcatgtaataagaattttttaaattaagtattaaaataaaacttttaatgtttgaaacttaaatctcacatggcactgttcctattatggattttgggggttagacctgtagctacccatggtatcttctttcagtggctcatatatacaagatttcaatttgtagttccctcactaaaaacaaacagcctctgatgaaatttatcttgatagggacatctgaaagtgttgatgaatgccaaggactctaatggaaaacaaacaaacaaacgataatttaaaaaatactgtttgctttaaaattctactaaaatggagttagtctacatgataacattaatcccatttgctgtgccaacatttaagaaggaatctgtggtttatcatctggtttgccaattttttgttaaatatgaggaatattttagtaataattttttaaagattacatgcaataatagcttaaactttaatacccattaatgagtatccataaagaaaacaattcagtaccacttaaaaataatttgaatatcagtcatcataatacgatgaacacatttgatagagaatatgtgaatagaagtacattgaatcagttttattctatctacagatgctgaatggcatagggaattgtgggtctcatgaaattttctcagaagtacccggaggatcttcactaccagactgataaacacaattttttggttctttgcccacacaggaaacttttctagaaaagtttcaaagaatacatgccgaaacatgaatcctggaaaagaaaagtgatcttctaaatttgaaaatgaaagatttatgtggctctcacgtgaaacatcctctggcaagggagtaggtacatgatggaaatacatggattttcactgaagaaatgaaaatataagtggcaaagtaaacttcatttatactattgaaatattcaactgaggaaagtacattacttttaaattggaagaagcaagggcacatgatttttttacaggccatgtcattctctcatttctttcatattgaaattagttggacttttctttatcataacgagtgttgccacagtttacacctgccattctgacttttcgtataccacctgttgagaggaatttttttttcattctgttatctacatcattgaaaaacttaacacaatccatgtaaagaagaaacaaaaatatacttgtaatgttcacataaatatagaaatataacttaggagtccacctaatgctagaatttttatcgcattttaagtgttatggagttttaaaatttccatgtgacttaatagctggaaggaagcattaatatttaaatattaatttcaataaagataaaacaaattaatacttttaaatgaatattttaaattccctaacgagaagacaattgcataaaattaagtatgtattttagtttgaagaactaaatcattcgtgatacatgaccgtactacctgccggattcatctttttgccaaatatttcaatagtaattcttgaagtcaattctcagcacatatcaacttttactgttgtggtgggtgagagagtggagaatcaggctttaaggtgaatttataatttactatgtgaatattgccaggagttagaatgacctttaaacattttgtgaattgcctatttcaatacttaaggattttgtatacgcaaccctgtacagtaattatcaagcatactaaagttttagaactaccaagttaaacttaagaaccaaaggggccaggtgcggtggctcacgcctgtaaagcactttgggaggctgaggcgggcggatcacaaggtcaggagtttgagaccatcctggccgacagggtgaaaccctgtctctactaaaaatacaaaatttagctgggtgtggtggtgcgtgtctgtagtcccagctactcgggaggctgaggcaggagaattgcttgaaccagggagtcggaggttgcagtgagccaagatcgtgctattgcactccagcctggcgacagagtgagactctgtctcacacacacacacgaaaagaaccaaaggacgtctgttttgcagatatttagacattctattatttgctttacaaataactaagaaatacctagtgatgaataagagttggatgggtgattctgtagctaagctgttcagtaccgtagccattagccacctgtggctacttaaatttaagttcattataattaaacaaaatagaaaatttggttcttcagtcacagccgccagatttcaagtactaacagccaaatgtgcctagcagcttcgtattgagcagcacagaaagacatttctatcattgcagaaagttctactgaagagtattgttctcaactgttcatctccctgggattttatctattttgttaaaagatcagacttctaaaaacataacaacttgttttgagaattatagaagctatttgagattcaagttatctcatagaaaaagttgattgtacattttaggtgttgtattttctgaaaatatctagtattgttaaaacaagagtacttagtaagaattattgatatggcactgtacattccttgtcattaaaaaagtggtcagcacaaggaaaaaaaaaacatatatagtttaactaaaaatcacttttcctctcctaaaattattctttaagttgtggtttacaggcttgattatagcaaaccatctcaatgcctgcatgcaaatagctaaatattattgactaatctcattttgaattcatagccacaacaattctcaaaggagattcagcctctccaagcaccaaacatcctattccatttccacttcttattctctaaactgattttcacaccttcttctctctcttcaaacctccctctcacaacagttatgtcttctttttacttcattgaggaaaagaaatatgacaccccatttccctcattttttcatctgcaaatctaccagctcatctggatccaaatctacattctcctcttcccaccttttttttagagatggaatctccctctgttgcccaggctggagttcagtgtgtgatcatagcttaattactacagccttgaaatcctaggttcaataaatcctcccacctcagcttcctaagtatctaggactacaagtgcatgccaccacgcctgggtaatttttaaatttttttgcagagacagggtctcactgtgttgcccaggctggtctcagctcttggcctcaagtgattctcctgcttcagcctcccaaagaactgggattacaggtgtgagccactgtgtccagcctaaatctacactcttggcctgcctttcagttttactggaattgacaagtttacctgttctcatatcatgtccagcctttccacttggactctggatttcatttacttttaacttattcatgcatgttcttttgaaattatctctctcctccttcaatatcaatttttttgtgtgtgcctataaatatgttctgctgttttctaactttaaacccatataaaaatacgctcttttgattctcttttctctttcggatattaccttgtttttctactctccttgctacatgcaaacacacatcaaaatctagaaggaattattcatactttttattgcaattatttacctcgtattctcttttcaaattagttcatcagggcttccctgacataggctggttttctttcctcctttccttccttttttttttttctttcttgtttttgtatcctatggtcacatgactattgcattgtcaaattgaatggccatgtctctgttcttcccatacttgatccctccacagaatttggcacagttgactacttgctccttctggaaaactgtcttcttttgtactgagccacataaaatcatcctggtttcctcccctctcagtttccttttctcatcatttctgtatccccaaatgttagtgccagttctagcttcatacttttttttggattaagtcatccaatctaatgtctttaaaatgctaactatatgcaaatcacccttaatatgtttttatatttaattctaacttatctcgtgaacatgaggcttttttcccctcaaacagcttacttgacatacccatgggagtacgtatctaatatgaatgtcaaacttaacataaacagaccttttgatttttttccatcagacctcccagcataaacaacaaacaaacctgctgagccctcactgattaactggttccattatgacccgatgactaaagtcaaatttataaatgcttttataaacttcatatctaatcatcagtgaatcttgtctcctgtacctcgcatcccccaaatctggccacttttctgtttcttcattatcactaccttatctcaacccttattacttctcacctagactgttacaattatttcctgtcatgttttttttcttttgtcaccatacaattaaatctcccttcttcctctacagatacaataatctttgaaaaggtagaccaggtaattttactccactgacttcctataaccctaaggcaaagatctgaatattttaacctggtctacaaaatccttcatgtcctaacctctgcctagctttttaccccacgtcattccctttcccacttgcatctcaggccaactcctacattagcatctttatgtagttagtagatgtttctctgcatgaaatgttcttacttcagatcatctctatgtgggcttctcccttaattgatactttctcagaaatcttaattaagtgatactttctcagaaatgcctttcctgacctaacgaaagtaggaacagtcactctcaatcacttcaacctattacagttgtcagtgtggaacttatgctctctaaaatctttcttattttacttatttactgattaattatgtatctttatctgcacaaaataatctccattttatccccactgtctggagctttgcctgttctagaatctgaactctttgtatgaattaaataaggatgaagtcaaaacaaactgtactgttttttgtttcaagtatcaggcgatatttaactatttgaagttatgggactaccaaagttactccttctggttgacactttactgagacaaacaccagtgatatgaaatttccatatagtcatgcatcacttaacaacaggcatatgttctaaatgcattcttagacaattttttgttgtggaaacatcagagtgtacttacagaaacctagatagtatagcctactacaaacctaagctatatggtagagcctgttactcctacaaacatgttactgtactgaatacttaggcaatttgaacacaaaggtaagtaattgtgtatctaaacatttcttaacatagaaaaggtacaattcaaatacaatattataaccttatgctaccactatcatattatgtggcctgttattgacagatacattgttattctgttcatgactgtattagtaccaggttgtggctgtttctaatatatcctctcccactcctctcattccttactgaagtcaccagggtagtagcaaatcactggaaccagacctataatatatctgacttggtatctgtaactgttctgagaaacatgtgttgaaaggcagccaggctgcctgatgattatttagtagctgtctttctttactgaacaacagtgaataatatctttgatctctgccactgagaaataaacagaacccatcaggaatttaatccctgggaatgattttcacatttcctggtatagacgtttgattttgaagctcatatggtttgcacaataaatatttacctatttatgtcaaaatgcatgttaaatcatttttatggttggtgtgaggaatttgtgaaacaatcccatccttttgttattactgtgtttttgtaagaggacttctcacaccttaacctcatcaatagtttttcctgtgtgttaatgcaacaaaatggaagcaaaaagatatattttgttttcatttattttattcacctgaatctatccagagggaaagcactggaagtgttttctttttaagagtgttaacttgtattcttggtaagatctcatcaaaagcttaaataacgaaggtaagagtcagtattctgtggacagcttagctctacacaagaccttctgtccatcttgctagttattttccagttaatggaaatcttatagacagaaaagctcatgttagcttctcccgcatagtattatgtcaacaatccttactctaatccttgatgcagctctttacctaaatgttatagagatggagaatcacagctgccagcaattcaaaatataacatgcagtagctattttttaaaaaaaattttatttgctctcataaaaataccatcttaaagggtttttgaaaatttacttgtgattttgtctttttttaaagtattgagaaaactattgagtctgaagtaaagtctctaaaatacatcttgtcttattgtaaagtaatatgactgatattttgtgtgaattttagaattagttttttcactttatagattcattacatagtggcacttgatttaaacattgcatcagtactgtagcccttgggcatcgtgtatagagtgtctattagctttaactcatttctaaaaaattaacttctaagaataagaaaaatattgaaaactcttgaaagtaagttagaaacgaccatgattttatttttatttttaatttttatttatttatttttttgagacggagtctcactctgttacccaggctggagttcagtggcacaatcttggctcgctgcaagctctgcctccgaggttcaagccattctcctgcctcagtctcccgagtagctgggactacaggcacctgccaccacgcccggctaattttttgtatttttggtagagacggggtttcaccgtgttagccaggatggtctcgatctactgacctcgtgatctgctcgccttggcctcccaaattgctgggattacaagcgtgagccaccgcgcccagccgattttttttttttcctgcaaaaccatctaagggaggtgtttgggttttcaaggaaataccggctataagcatcattggatgttttggtggggtgggttttttgaaaatgtgtatgcagataacagtgagtgatattgcataagtattttaactacttagattgtttaaatttggttaacataaaatcaaggaaatggcttgcattattctatcttttcttttctaaacagtgtttccttaacaattaattctaacaagtcttggaaccatgggcactttctttcctcctgtcaccatgattgatccctattttgttggaaagtgaaaattgagcagttttaactctaaaggctaacattatggaaaaaaatttcaactgaatttgctagtaaatgctttgtatgaaaatatttagaatttaagtacttctctttacagacaaaatcatttattttcagtgtattatgaacatagttcctagtagggtatgtaaatgattcacttttaaattatgaatattttcttccaaattccattgttaaaattagtaagtgtaaagtatgacttttaagcaatatttcattagctatcattaacaagtatttaaccaccttgtttcaaattagttagctaatgaggtataaattattaaatctgaaaattttatttggacaagtattgtatcattaatttaaaatgattacaatgtagttgaattgttattcagtatttaatattttattgcctataaaaataaataatagccatgcaaacttatttttcaaatggtgttatctgtgctatatttaaaataggccaggtgcggtggctcacgcctgtaatcccagcactttgggaggccgaggcgggtggatcacgaggtcaggagatcgagaccatccttgctaacgtggtgaaaccccgtctctactaaaaatacaaaaaaaaaaattagctgggcgtggtggtgggcacctgtagtcccagctactggggaggctgaggcaggagaatgtcatgaacccgggaggcagagcttgcagtgagccaagatcacaccactgcactccagtctgggtgacagagcgagactccatctcaaaaaaaaaataaaaaataaataaataaataaataaataaagttaggtttgcatatatgagcatatgcatttataactagatggaaacttccttaaatatttaacatttctccttaaattttatattttatagtacttttttatggttagattctaagttctacttacattcagtgtgtatacaaattgagataggggttgtaatggaatatataacttgaatatttctatttgcattgccatagcatcattttattttgctcttagcaaaatctttctatagaggctttttctcctttcagttgtaaagaatctcttatctttaaaaaatatgtctcattattttcttacaatgtaatagtaaaaacaaaaataccatcaggtttttctcgatccttcctattttcctggatgtgtgcttttgtgtttttattgatatggataaatacatcttcaaattcaagtactagcgtttcagagaagtaatatgcttcttttgttctggttcctcttaaatgttagtaataaagaaacaattaacctagatatagaacaactcagtgaagggaaaatgtcttcatgggtcccttgagaaagacctatttagctttttatgtttctaatttttaacattgagtatagagtatatagctgtctttacacttttttttttttacattttagcttatttgtaatgctaacaggtaaagtagaaaaaaaaaatcactaaaaaaatggggatttagtagaaaaagaaaactcagtccctaaataatatcctacacatttacattatttccttatgatattttaagtgttccctatgaatatttttattttcaaaatgccaaagttatcagtaattttaaagctaatactgccaatcttactcttccaattctactcctaatcttttcctcctaaatgcttgatccaagtacctccctttgggacaagtaccaaatgtctttctccatatgattttttgaatgaattctgagtgagttaattaattaattctaggaattaatatttctttgatttctagcaagccagagcattttcttcaaatgtgcattaaccatgtgttaattatatctttatgtatacactgtagacattgtgtatgtgtctgtagatttccagcttggatttatacattttaattttcattggtttgcttttactgtcttaggcccctcaatccgtgggtagaccttggaggagcaagctttcagatcttttccactggagttctctcccccattgcagctcagtggccatcatgatatctaccagaacattcagttttctgaaactgtgtaaacactcttgtaaaaacacagtgtagagtcactgtgggagagtgtcttcaaccaccattcctatcctgtaactgaacatagctgataatatgtcagtagttttatttttgtccatcattcaaatagagttccacagtaattgtttcctcttggaagataacttgcttagcagtggggaaaaaaatggattagacagggtaaaatgttatcggaaatgggccctgatccagaaccctagagagggttcttagacctcacacaagaaagtattcggggagagtccgtacagtaaagtgaacaccagtttattaggaaagtaaaggattgaagaatggctaccccataggcagagcagcggcatgggctgcttgactgagtatacctatagttatttcttgattatatgctaaataaagggtggattattcatgagttttctgggaaaagggcaggcaattcctggaactgagggatcctcccccttttaaaccatgtagggtaacttttggatgttgccatggcatttgtaaactgtcatggtgctgatgggagtgtattttagcatgctaatgcataataattagcatataataaacagtgaggacgaccagaagtcattttcattgccatcttcggtttggtgggtgttggccagcttctttactccatccttttctgtcagcaaggtctttgtgacctgtatcttgtacaaacctcctatctcatcctgtgactaagaatgcctgacctcatggagatgcagcccagtaggtctcagcctcattttacccagctcctagtcaaaatggagtcactctggttcgaacacctctgacaaaaatattctaagtataaatacatcaaaccacattgaaaaattcatcaccaagttactttcagtacagttcattaccccatatctaaaagcgatcttgaaatctgcttggttgttagtggagacgtttcacttccttgttattaaaaaccttttcgctaactgccttattaagatattattcatataccatacagttcatgcctttaaagtgtacaattaaattttttttagtatatttacatagttgtgcaattatcaccataatcaattttacaatattttcatcacccccaaatgaaacaatgtacccattaacagttaccactcatattgctcctaacccttccccctcagccataggcaactactaatttatttcctgtctgtatgagcttgcctattctgcacaatttatataaacagaataatacaatttgttgtttcgtgactgatttcttccactcagcacaatgtttttaagattcatccatattaaaacatttatcagtacttcattctttcttattgttgaattacattccattgaatggatataccacattttatttatctgttcataatttaattgtcatttaggttgtttctagtttttgcctgttataatgctactatgaacatcatttacaagttattgatgtgtttttctgtctttatgaatagaaatgctgtgtcatatagtaactctatatttaacttcctggggaacggtcatactttccaaagaggatgcaccattttatattctcattatctaatgtatgatggttccaattcttccatctttctcaacaatacttgttgttatctgtcttttttattatagccataactgttttcagcagttctgtggatttatttcactttcttgatagtgtcctttgaagcacaatagtttttaattttttataaagtctactttatttttttttagtttttatttttggtgttatttctaagagatcattgtctaatccaaggtcacaaatttgatcctatgttttcttgcaggttttgctatagttatagcccttacatttagttaatcgatcgatttacaattaaatttttacaaagcgtaaggcagagttccagcctccttccttggttatatatatatatggatatccagttgtctcagcaccatttgttgaaaaaactatttttttctccctttaaataacctggcacctttgttaaaaaataatggatcataaaagtaagttttatttctggactctcagttctactcgttgacttatgtgtccatctttacaccagtaccacactattttgattatcagcactgagagaactttaaatggtttatggggagagagtagctttgggcttccctgagggttatgtcttgcaaaactggaagctcagccatgctactgttacaggaattattggctcttgtatgatgtgagacttgtaatccagggtgactcccacgtctatcaaatgtggacactggtttatcttctggagggtcaaggagaataatttatgaattaacatattgactgttgaacgtattctcattgaagaggaatacctaatgctgccccgctaagatgctgttcttctgccttctgttctcagaatggatctgatgccaagtatagactatagtgatcttgtgagtctcagtgttcagcagagccaaagatgaagactaggtttgtgcctagacatagaaacggggtgtaaaagggtttaagctacttggcatttgtctgtgaggaagtgtatttcacacatattggcagagtatgtttgtaattaggcaaatataggtcactggaattgatctgctgtgaactaattgatctaccttgaacaaaccctgtaaccactgagccacagcctcttcaactgtaaaatttaaagactagtaattgatagtctctatccctcatgctgaatcgagcatcctatgacttgtctaagattgttcacactgtagtttgatactttcttacattcctgaaaatgtgagttttgaggttttttcagatgattttctctatgggaaaaaatagcatacagaacattctcatgacctcagactagataataaatgactgagcaatggaactgtaactgtgaatattgaaaattataaaaaaaaattagccagacatggtggcacgtgcctgtagttgtaactacttgggaggccgaggtgagaggattgcttgagctcaagcttttgaggctgcagtgagctacgattatgctagtgtactccagcctgggcaacaaagtgacaccctatctcaaaaagtgagcccctgagtgtactgtaatgatataataaccatttctatatacttatgtgtgtatatatatatgtatgtatgtatgcataatatgatataaatcatattatggtgatgcttttgattgaaagacaaggagatcttagagtgagtggttttaactctgattatgctgctccctgatataccacaatgggtgataacacttccatgagcttcaggttcctcctcttcacaataaaagttttgtgtcacttgagttcagattttcctttcaactctaaaattatatgattaatgacatgatattcttcatatacatccatgcttctttgactatttaggccatagtgtctctctctaatacaaattttcagataatttgccaaactgaattttcaagacattccttctcagaaacatggcctccaataaacaggttttacatattttttccttttcctgttggccctaacgctgtcaatcttagcctcatcgtctagcatagtcatttatgcaggatcctgtgtaaagttgatgaaaaattctgtcaatatgaaatatattgaagattgccagtttacctttttattcatttattgtcatgtcacttgaaagatattaacgtttatatctgtctaaaaatttactctctgaaaacaataaataacatttggccttttgtgttaccgtttctattgaataattattctgaggtcccctttcacccatgaaagcacagtaacttgtactctaaagtcctacaaagtattagatatataatatctaggcataaggtaaaatctattattatgcttgggtccttaggctgtgagagtgaccagtttttactttcctacctacttgattaaggtaactccagtgaggtagaaaataagggaactgagtcaagaacacaaagtgtggtatgtaattgccattttagatatcattagtagtcacactcccgaaacattaaaaattaatgacagagtcaggaagaggagagaaggtgtcttttgcattgccataatttttacaatgtctacatgctgtcctatagcctggaatatgagatttttaaaatcatggttactatcatcactcaagtgtcttaggctgaaaaggacattttccatatttcataaattcaagtcccagccagagtaatcaggcaagagaaacaaataaaggacatccaaataggaagagaggaagtcaaattatcctgttggagacaacatgattctatatctagaaaaccctatagttttgtccccaaagctccttcacctgataacttcagcaaagtttcaggatacaaaatcaatgtacaaaaatcattagcattcctatacaccaacagcccagctgagagccaaatcaggaatgtaatccgtgtcacagttgccacaaaaataatgaaatacctaggaatacagctaactagtgacatgaaagatctctacaatgagagctacaaaacactgctcaaagaaatcagagatgacacagacaaatgggaaaacattccatgctaagggatgggaagaatcaatattattaaaatggcaatactatccaaagcaatttacagattcaatgctattcctatcaaactaacaatgatgtttttcacagaagtacaaaaaataattttaaaattcatatggaaccaaaaaagagtccaaatagccaagacaatcctaagcaaaagtacaaagctggaggcatcatgttaactgacttcaagctatacaacagagctacagtaatcaaaacagcatggtactggtacaaaaacaggcacataaaccaatgaaacagaatagagagctcagaaataaggctatatacctaaaaccatctgatcttcaaacaaagctgacaaaaacaagcaatggtgaaaagactccccagttattcaataaacggtgctgagataactggctagccacatccagaagattgaaactggaccccctccttataccatatacaaaaatcagctcaagatgcattaatgacttaaatgtaaaacttgaagctataaaaaccttggaaaataacccaggcaataccattctggacgtaggaataggcaaatatatatttcatgacaaagatgccaaaagcaattgcgacaaaagcaaaaaattgaaaaacggtatctaattaaacttaagagcttctgcacagcaaaagaaactatcaacagagtaaacagacagcctacagaatgggagaaaacatttgcaaactatatatctgacaaagatataatatccagcatctatgaggaacttaaaaaaatttgaagcaaaaaacagtcccattaaaaagtgggcaagggcatgaacagatacttttcaaaagaagacatacatgtggccaacaagtatatgaaaaaaaggtcactatcattgatcattagagaaatgcaaatcaaaaccacaatgagataccatctcgtaccagtcagaatggctattattattaataaacagtaaaaaaaaaaaaataacagatgctggctggttgtagagaaaagagaacacttacacactgttagtaggaatataaattagtttagccattgtggaaagcagtgtgacgattcctcaaagacctaaaaacagaactaccattcactcagcaattccattactgggtatatgcccaaaggaatataaattattctaccataaagacacatgcatgcatatgttcattgcagcagtattcacaatagcaaagacatagaataaatctaactgtccatcaatgacagactggataaagaaaatctggtgcatatacaccatggaatactatgcagccataaaaagagtgatatcatgtcttttgcagaaactaggatggagatgaaggccattatccttagcaagctaacacaggaatagaaaaccaaataccgcatgttttcacttataagtgagagttaaatgatgagaactcacggacacaaagaaggtaacaacagacacaggggcctacttcagggtggagggtgggaagagaggattacaaaaaaataacgattgtttactacgtttagtacctgggccatgaaataatctgtataaaaacctcctgtgacatgagtgcacctatataataaactccacatgtacccctgtacctaaaataaaagtttttaaaaataagtcaaagatgtaatcttttctctcatgtttttatatctctgaaatcaagacatattttacaattgattgggagcaattttcttgcttgaacataaaataacattgaatctcgtcatcagagtatcttggattagacaaatttagtatgttcagaggcaactttaggtagggaatgacagacctcaaattccagtgtgtcacagacttattaaataggaatatggtatgcaaaaatttgctgattaatcagcccatcataactgaggcttgactctatgcctatgtgcatttttactttgtctttcacttcaaagcaggtgcagctgcacagtatgaattcaatacccatggtaaagagtccctttaaaaggctatatttttatatttaatatgtggatacagaaataacagaaaaagataaataagctatccaaatgcaaagaaaattacattcatagacatacctcttattaccttttcctctcaactctgcagaaaatatgaagcaggttggaatgttcattttatgtggctctcaaggtactattctcataaaggtaaaatgagaaacagtaaattattgtgaagtttagtaataagagcaaaaaagacatatatttatgagagcaaaaatattgagtagcatttggccaaaggatcttgaaactgatttgaattgatttaaccagtgtaaataaaaatgatttatcaataaaagcttatttctagaagtgtttttttcctgtttttactgttcttttcagaagcgttcctttgcttatgaacagtttagaatatgatctttttgtcaaataaaatttccagcaccttgcaatatcagagacgattttctttctagaagttttagaagacgtcattatgtgtcattctagacaaataagatgtgtttggctgaaatgttttagaagtctctaaggaaagaaataacctgttgattatattttgacttacttggggaaatggaaagtcacagccaagataatgctaagtctccaccaatcacattttattatgtggtgtgcttgcctttggccctctctctaccccttggaggaacaggtaaatattggcacaagtcagatgaaccctacccatcactttttggatatatctacatgtcataagaattatgacatgatcaatcaatgtaccagctaattttcataaatgctgtacctcatgaatggagaattgagttgagcatgagtgaaaattggattttccccactcagaaaaaaataagccactatatatattttttgtttagttctttttattttggttattcttcttttcctttatattattacttaaatttatttatgatactgcttcaagcaatatttaacgtatcaacattttgaacagttttaagtataaaaaaatttgaaattctgttctagtgtgaaaatacaccagtgagtgacatatttgaatgaacatttgtagaagtatgttgaccttaaaaagcaaaaggatttatttttccttttattcaacagatattcatatttgtaccagtcattgtgtaaagctctggggaatgtttcacattttcaaaagggtagagattagcgtttcattttgtttttgacttatctctcttgttacaagctctctgcaagatatttacttaagagttggatgaaatgggtaaataaaaagaaatttatgaggcagaagaaaatgtggaaccttcagacatccctttttggtaccacttttatgacactttcatctaatctagctccatctcaattgacctccatctaattagtcataaaagagaatcaagttctatactgagcaagcatgcctgtgcttcatcagtaacatttaagaaggggcagaaatgagtcaaacacttaaagatgctgctttaaaaattttaatgtgttcttcaaagatgcaagcttattaaaattttagttctgaagaagtaagcacagtatctagtttggctccactgatccttttagacatatgtcacacactttcttctcatgctcaagagggtgattacatcatttgcatagatgtccgttttatctctaatagattatgaattccttcagggaaatacttgttttaaggggaataccatgtttttaaaatctttattttgcagagagtaactatgccatcaccttgcatgtaataggtttttaataaatctaattaagtaaaagtaccattgacttctgttcttggtggtctcaaagataatacttgagtctgctaaatttggaggactaccatgtagaaaagaaaagaaaagaaatgcttctaaagattccgagtaaagctagaaacatagttccgtagttcctagtctctccgtagagagaatacgataactgaagagggctttatatgctgagatgaaatttagtttgttcaaatccgtaatgaattgccatcgggaagtactggactgcttgccactataagtgttcaatcagtctggacaagattttgagaggaattttctagagagatcttagtcatctaatttgcggctggcctacttgacctttttcttctttactcctgaatcttgtttataaaaaatgcaatgtaataaaatataatttatattgtatgtaatataaattatttatacctctgtgaatatatatgataaacaaatgaatatatacaatgtaatgttatattacatcatgggtcattttcttcctaaactataatcatttttacagttttaaaccaaaaaggtagtgaaaataagcgagcccatattaaatttctaggaagtatccctaaattgtttcctcagtcttttgacttatttcacatggaatcctaacatacgtggttgtctgtttttcatgtctcaataaaaaaagttgaccataatataaaggataattggaacttggccacatataggaatataagacatctaatagtaaaaaaaaaaaaaaaaaaagtttataattaaagagaatcgtaagttttataatgacttagaggcatcagatgaaagagaaaacttgttctgtgcaatcccaggggaaagaattaggaaaaatgaggtcaaagctgaaagaagtacaggtttctgtttaatataaggaagatatttttaacatttttctgaaaacggacaattttgcctcaagtagtttcatcttaacagataatatattttcaagcacaaaatgaaaaaccatgtaataaagatattgcagaatacatccaagaatccgatgagacattatcttagttttctactttaaatatgcaagctccttaaaacttctatagatcaacacattatgtgatggtttcaatatgcctaaggtttgatcgtgtagtatagcgttgacttagaagttgtaaatggaagaattaccttttatttctcagccagcggaacctatttatctctttattccagatacgttatgtgatatataatgggcaatgaaaaggttggtcattagagcagctttaaaaaaaaaaaaaaaaaactcatcacagcaagtggaatctgtgttgaatgtttaactgattgtaactgaaaccttggcagggggatagagagacagaaatgagattaaggtagggacagttaaagaaatagcaagagtgtcattttgaagaatttgaatttgatagcaagcattattgtgagctgttgatgaggacaatatggttatgaacataagaataatctatcagtaatgtatatgaacccttaaaatgagagaagtagatgtcatggaggaagaattgtaattttatgatttactatgctgtgatgaggagtaggatggggaattgaggggtggatacgtaacatttttttttttactcattaaaatttccccagcccctaaataggttgtcatattttaaaactctttattattttatccttgattgtctggagttgccaagtatattagtaagtacaaaaagtaatggtattaagttttaatgacaaaaaaatgaatccactgggtataattagtataccaaactagaaagggcctattcaaagatctaatgaaatgcactcagtactttaatttaaattccacaaagtgctgaaatgctggtttatcttcccaattccctttagtgtcattggtataccacctttactattgtttccttaatgtattttttctgagtttgattcgacattcacctcaacatagatttgtaaatctacttttgtgaaagttatgcaactgctgcatttggacaagtcagctcatctatgaaataaaattctccttagtcactgtgaaggtaaaataaactaactcatgtggacgtattttgtaaatataagtcaatttagttatttttatttttagttatggaagccaaagatcgaatattattatttttaataatcacaaattagttgtttttatatttattatgggggcagaagctcataatattatttaaaaaattatcgtggagaaaattttaaaaatcacatattcctcaggataaattaagatttggtaagttctccctaacaatttatggtagtttcttaaccttgcatttgatatcaacagtattcaaatattagggtaatgatttgtaagttatcttttaaggagttgtctttgtattctattttaaattttctaagaaaatcgcacgttacttgctctccccacaccatttttatgaaccgatctcatatccactgggtatgcagttgaagtttaaatgatttcacaatacacgtttcctggcttttagacagtgtattatgtgtttagattacaaatagttagaaatctatttgcataaaattttaaattatttttataatgtcagtgatttaaaattattgataatttcttggattttgttctgttcacaattttttaaaataatgattgtaactgaaagagtaaaaatatccgacatgaaaaaagctacattaaataattagcatgttttaagttacagttgaagaaaaaagtgaaaatagactaaatgagatttttatcacatttccaagtgcaaaaagaatcatccagtgttggggataggaagtttttttttttaagataagaaaaaagatcattttaaaatttgactatggttttccatcttgctcaattaaaaaaagtcatagcatgtcactttcactgttaattacctaatcatattcaaagtcagtgattgacattttcacgaatccttatgtggcataaacacgcacacacacactgtgtgtgtgtatatatatgtttgtagaggtcccttgcttacctgtagcttttgacttagtgtattaataattcattttatgcaaatcaaaaccacaatgagataccatctcacgccagtcagaatgacgattattaaaaagtcaaggaacaataaattctggcgaggctatggagaaataggaatgcttttacactgttggttggaatgtaaattagttcaatcattgtggaagacagtgtggcgattcctccaggatctagaaccagaaataccatttgacccagcaatcccattactgggtgtatacccaaaaagtatgaatcattctgctataaagacacattcacacgtatgtttattacagcactgtttacaatagcaaagacatggaaccaatccaaatgcccatcaatgatagactggataaagaaaatgcggtacatatacaccatggaatactatgcagccataaaaaggaaggagatcatgtcctttgcagggacatggatgaagctggaagccataatcctcagcaaactatcacaggaacagaaagccaaataacacatgttctcactcataaatgggagttgaacaatgagaacacatgacacagggaggggagcaacacacaccagggccagttggagggttggggatgaggagagaaagagcattaggacaaattgctaatgtatccagggcttaaaacctagttgatggcttgataggtgcagcaaagcaccatggcacacgtatacctatgtaacaaacctacacattctgcacttgtatcccggaacgtaaagtaaaatttaaaataataataataataactcattttagttagttgtttaatgagggtatgtttttacccaagttctgcttttatgggagtactggatactaattatggtttactgttatatatgtatgtatatatatatatatatgtgtgtgtgtgtgtgtgtgtgtatacactcaattaactattttcaaatatttaaaaggatatatttaatccagtacatagaaaagcaaataacaatgtctagcataattttaaatgaagggcatttatgaataacacatacagtgtgatacaaatatatagtgagcctaccaattaagatctgataaaaaaagaggtacatggttaatattatcaacaaatggttactacagaatactagatgagggttaaaataaaatcattaatttgtatctgacgcaaaaataaagcagtcaaatttctaaagactgatttatgcatgtgtaacacagtcattcggttatctttctgtctacaataacttcaatcatttattttacttcatttaatattaagcaaaactctttgtgtgtggtagtttgtaggggaaagcaataggggtagtattttaaagtaaggcctctgaaaatgatgctgcttaatttgtcatctaggcactgccattattaggtatataattatagaaaacttactttctcaacccctcactttctcattcatattatgaagattaaaatatgcaaaaatattgtgagataacttatacaaaccactccagagactgcctggtaccttttaagcattcaaatgagccataattattaaaaagaataaacttatcctccagtgtatggtaattctgaaacactagatgtctaatagattttctcatttcaatccaaacaatatttattgggcccttggtatgtttaaggcattgtgcttgattagggacataaaaatgagtaagacagggtttccactctcaatttctcccaatttagtatgctccttgaaggcagtgtccatatgttttgatcatctgcagcatttgatgtagtaaagcgtatagccatgacatcacttaataaaaagcacagtgctatttgtttatatttattacaatgtcttcttcctcctgaagagttcaatgagtattttatcagtgtcaattctattatctacttaacaaatttgaacactgaggaaacagtaagggaaaaactgaatgctaataagcactcacagtctttgacaaatttgtgtctgcaactgcaggccaaggaagcatgagtcagagccacagtaatcaagttgttccatttttcttttgaccatgcaatgttggataccgttgctttcttgacttttccttttggtctgttttaggtgtctcagactcgaagtttgtgtgatgagaggagcacagtcccatagcaatgctaaaagatgtgtgtgtatgtatgtacatgtgtatgtttgtgtatccgtgtgtccaagcacacacacatatatgtgtttggaaaattgggttttgattttcatcattctgaagtttaattccccattagagttgattcactacataccaaaggatatactggtttattcacgtattcaaattgtactgagtggctggtatggtaagtgccatgagaggtacaaagatgaggatactgtggtccatttcttggaaagcccttaaaaacttactgtttagccactgcatgttctcactcataggtgggaattgaacaatgagaacagttggacacaggaaggggaacatcacacaccggggcctgtcgtggggtgggaggatgggggagggatagcattaggagaaatacctaatgtaaatgatgagtattaacccattagggtgcagcacaccaacacggcacatgtgtacgtatgtaacaaacctgcacgttgtgcacatgtaccttagaacttaaaaagtataataaaaaataacttactgtttagcatgtaatacatcaggaaaacaagtagttatatgtactacttatatgaaataataaaaatatatagagaaatattctcagtaagaatgtggaaattttatatttgtttttggtgctcactgaaagcttcgagaaatgtagcacttatgctaaaaattcaaggatgtgataggctttagaaatggaaaaatcgtgtagaaggacgttttggcaagagggaagaacatggctgaaacattaaagaggctattaatgtttcttccaacactctgcttattgtgagacctagcaggcactaaataattaatagcttgagttaatcagcttgtagttaactgaaaaagactgttctacagaagaaatatgacttctgactgactagaagtctactattaaggcctgaagacagctgtagaattcataatgccttcttcagttcaaaaaatgaaaaatttggttatgattcagcatcccatatattgaagttattatgtaaaattatttaatgaatttactttcttcatttaattcttctaatattaataaagtgcctacttctggatacatcagctgtgaaacactggtttcattctgccttttacctccttagatatgagggtgggtgaatttgctctttttgaccctcttctttagacccattcactgtccctgatctgatctgaacctagaagtctctccccagtcctcaggagacagacaggattgaaccccatgcagagagaaggtagtatgatggaattgaattcccggacagatgtggcattgaactctggcactttatctgagtgccactggtcataatgctgtaggttaatttcctcccttaaaaaaggatggaatagcagtctccttgaagtgttataagaattttagatggtacatgtaaagcacctgtaacattcagcacctttaacattaatgcagtaagcattcaacacatgtctaaatggaaggtgatggaaaagtagtccctccttatctgcatgatacatgttctaagaccttcagtggatgcttgaaaccacagatagtactgtgccctatatatactgtttttccctatgcctatgcctatgtacctatgataaagtttaatttataaagtaagcacagtaagacattaacaataatagctaataatgaaatagaacaattatagcaatatactgtaatgaaagttattttccttctgaaaatatcttgttgtacattcccacgggcaactgaaaccacggaaaatgaagctgtggatggaggatcactactatattattgttattattattattatttgaatctaattattagtctctaacaatagtgtttggtaaacatatctttattaactagtagagtgctttaggttaggaatgaacacaattaacacttcagacagtctccaaaatgttcttttaaaaaaatccactttatttcagctatattttgtgtactcatcttgctgtatgaaaattcttcaaagataactgcagaaaaatgttaaattgagaaaaggtgttttttgttttttttttttgtttctcaacataaatgagccttgtgtgctttcatttgcacatacctttaccaaggtaaaagtgtttatatattgtcaacaatgtattgatagactctgccaaggactggcttgtggatccctttggctcaatgcctgtttttgtaaagttttattggaacgcagatattggttaatatactgtctgtggctattttcacactacaacagagttgacaagaggccttatggcctgtaaagctgaaaatgcttactatctggtcctttgtagaaaaaatttgtccctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtacattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttatagacatgaaatccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccacatgtccaacagtgatagaatggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaatctgcacaatgtgcacatgtaccctaaaacttaaagtataaaaaaaaatgttcaaggatgcaaatttgaagggaattctcaccaaaatttatagacttgtagaagcataaagactggaaggaattttttatccttcaattattctaacttcatataaatgtattggaatccatgataaatggtaaaaaaaaaaaaaaaaaattgtcaactacacttttacatttagtgtgccatagaaaattgttttacaatttagggttttatttttatagaatatcagccttttatgactagtatttataattgtgaatattaaaaatatagtacacatttattcaaatttgatggatttgaataattagggaacagaattgatatctgcttagcctcattagagtgaatattatggtaggtttcagaaatacagtttctacttttattttatcatttacagccccaattaaattctcttgcctttctttctaggacaattgagaaaaataaaaaagtgcgattgacaaagacaatgtagttcactatagtggagcatctgagcttcctgacaggctagatggaaaaggaaacacagataaatacttttttaatcatgagaaaataggaagtgtatcaattactacagtaaaataaactttatcttgatgctggcttttaatgaccttaattatatgagctattgtgaggcagtatatggtagatgttaagaaggataaaattggcatcagggagatataagactgcagtcctcatatactctctggccgtgggcaagttacttattcttttagaaattcagttatgtccagttatactataactacaataaataggtaccgtagagaatttccccatacacactttcatttgtcttaatttatggtgagactatctataaaaacagaaagcattaattttaaatattaatatatttaaggattacttaaagttaaaaacacatttccaaaaatttatatttttagtttaaagtatgcacttattaagttgttaaatatcctgggcttgatgtatatttaaaaacaaagaatttaaggaaaccaggtatttggaataattaatgggcatttaaaaaagttatgtttataaattgtagggttatatgtacacacaaaaagaaatttaaatgtaacatacataaggacaacgtaaaagtttatttcttaaccttcttaatctacttaaaacttttagaaaagctcttctttcagacataaagatcagccttctgccattagcaaaaaattggaaaaatagaatacacattttctcatctaagcaagtatttttagagtcattatttttatgttttttttccaattgaagaaaatatagggtgcatatcaggaaatacaatctgctagtatcactaagaataaggaaactaatgttgacatatttgactcgaagaaaacaaaaccattattgatgacatccatgtttgaaaagaaaggaaaagtgtttttatggaaatatgtagtgtttaacatccttagaataaagtacatttggtgatatttttaaaaggttaaacaaaggcagatcttcaatataatgatatttatctccattttatttctggcttttactttgatattaacagaaatatatgcacagacatattagcaggataaaacaagggtcatgataaaactgaatttatttttgtttgaattataagtagttttacacattaatgaaagtccattgttatggttaatcccctggcaacttgatctgtgtaatgggttttcattttctttataaataattactcgctgtttaatatttcaaaaaactatagtgtaggcatattgacttgttcaataaagctcatttgtattcattgtggactcttgaatatggactatagcagccagtgaaattggtggtgttttcttgttacgaataatacaaggaaaaacccaaatctattcaattaaatttttgtgtgcaaaatttcagctatagtctaaaaacgctacataatttatattacaatcattttggctaatcagatacccaatcatattttaatagatttccctgggagaagaaatgggatttaagcttattaatctgtatggcatgcaattaagctaacattaagatgaccaaaccagtatgttttattccatttggaataggatcacttctccagagtagtagatatttcggaatttacaaagaccaagaaaatgtgtattcctttatgatttttactgcatgcttaactatttattattccatcttgttcttgaaagatttttaagttctttataaaaatacatacattacaaagtaataatacgtagaggagggaattgggacagtgttgggaagaaaagctgtgccagaagtgaggctgtccagaggtggatcataaatttgtgtctaaactttttagtactcattgcaaaaaaacatgatatcaacataattccacctttatgaattgtaactttttttacattaattactggagctcagatcttccattctagatacaaacaaaagtttagttttaatgccagatcatttaaaggcagttactttaaaatggcatcctacaagactactttctgtcagctgcctatttccacacatctataggttaaataaaccaatattgaataccattggcattacattttttcaagatttgaaagtgactcatgaatcattaaggagaggttgaattacgtcaagtgtagtttcactactacatttaactgatacttttaaaaatgtactcactttcatatggtgcataaagctctgttaactcaaatattttcattgtccttgatatttaatacctcagttattgatagcagtcaattgctcataaccaaagaaatgcaattgacatagtgtaaaagttcaatttcagtgttctttctttaaaaacccttcaaaatgagttttaaaataaagtaataaaatttctaagtcaacacttagaaatctagataagccaatagtttcatatagcgtcttcaatgttacaagatttgtgagtactggcatgtgggtcagaaaacaaggggtttgaattccagctctgctccatttttattgcaatttcagttatcattttagcacttcagaataaaaaagagatttatttaatttctaattttttttctacctctcagctttttttcaacctgtgtgtgactggattgcccccactttagttaggttatcataatatacctgtattatttaaacatacacaatctcattgtcacttccccacaaaattaaaggaaaagctctctaaaaaatggaaaatttttagcacttcagaataagagatttgtttaatttctaaatttttttctatctttcagcttttgtctatctgtgtgtgactgaattgcctccactttaggttatcataacatgcatgtattatttaaatatatacaatctcattgtcaccttccccacaatattaaaagaaatctcttcaaacaaaatggaaaagattctgaacaacgtgaacctaagaggcctaaaaatgactaggcaaaacaagtgaagttagaagtgataaaggatattgggagaaatacagtaaagacataaaaatatctattctcctttcctcatttacccccacattcatgtcatttgcctggtttatttacctgaagatatatgcccattgcagtgaaactgtatcatgtcattttatgctacacgtaaacagtaatggatatattaccatttaaagcatattaacctattcatgatgtgaaagatataattgatctttaaatgttttatgcagaaatccttgatggattattagttgttagactattttgattggggctctgggtgcactggaaataaattattgtttttatcatttaaaataatgaaatatagactcctactagccaaaacattttatcaaacacgtgacaggaatggattacattgatataatgacggatatatgtaactgagataatctcttcatgtatggccatagttagagataagatttgtgctatttttttgtttttcttgataagttgttttttcttccttcttttgtgataatttagagagttcacttttggctctttaaaagcacttcacacatactagagtctttacctaataaactagatcttcaaatacattaggtcgaatcattaaaaattactaatcttgtataaggtataaggaagggatccagtttcagctttctacatagggctagccagttttcccagcaccatttattaaatagggaatcctttccccattgcttgtttttctcaggtttgtcaaagatcagatagttgtagatatgcggcgttatttctgagggctctgttctgttccattgatctagatctctgttttggtaccagtaacatgctgttttggttactgtagccttgcagtatagtttgaagtcaggtagtgtgatgcctccagctttgttcttttggcttaggattgacttggtgatgcgggctcttttttggtttcatatgaactttaaagtagttttttccaattctgtgaagaaaggcattggtagcttgatggggatggcattgaatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagctcactcatgatttggctgtttgtggttggtgtataagaatgcttgtgatttttgtacattgattttgtatcctgagactttgctgaagttgcttatcagcttaaggagattttgggctgagacagtggggttttctagatatacaatcatgtcatctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctgttattattttgagatatgtcccatcaatacctaatttattgagagtttttagcatgaagggttgctgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaagttctcttttttggttgtgtctctgcctggctttggtatcagaatgatgctggcctcataaaatgagttagggaggattccctctttttctattgattggaatagtttcagaaggaatggtaccagttcctccttgtacctctggtagaattcgactgtgaatccatctggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgtatctatttgattcttctctcttttttagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaattactaatctttaactcatttgacacataagaatgacaatttcatatattttatttcccacctttcattttatttttagtctccatttaatgataactaaattttaaatattttaagaattttaatcaagcgcttctcaagatatgattaacttctataattttattatgtatgtatatgtgttaaatatgtaattattatttgcacatattttacctattccaatgtctcttactgccttcaacattcatttctgtttcttttacacaacaccagcctcaatttgttagtgtttttttgttcgtatatcactgattttgagtttatctctgatcacttgtagaacgggatttagtttttttttaatgttttaaaatattggccaggctcggtggctcacgcctgtaatcccagcactttgggaggccgaggggggtggatcacgaggtcaggagctcaagaccatcctgaccaacatggtgaaaccctgtctctactaaaatataaaaattagctgggtgtggtggtgggcgcctgtaatcccagctactcaggaggctgaggcaggagaatcgcttgaacccgggaagtggaggttgcagtgagctgagatagcaccactgctctgcagcctgggtgacagagcaagacttcctctcaaaaaataaaataaaaataaaatattatttatttatttgtaattgataaatattgtatatatttattgtggacaacacgatgttttgaaatatgcatacatttttgaatggccaatggagccagttatcatatgcgtcacctcacatacataccatctttttgtgatgagaacacttgaaatctattttttttagtaattttaaagaatatattgatattaactgtagtcatgatgttgcacaatagatctcttgagcttgttcctcctatctatctgaaaatttgtatcctttaagcaacatatcttcaaccctgcccagtcaccctctggtaaccaccattctactatctacttctatgagttcaactttagtagaacatgaatttgaatggcttcactcctaacgctgtacacatctgattatgagggtcttttcatttcctatgggtgtgattgaaagcctgaatgtatgtaaatttgggggtcataacgttttcttgcaatgtactatagacatgcatgcaaatccatactggggcaagtaagctatggagtgtctgtgtgataggctttagacattaagaagaggaagtgataagtagtagaagaggccagcatgattccttcaaggattatgaaggaagatagtaaaagtcattttttaaacagtttgtctactttagatggtaaggcagctaaagaattttgcaaaactcctctaacttcaaaccttctagaaagggttagaggatctcatgtcatcaaacagacccccaccaacaggagcagatggggctgaatgtagtttctccacttccgtagagttttaagtaaatacagctctaattacaatttgtattggacattgattctaataatccataataatgaattaaggaaagctttagtaaaataaagagaaatgtctctgacaaaaaaaagtttttctaagtaattagatgggaataaaatgtttactgtcatttttcttttgttacagagaaaaaagatctgaagataaatatcttcagctctttttaaaataacctatattttcctctttgatgtttatcaagatacgtgacgatcagcatattttaactataaagaaatgtaacatcatttttgaaatgaaaaagtaaggacaaataattaaagaaaattacttataatcttactaccccgatatttgtttagattgacactttattgtgtatctaatttttaatacatatttcttatttaaaataaaatgcagatcgttcagtacaaactattcataacttgctctttttacatgcaaggaaacattccttaatatccttacatattttaacactctcatttataatggtgcatgtggccttttatcctagtgctgtatttttaaaatcaattataaatggaaattcattggaatgtagttaataattttatttcttctcaaatatcttttcataaaaattgtgccaatttatactctccagtataagagagtgtttgtttcatccacttatcaccaatattatttaagcctttgccaatttggtaggtgaaaaatagtaatgtaattataattccaaattatttagcaattcatttgaattttatcatattttcatacttaatacaaatatgtttctcttatgtagaattcaggattatgttatttgcatatttttattaatgttttcttactgatttgtaagatgtttatgtagcaaggacattcatattttgcattctgtaaatatttggaaattttcttttagagatgttaaacattattcacttttactgtattttggatattttttcctaaatttctgaatcactgatttgattttctgcagtactaaatctgagttgtattgcttgtagcacatattttatttcaaccattgcagtctcatttctttttactttaatttcactctacatttatttaataaatgaaatgtgctcttttctgtccctgaacatgatgtaatgtaactacatatgtttataccatggctcaaatggagagaagaggacccaggtaacaaaggagaaagataaaagatagataaagatacagttgcatattggataaagtcactaatttgcaaaggtcagaagatatttctgtgcagaaaaggaattggccattaggtaggatgaggcacgtgtatacctatgtgttaaattatgtgttaaatatttgtcattttacagatgatcgtagattcctgctaaaatctcacatgacctcagttcctattactcattaatttttctcctgaatataacttcattatcatgacgtcatgataagttcaaaaagcattaggaaaagggggtttagcatttttatttacttcaacattttaaagtatttcccagtatgtgtctttaaaataatctcttatggaatatcaaaagacagagggactgataatagttacggcttgagtcaaccaaactgttcaataggaaatagcatcagtatattttctgaaaatcctgccttttgcttgaatattatggccattttgttcaaaataaaaatactcagcaaaacccttaagagaaaccttcaaaaggacaagtacatgccaagtaatctatattgtaagtgcaagggcaaagatacttctccatccttatattgaagcggttgaaaatttgctacacattgctagagttctccaaaattgtttagagtttattattattgttgttgctgttattgcagttgtttctgttaagaaaatgtgggtaaagggccgggcgccgtggctcacgcctgtaatcccagcactttgggaggccaagatgggcggattccgaggtcaggagatcgagaccatcctggataacacagtgaaaccccgtctctactaaaaaaatacaaaaaattagccaggcgtggtggcgggcgcctgtagtcccagctactcgggagtctgaggcaggagaatggtgtgaacccaggagacggagcttgcagtgagctgagatcgcaccgctgcactccagcctgggcgacagagcgagactccgtctcaaaaaaaaaaaaaaaaaaaaaaaaaaagtgtgggtaataagaggaaatatttatgaaatcgggataaatattgcgagtaatgtaacaaacagatagcttatgcccataaaatgctacattttactagctacggaagggtttgagtccactaagaatatacagaaagtacttcttgtacatcctcatttgatactgttgttgctctgatagggaccacatagcaatgtaagcacaccacagttaaagaatggttgaaaatagaacttaaggacaactgtaaatgacgtttggggagctattttctctctgtattttattttatttcatctcattttattttactttaagttctgggatacatgtgctgatcatgcaggtttgttacataggtatacacgtgccatggtggtttgctgcatctatcaacccatcatctaggttttaagccccgcatgcattaggtatttgtcctaatgctctcccaccccttggtccccaccacctgacaggccccggtgtgtgatgttcccttccctgtgtccatgtgttctcactgttcaactcccacttatgagtgagaacatacggtgtttggttttctgttcctgtattagtttgctgaggatgatggtttccagcttcatccatgtccctgcaaaggacatgaactcattctttttatggctgcatagtattggggagctattttctatggctgactttgttacccatgtgactgttcattccccctctcccaaattaattataattgctttggcttcatatttaaatgttccatatattgccagttgtctcctgggaagcaaaattgccactctttgagaaatattggtctagataaatagataccatttaatttttttgagacaatagtatgaacttttctatctgtatagacatttgattcagccaaagaataaactagattgttaaatcttatgtttcttatataaggtgttactctcacgttaagagcacccaaactatctaaattcacatatttacatcattttagcccttaagacatagcctgggaggaaaaagtatagcttaagaatggcataagaagatatatatttgttcttttctgaaatttaggaacatcaaatattttgctatgagacctgtcttctttggaagaaaaattatcagatttgattttgataatctggttctctattggaaaacataaacattcaaatgactaagcttcatatagggctctctagcaatgttttgttttctagtccgcttacacattatgagtataatctttaataatgttgaagatcctttggcttaaaattcaaactacctcttcttatgtttagcttatttttctggcagtaccactgtggtttcagataattttcttttccttttactctctcatttccaagtttcagttattaaattttggcatttgagacccagaatcctggtagtaagacttttgtttaatttttttctcccaaaaattacatttgattttaattatgtcacatgcacagagagcgctccttatccatgtgttctacatccatgtattaaccgactgtagattgaaaatattcagaaaaaaataataagtagttatataccaataaaaatattataaataaaacaatataacacagcatgtgttatactgcacagtatttacattctattaggtgttataagtaatttagagatgatttaaaagtatatgggaatatgtgcatagattatatacaaatactacaacattttatttaagaaatttgagaatcctcagaatttggtatccgtggggggggtcctggaaccaatcccctgtggatactgagagatgattgtgtgtctgtgtgtatgtgtgtgtgtgtgtgtgtgtgtgtgtgtgtgtatgacatgttgcttgttggctttattagctactatcaagtttttatactgcagcattttttaattcatgattttgataactccctcacttacttagagtgctttttgaaagattttgttcaagaaaaatacatgggtaatatgttttctaggattctctaaattggaagatatattccacttctgtaatttcttggctgaaaattcaattattgaatcacaaccattctttgaaaaaaatctgtgggcactgcctcaacgttatttgacttttaatgttgcaaaggaaaatgacaatttggatttttattcttttgagtgcaacttgtttttgctgcctagaagtatattatacttttttctttgcctttgtcgtttaaatctgtggccagaatatgttcatttttggttgtatttcataaatattgccttaataaagatgatctctattttacattatatattcctctgcatacccccaatatatctatatcaatttatgaatcaattgcatgttttactcttacaatatatctgtaattgatatcaataattaatacatagaaattaataaatatatatacaagtagatgaagttaaaattaatgaaaattgaacttctgatatattcttttatgctgcaagggattaatcaatgcgatgtctaggaaggtgcccatcctcctttgaagactatggtcctggaacaccgaggatccttaaatatgcatgtttgggtgttattacttccctggaaagttttcagaagttgtgtgtttaattctggcgttgattttaactgctcttgttccatcattccagaacctctataattcttaggtgggcttgtttttctgtgcaaacttccatcatcttctctctcttatttcttcttttcctaaaattttaattgtggtaaaatacacaatataccctatttcaccttacttccctcaccctaccccaccttcttgcagaaacttattcctttcacaattcattatatttttatatgtatcattctactcaattttctctgtgtattgtgcttatatatgtttgcataaattatactctatattgttttctgtgcttcgtaattgtgacttaatcatatatctaggaaattgtttatgagtgtatatttaaatatgacatcatttaaagtaatccttgaaaatattttaatacttcttttagttttataaatagatgtgagtggttaaaaattcatcagtgtagaatggtataacataagaagaagccatcaaatgcttccacttccatctggcaccaccatttttatttccaggaataaacacatttgagacttgcctatccacttttaacataaagtatctacgcatatacagacatatgtctattaagtaactggcttcttttttttacataaatcatatcaatgtgtctctgcacatatagatttctttatttccctttatttgctgcatagtattccatacgatggatatattttccacttaatcacgaaattaaccattcattttgttatgggtggttggctcatatacaaattttgttattaagatgcatgatatggtgcttattcatttacacctatttttgcatattggtaggaatttagcagtggaataaatttctagtagccaagttccttgggcaaaaggtatgtgcagtttgtttctagatatttccaaattattcccccaatttttacactatttgatgcagcataaatttgcttctttgctctttaagtgcaagttttaatttttccattttatttttctttctggattttttctcatttcttggcatctcaaaatgttctccttttgtgagacctaggtcttctcttacatcctatttgggtaagcaagtagtcttgaaataatttccataattcttttttttctctaaggtttgggatcagagtcacagtttatggttttgaagtagttttttaattgcgtacatgcatgtgtgaatttttcttttgactatttctggaatatacaccttagtttagttctcactaaagataacttgtttgtcttgttcttggctttgtatactctccacttgtgtagaattgtaaaagaatgttatacacacacacacatagacacaaagctcaatctcatattacattagctcagaagtcaaagtcctttaagaaatgggtgaaatggtggtaaacaatttatttttcatccatacttaggaaatgctcattccccatactacaggttgaaaaagaacttcaaatttctcttttaaacatcccatataatagaattgaaccttaatagtaagataattattaatgtgcatatgagtaagtttattatttaatatccttaaattagcacctgcatttcaaggtacagaatttgggttaggttccagtttgatcatttatttaagaacatgttgagcttatagaaggaaagtgagccttttttctctctcagaagacaggcaacaacattaaaggtctgaaaaaaatgctttttgcataaaatagtttacttaattgaacagttttttgctccccttaattcagttcttttacctagtagagaaaataaaccttaggaattaagttatagtctctaaggacagcttcaaaacttcacaactcattgaactggcataatatcagagagacttgcacttgattttattttaaatcctctagttctttgcctataagattggcattgatttcagcgtagctttcaaatgggcccaggttgcaatatctgtctatcagggatacaagtactaatgtgataaaaataataaagcaatctgtgcgctcttagtgattgtgtccttatgagatttcattttcctttataccatgaaattatttagtaaagccatctatcataaagagtgctgttagaaatacaattttctcgtgacgaatgatgtaaaagtaacctttttcaggacaatttattgattaatttgataaacatgtattttgtgccttttattcttggggcaccatattaggcatgtactaaaaaatactcacgaagcccttttaattctttgaaatgggttagatggtggggctgcataatggcaccaatattaaatagacattaagttaattaaggtgcgttaccttagttttcaaacatatatacacataggtccccaatttagagcaaaacagaaattttacaattagacttctaatgaaacttgcaatttttgttagaataagccaatctttagcatttataattgccaaattatgtttctctgcttttctgaggaaatacatggttatgctttgttttctgaagcataaatggatgtttttacttattagtcacttgtgagcagaaggtattactctcgttccttttatttcctcttcttccaattagctgacagatcaagaattcgaaagatgagaatgccttgaggtattcagatgtcatctacaacagggaagaagggtgactgtgagagtgccaaactttgctgctggaaggcagtgttatttcttgaccaactcatgtgcattctaatagtcagtgattttgcttccttatgtggctttgcaaaatgatcgtcctctgccaactctcccccctcctcttgttgttgcttttggtttcagtctgtatgacacaggagcgattttaaagcctttcatggccagtattgtatataaagaacttagtggttgcaatgtatcaattaagcaaacccaaaagttatctttatacagctgtagatattgaatgctaaaacactgttttatcaaatatttggttctaatatcatcatctaaattttaatgtaaacgtctacattaaacttttactggaacagttacagctgatttgaggtctactcctctagattagtgacattttctattaagcatgatttattttttctttacctgtaatcatttaggcaccacaaaggaaaccattgttattatagtctagagactagagcttgttggaagctttctgaatgtttttccacaagaggtggccaactcaattaggactggttcaatttttgtcaggtttagtttggttgcaaattccaccttttggtttgtaaattgattgctgctgtgatataacacaatgaccaatgggcaaaagctaggccaaaacagtgaccaaacagttgagcttgtggaactggtctcctttgcccagttacatgaacactgcaatagtttctaacttctgccactcaaaatatgtgaagcttctctaccaaagacaaggctccctttgcaaagatcacttggtagctccatcctgctggagttggtgtaaccgttcatgatttaagtcatataaaataggcactgaagctttatatactattggccacaatcagtttcataagtcttatattactctttcagcctcataaatgttcaatctcaaatctagtatttagatttatatataacttcctttccttctttacccttatatctacatactgttctaaatcagaactctttaatttagtccccttggccaatgagaaagttaagccattaaaaaaaaattctactttcaatacataacaaattttcttcttattctttaaattaaagatctccccctaaccctttacctttaaatcttttgtctttctaggctcactactttggtgatttacctattcccatgaccttactcatcattacaagcacttgacatttaaatacctagatcaaaccattcctgagttgcacatcccaacttctaacttccttatgaacatcactagttgcctgactatatattgacatgcacaattgagagtgttacagtgcaggcatgcacagcctaacaagcaagatacactcactgaatgaatgttaaagtggaaaaagtcttccaccttaaagattattttaaataatccctaaggggtgtaaaaatcatctttacttacattttaatttgtaaagaggagaaaaatattgatgaagcagttagaaatcttgtgcctgagagagagcgtccctcacttttggtccctgtagtgtgtctcttttcagttacagtaagtggcttcccacattcttttctcataagggcagtgcggccagatggcatgctacttacttattgagaaacaaaagagaatttcttccttacaaatgttatctaaaatgtagttttgaaagtctcttaggtaaagatctcctttataaaatgtaatatataattataagctggtggacttctttttgatctctaagattattttgggtatacttagattactgacaacccttagtcaagagccattagttccgtagccattagttaattattactgtatataattattagttagctaatgaagtgtaggttattattaatttggggggctgagatacaaagtaacatcaggtataaggagtttatggaagttcaaaaatgcaaattgtgagttatttcatactcatgacttatcatatggaagttctggtcccgccacttccagactctatgatctcaggcaggcaaataatttatgtccctcagcctctttaacccaagcgcaaagtggaataataagattggcctcacaaaactactttgaggaaaacattagaaaatacatttgtaagatgattctataataaccaagggaaattgttaataaatcacagtattcccataaaataacatgagttaagcattgtgtagaaggaaaataaatttcaaatatataataaatatggaagcaatgctcaaaattcaattttatgtgaaaaatgcaggaatcaaaattctacagaggttatgcaaatttatgtgtatactcacatatgtgcacatttgtgtgcatgtgtgtgcacatacacatatagagatgggatgagtgcagaggcaataacaaaccaggaacagtggtgggaatacatgttattttctttatatgtttctttagaagtgattagtagtcagacttattaggtgttgtatacactttttagactaatttattgaataaaaacaaaagccatttttaacaatggaacaattggaatttgttgttttctatagtaaaagctgtctatcttatcattcattcagccctcattctttgacatctgtatcaaacccgtatgctgtatggttaagccaactaatggacagtacatccttcaataaggaggaagtctaaaacacatagcttccaacttgctttaaaccagatcttgttggtgtgaagccactgtatagttatttttatttatttattcatttaaaaggatttccaagctggggttttggttacttattaaaacctacagagacaaacatgtgtttgaaattaattgtgttattccagatttttcttataccattacatcatgctctttcccaatctggcttcctgaattttcttcttaaagttacatgatttttagtctcattctcaagagacttggaaatgtaaattgagttattcaggcaaaacactgaatttcaagacattgttagaagccagcttcccattatatagaaagctttttttttttttcagtgtaggcatttttgctcagtttttagaagatttagaatgtaatacttgaatagccaaatactgatttcttaatcctatctattcatgtacattaattcctatgatgatgtttgttaggtttacaatcttggctggtcttggtaaggtagattaaaatattataggttttagactctcacagcagtaatgtccaccgtttttctccctagtgttaattttttttaatactaagaaattgtattcttagatattcgggaatgcaaattttatactgtagcactatatatttcggtctttggatagacaatattttggcttatttttttcaattcatctttagaaacatatatatgtttctaaacatatatgtttctaaacacatatatatatgtttctaaacacatatatatgtttctaaacacacatatatatgtttctaaacacatatatatgtttctaaacacatatatatgtttctaaacacatatatatgtttctaaacacatatatatgtttagaaacatatatatataaagataaagttttgctcttgttgcccaggctggagtgcaatggtgcaacctcggctcactgcaacctccacctcccgggttcaagtgattctcctgcctcagcctcccgagcagctgggattgcaggcaactgccatcacacccagctaattttttgtatttgtagtacagatggggtttcaccatgttggccaggctagtctcaaactcctgacctcaggtgatccacctatcttggcttccctaagtgctgggattacaggcgtgagccactgcgcccagccaaaacttttacatctttatgttgacataaaattctaaactatgtaagcaagcttcactttttttataaggatttagaaatgaacaaaatgggtacacaaagaacagattctttatttaacaaacattaattcattgaacaaatattgaagtgtatactttgtatcagttatcatgtcaatcatactagaagaaataagttccaattgtgtcaattggatgttctaactgttcttaacttctatgattcataagtttataactccctaataaatctttacatataattacgttggagtatcacaataatgaataataccattttgcttatataagctttgtgaatgtgaaacaaaaagcaacaacagcattgaagttagaaactcttgaaataattttctacaaaaatttatcctttttaaaaaaactaactttttaagctaagcagagttcggcctggttagtacttggatgtgagaccacctgggaatactgcgtgctataggctttaataaaacagaaagaaaaccctaacttaaaatatatatgtaagttcttaaaaagcatatcttgccataatttatgaaaacccttatatatataatttttattgtttttcagccacataataccagtctaaaaaagcacatgtagaatatttatatgtagtatatatatacattcaactaccttgcatatccagtctcatgaaaaacaaatcaaaagggaaagagaagtatagaattttcagtgtagttaagccacactgctttccctgattttgaaaaatcacttaagacataggttttacttgtttccttggccagggtatgatggattacctgtttcacaaccatctcagtaactaacaactgccaactacagaaccgtattgttctaccaaaggaaaaccatcatgagaagataagatgtttttcccctaccccattgaaacttctaaattacctataaaattgtcataatgtattagtaattggaaaattctgaatgatttttgtttatagtcttaaaatatatggatgaaaaaagaagaaacagttttggcaaaacaagctcagaattcttgatgaagctgttccttggagtcaaagggagtgtgatgccattgccactcaaggttctccttcgtaatctctagcagataatctataaatcccaatgacctataagagcaagacaaggactgcaggtgctcaggcaccatgatatcattagcaataatcaatgcatggctgtgttttctcactaatacatgggtagagtaccaaattattgagcaatactagatctctcttttatcgagctcattagtcttggaagaattcattaatcttttaagcttagaagaaaaatgtaacctaggatttggcagaacgatcaatgagacatacgtgagagagtgtgtgtgttcaagaggaaggtaaggagaattgaaagttttagcattggatttagcataggatttaagtggacccatctgtatttggggatgagggggaggtcatacacggggctgccaacatgggtggagacagaaaacaaataactctgaaaattgtgtgtgtgtgtgtgtgtgtgtgtgtgtgtgtgtgtgtgtatttctgtaacagtttagggttttaatttttttccagaaaccctaatcaacataattaactttctagcctcagatctaattggtcactacatcctgtcatggccaccaccaaattatatcttatttacttccttcttttatgcctactgccggaaacttatttcaaagatacctgtattttcatctgaactgttgtaataacctactgactggcttctctattattttcccgtgttcatcacttatattgacttccttatttaaaagcagtccagatctattcattgcctacccatgaaatccaaactttttggcatgaatttgaaacaataataattattattatcatttattaagaaacttacattgctagacataaaacatgagtatctccaactcccaaactgagctttgaagatagggtattgttatgtcttgctttgcagcagaagaccttgatatacagaaagattaaagatctttccaagttcaaggagctggtgtaagagacggaactaaaattcaaaacatgtgctgtgggtcgggcgcggtggctcacgcctgtaatcccagcactttgggaggctgaggcgggcggatcacaaggtcaggagatcgagaccatcctggctaatacagtgaaaccccgtctccactaaaaatacaaaaaaattagccgggcgtggtggcgggtgcctgtagtcccagctacttgggaggctgaggcgggagaatggcgtgaacctaggaggcggagcttggagtgagccgagatcgtgccactgccctccagcctgagcaacagagcaagactctgtctcaaaaaacaaaacaacaacatcaacaacaaaaaaacaaaaacatgtgctgtgactgcagagttcgggcattttccattacacctggttctgtttaaacctgacccatttcacctttatagattcagcaactaccagtctcaccttctcgtacatcttatacatatttagctttacccacccgccatgatttaaatctctcatactttttcccatcctcatcctgttggtcatgcccttcctgctgttgtttccttgatctttagtaattttcatttagataacatctactaatctctccaggttctgtgcaaatgtctcttcttctctgaagtctcttttaacctattgagttttccccttacccatgcaatatttccagagcatgtgatacatacttctattgctgcaccaatctcatttttgtagttatttatttgtgtatccataagtcaccatgactgcttgaaaacagagcacttttcttcttactttgttgtttatgacacagtgattgtcccatcaaacatgctcatacatattgaatgagtgaattctctacccatctcaaaccaatgcgttatggcaatggcacacaccattagtttttgtaagtaacttttgaaagttaagccaaaagtatcttcatgttaattaatagtgcaattttgcacgtgttggaatagttgagaattggttattcttaagatttatttcctgcccaaacaccacagctccatatttcacgattttccaatataacttatcatcttggctgtaaagaataccttaattttggccttaggtaggatagatatgtttgattggactttctctgactgattaggttaatttgtcagctggactcacggttcttctttagttttcttctattctacacttatgataactctgtgtttggatatttctttgtttattacagatattaaacttgtaaatttaatgattctctgtaatttttcagagcccatcagcccaggtgtctttccacatactgatgtagtaactgtgagtgcctttaaagctcttgtatctaaaccatagctctgttatggttagcctctgcttcattcatttaaaacctattttgtgtagtcactatttgcaaagtgtttagctaagataaaccacgtactttccctgttcttgagaaattcatagtgtatcctttggtttatgatctagcctaggactcaattagaacattaattttgaaaagttaaaggagacctctttggagattatgcgtttgttttagttgtgctattagtgagtttaatcatataattttgctcaaacaaatttcttaagggtctactacgggcctgcagagggggaccaagggctcagaataaattgatgtagtggttacagatgctggcactggattaaacctggatgtgactcctggcttcccccatacttgctgtgtgatgccctgcaagttacagtaactatctgagttttctctttgacatatgaaaaatgtaaataatagtatttcccatataggtatttggtgacaattaaatgagataattaaaataagcataggacattatatgacctttgctaaacgtccaatttttgttgtttaattattgagttttcaataaatatttgccaaataaaaaacttaaggaaaataaacactgaagttattgtcatgactttcatgtatatctccattcttgaagttttgacagagttataaaaattgaactccgagttttggctcaagaaacctctgttaatctgatatgcataaatcttgaattaaggtttcctttactactgttactattcctactgataatatctttttatagcatttatattttaatgtatatttcccattacctcctaaaatccttagagcaatccctgtgagggctggtattattttcctttatagatgaatagactaacatgtgcagggattaagagtcttgatctacgccatttggctcataaatggccagctcagtcctggaactcccaggtgtcctactcctgtacttcttgcctctcttccctaaattttggttagttgaaaagtggacaattatcatcttctggaatcttctgtatgtaatgtaatatagttacagtgtgtttatatagagtggaatataaggagatggagattactggcctaaggatatgtatagatataaatggaatgtgcacacacattttaaatgcatgctaagtggaacatggaagtttttcatattgactcaaagtgtggtttatttgaagacattcaattataaatgtcaagtcaacttgcattcaagtaaattattatgtccctactcctaaaatttttaatacaaagtcatctggccaatgcttatctcttcagactcataccccgtcatttgttctttttttcagaatcaccatatgattcagctgtatagaagtattgtggtgaatacttgtttcatacttctgtcttattatattccctctatcagtgtactccctgccccttctgcaactcttgtttatcctgggaaatgctggatgatctttgaagatagcaaatgcttgccccctctgtgataccatctttcaactctgtagattgaacattttctggcacttatagcactttaactgtcctatcacattaaacaatgttgatctaagtcaatctgggattccttagctctagtacaaaacctggtacaaatgtggaaacaattaatatttgaattgggctaaaaaactaggatacatgtttctttgggaatttgctgaaggaaaattagaagtaaaaaaattgagcaactttctaactgttttctttcaactccaagtgttcattcaatctgcacatgttcctgaacacctatgaagtctcttctcctaaccagggatccagcagtaaatagaacatataacaatcctaccctcatggaaaatgttttctaatgtaaagagatatacagtaagtaagataaatatatgaaatatcttacatggtgataaatgttttagagaaagataaagcaggaaggtagaatatacaatactgagaggaacttgcagttttaaataggatgggcaaggaagactctgctgaataggtgatatttgagaaagaggggaaggagataaaggattgaggtattaggatgtctcagggaagagcatcccaaatgtaacagcaaatgcaaacaacaagagaaatgaacacgtatgtcatgttcaaagaagagctcagaggccagagtggctggagcacagtaaagaatggaggagaaaaagaagacaagttcataaaaatccataaaaatcatgtaatgtcttgtaagttaaaagattgatagttaatatgagtaaaatgggatgtgaatggaaggttttgaaaaaggcttaatgtcatctaacttagtattttgaaaggataactctggcttttatattgagaatgaaatgaaagagggttggcacagaagattgaggataggaacaagggaaagaacagggagaccagttatgaatccattgaaatagttcaggccagaaatgatgatgacttggtttatgatggtagcagtagagataatgacaggtggtgggttgtgaatatattttgaagataaagataagagaatttcctaagagagcatatatatgtgaaagagtcaagtatgaatccaagatttttgttttaagcttttgagaggatagagttgccatttactgagatgggaaaaactgcagaaggaacagataagggggaaggtcaggaattcagtttttgacaaattaattttgagatatgtttagtcatcaaagtgaagtttccaaataggcagtttgtcattaaatctggggttcaaggaatcattccaggaaagatgaaatttaatgctatgggcctggattaggttacccaggaagtgagtataaacagaggagagaagagatccaaagactgaatcttggggcatttccacattaagaggcttgggagatgaaaaggaactggttaaagagcctaaaaagagagtgaacagtgaggtgaaaggaagacaaggatagaagtcaagaagaagttagggatcactggcaaacttcttctgtaaagtgccagatagtaaatattttaggcttcataggccaaaaggtctctgttggaagaatacaactctgctcttttagcaggaaaacagctatagatatcaggtaagcaaatgaacatggttatgttctgttacaactttacttaaaaatgaggcagcagacttgatttgatccataggctataatttgctgattcctgttcaagaaaccaaacaaataaactgtttccaggaggaaagaattattgattgtatcaacttctgcttatttgtcaaaggtgaaactgaggaattgaccattagatttaacagcttggtagctgtattagtccattctcacactgttataaagaaatacctgagactgggtaatttacaaagaaaaaaggtttaattggttcacagttctgcaggctgtacaggaagcatagcagcttctgcttctggggaggcctcaggaagcttataatcatggcagaaggcaagggcaaacaaggttgtcttacatggccagagcaggagcaagagagagagtggggaggagccacacacttttaaacaaccagatctcataagaactcactcactatacagtaccaagaggggatggtgctaacccattcatgagaactctgccccatgatccagtcaacttccaccaggcccgacctccaacaccgggggttacaattgaacatgagatttatgtgaggacacagatccaaaccatatcagcagcctttagtgaccttgatgagtagtttcaaaaggtgttgagaggaaaggcaaaattgaaagagggatttgggttaagagagaattaaggagagaaataagaggtaagaacaagtcagcactttgggaggccaaggcaggtggatcacaaggtcaggagttcaaggccagcctggccaacatggtgaaaccctgtctctactaaaaatacaaaaattagctgtgcatggtgatgcgtgcctgtaatcccagctactctggaggctgaggcaggagaattgctcgaaccaggacccggggggtggaggttgcagtgagccgaggtcacgccattgcactccagcctggggctacagagtgagactctgtctcaaaaaagaggtaagagaacaagtgttaaaaagtgaacgcgtttcagtttcacatttgaggggaacaaagaaatggagctgaaactgtaagtgggaaatacggtcaagagaggatgtttttaagatgggaaaataatagcgtagaatacacacaggaatgacccagaagagaggaagaaattggtgatgcaggagagagtggagctaattgctggagccatgtccttgagtaggtgagagggaatgagatctagagcacacagggtggggtccgtcatcggaacaaagactggtgatccacagtgttggtcaccaacgcaggcccatgggaagatatgttgacatgaggctagggagcaactgtttactgattacttcaattttctcagataaatgagaaacaaggtcattgactgagagtggggaaggaggtgttggaggtgtgaggaaaggggagagaataaaatagccattcagactggaggttctcaaacgttgctacatactaaaatgacctcagagagcatttaaaaattccaaaggccagattgtaaccaagacaactttactcagaattttggggtgatgccttgctttagtactttttaaagattccccaatattcaggtaaatttgagattgagtaagattactgagtcatactaggagccaacttgaatctagtgttcatgaattcaaaatgtgactagtcagattatgtgttttcctccagaagtttccatagcatgagagtgaacagtgaatgagtggagagttggtggtaaccggggtttaagatttatcaagtgggcaccagatttgagagggagcagagcaatttaaagatgtattcaaaaaagtgtttacaatacactgtagagtttatgcttgataaaaagagaagtgatgccacgaagggcataaggaatagtgaaaagccagtagaatgaatgcattggagggcctggtaatatcaaagtgttgttggaatggggtactagatggaatcatctggagacttagaaggtggaggtcagaaagtgtgatgtttataactgagtttctaacaacatctatcgtatgaccacagaaccaagtggccaaggcagggtggaggacaaggtctctggagtcaaaaagttcagtgaattactagggcaagatggtgagagaattgttttcaacagacatttaaagtaccagaagttatgacaagcatcatatgttggagagggtaacagttaggcaggagctaaaatcttcaggtagtgagggaatgataccacccatacttagatagctcctcattttcctactttcacagatactgattccatctttagacattttgaacaatgcaacaatgttaattttcttatactttgttcaatatactttcatgtgtagtcaggtactagcgttttcctttttgccccgttttattctggttattagtaattcactagtttctaaagctaattgtatcatcattgctttttacacttgaaatatccagtcactatttgtgcagagccaattcaatttttcttcttgaaagaatataactcttagctacaagaatggtccagcaatggtaatagaattattctccatggagaatacctttttgcttctctagctctcccttttaacattagccttaatctgatagcaaaatcagcagtcctaaaacaaaaggaaaaataatgatgtttctgaaaagagagagtcagaagaattaccagcacactgaatatgtatttcagtctcttgtgtaacaagtttgttgttgtgatggttgttttttgttttccctttggcaatggcaatgtattctggggaaaaaatgcagtatgttgattttttaaaaagcctattaaaaatttccaaagataaaaatgcctgaagcccttaatctaccacatgaaattgtaaatgatccccagtggtggagttctctgtgatgcaagttcatcatagttgactgatggatattttcagatcattcctgaagttgtagtgcatttgaacaatgagtattgtaggtatagtgtagaaatgttcatctttctatgactgagatggcagagccttttagctaagactcagtgtgatttattacctctatctacatcaatcaccaaacatgcaaatcatcttgactctcaggagagccatgactcattcactgatatagaatgtttctccgtcacttggctggagctctcttctctcacctccagtgttttacacagtctgtttcacaaatgtgaacaaactgatttctctgccatcccagttttctcatctcttcaaattgatggttttttccagcacatctttactgattaagctagatcatattcccactccattaaatcttactgaccattcttacctgctcatatttatatatcaagtcaaacgtctgttaacgtgtgaagtttattataatcagtctgtgttctctgtttaaattatcctacctcatttttatattaatttcttacataattcttttgtcaaacatgtataacttggagttgaaatagccttgtgtaaatcttgaatcttactccccgcaccttctgccacattgtccatttatgatgcttgtaattagtttgtagatttgactttttaagtgaaatattccagagcaagagttttctgtcaagagggagtttgcagttaggttgaggacaaatgcatatatgggtcacctggctaatttttttttattttgtacagcatatacattccttatttctagcctacttccacaaacaagtctgttaaggctcaagggtcaagtatctcaaatctgataaaatattatgcttaggtcagacacggttgctcacacctgtaatcccagcactttgggaggtcaaagcaggaggatctcttgagcgcaagagtttgagtccagtctgggcaacatagcaagatcatgtctctactaaaaattaaaaaaaattagttgggcatggtggtgcatgcctgtagtcccagctactcaggagactgaggcaggaggatcacttgagcctgggagattgagagtgccgtgaactatggttgtgccactgcactccagcctgagggacagagtgagaccctgtctcaaaaaaaaaaaaaaaaaaaaaaaaaaaaaaaaaaaaaaggaaagaaagaaagaaaagaaaaaaattctgcttagtcccatgctgtaggtagaatgactctggcttttaatggcctgccttgataagaggtcaggtgcactttctcacacatcatgccatgtccctcaaaggaggactccttattaacattgatactaaataactgataagctaatcatggagtttaacttaatacacctgaaaacgatcctaaaatgatctaaaaatctcctgggtttttttcttttcacagagaaggaaattgaaacagtcctctttcaggacccctgaaccaatattttttctattatgccatactacctctaaaataattgtttgctaatagccagctatatgcaaagaaatatattaaggcattaaaaatgtttgaagatatgatttattcctcaaggcccttaacatccctttggcaagataatgcaaactacctgtgcctctcttacacttcttagcaagatatctgtattttgtgatggtctatattgtgttttcttctcttctcctcccagccttgtcttcctgtttaccatctgaatgtggtaaaaatgcagatctacctttcttcccaatgctgaaatagggcctggctcatagttggcattcacggcagttaggagaaggactgaagagaagcctgcactttctcgtttttgtacatgctctgcacaaatcctgaagtatcctaactcaacccctaattatccccagctctttaagccctacttatctccctttaacctttgcctgcctcactgttcataccccctctcccatcgctgcttttgggtttgcatctacctcctgtccctgttttatcctattgtatttatgcatatgagtattaaaatcttaaaatataccagtaccttaaataagaactgagggataaagcagatatccctccaatttgagggtactttttttctattttattctccagaactgatcagtgccacaaaatatgatgagagagcaaggtgtctgttttctctttcagtttcattgttctaaagacaacactttcagtgtaggtgctgtgtatccattgcctgtttgaatttacagttgttttccagtggtgctgcctaactctttgctaatatctatatttgacattaggtcatctgggcagcttgctgtaatcatctgtgagaaagctcctctggaacccaccaatgggcactagaatcaaaactttggttcagtcttataatttcctcatttataatgtggggataattatagtaccttccttgtggagttcttgtgaggattaactgagtcattgaatgtaaagcacttagaatacgggaagcactcagtaaatattgttcatatggcgctcttcagtagccaaaatataacaccacactatttgcatttagtacctttctgttgtggaagcttctattcaaacaagggtatgtatttcatttatttttaacgttttgcttttgagaaagcttgagatatatttcatagttgcctacaggcaaagggagacaccaataaattgaattctgcatcctggatcataaggtaagtgccgaatctgaccacaggatcagtgcttctgccactaaacccgagtatcatcaaccttactggttctttgcttagatactcttgtccaaagttcttaaacgtatcagcaataccatcatgcatctttcttttattattatttttatttaaataaaaagcctacagcacccggtattcccaggcactctcccattcaagtactaaccaggcccaaccctgcttagcttctgagatcagatgagaccagccatgttcagagtggtatggccatagactcatgaatcattcttaactagagagcaatacattttagctaggaaaactcctgcattcaactataatttcatataatgtaaatatgttttaactatattaaataacttctccaaatatgaaacacacatatatatcatttggtctagatggatccttgactgtaatttactttgctgaagtgtccatctctctatccacatttggattatttaaattacttggagagccaaggtggctcccagactaaaatttccccaattgtccttccactgctacttgttcatgtaggaaatttctccatcctgtacacagacatcagagtactctactccaaagaggccctaggatttttatctcttcccctttcccagtccttctgacaactctccctccactgtttaaagcagtattaaaattatccaaatgttcatcattgcctctttctactttcaatattcctctagcagtgccactaatctaaagcatatgctgatttctcttccctcatgaattatgatttataatggattagcatgagcctaggaacaatgtacttcctcttgtcccagacatgtttagagctttccaatttacgctaacattggagtttgtcatgggggcatttttgcccatctatttttattatattttagtcaatactgtgttatatttccatatcatattattctgatataaacaaaaatcacaaggtaaaatacaagtattcattattttcttagtatttatcttatccactgagtagctttgactatacttaaaaaaattctcagcttatttaatagattaaaaattataatctgtaatgaattaattggaaataaccaattaatatagtgagggaatgaaagtatgtcacaaaaatctttctgaaaatgtttcaacgacataagtacaaacaactctgagaagtacaaacaactacagagaaggcataacaaatatgtcatgattgtcaatattttaaattcaccacttcaggtaggacaaaggatgttaaaatatttttctttgaatatttaatatcactaataggaccaaaaacattggaatagcatgtgtgtgacataagctcaaagttctagagcagtgctattcaatagaattttctgcagtaatggaaattttcaatatctgcactttccaatatggaagcaactagctacatgtggccattgagcaccagaaatgtggttagtgtaactgacctgatgctgaattttaaattgtctataaattttattttaattaaattataaatttaatgataaatagctacatggggctatttgtctgcaatattggatgaacagtaaaactttagagacttccaggcttctgttaagactgtaattcacacaaggctgggtcatcttgtggtcactattaggccagtgtcacactacaaagcaacacaaatcctacattaaaacaaccacataaaacgacctataagaaactaccacatcacactgaaaaataattttgatatttactgttttgcaagcgtgtcaaaatatttaaggatccttttcacacatctttctccttgaaaacctctcactatgcttcttcagtgctttcttcttgtttctcctccaaatattttccccaaacttacctatatatctcaggcatccttcctttctctcatcctcatctcttctctacaccttttaagatctgtctctttatccattatccccacacatcaacaggtccctgaccatgcacactaaacacaaaatcctcatccccagagaagagacttgctatccgtcacaagaataaatatttgtaaaggctaaattgggggctatatattagaatcatttctagatgtcacccttttttcatcctctaggcaagattatttctaatacgaatttcatgaggcctctagagtttaagaaaaaagctaatgcttattgaatgctttgagtagtaggagcacctcaaggcaataagaacatctcaaggtctcttccacctctttgatctgatgaaaaattgaataataaatataaactgggtatgatacaaaccaatgagcaaatcactttttatgtaaaagtaattaacaggggaaaagatttaaaaaggatgcccttcatcttccctagattgggagcttatcctttagactttaggttttgttcatttgggatacagtcaacaaatatttgttgagccttgactgagtgttaggcagttttaaaattattttatttgtattggtaataaaaacatggtggtccttgcccatatagagcttacaaatgttaaaggaggcagagagaaaacaagaaaatctataacctaaatataaaattatcaattgtgatcactgtaattaagaaattgatggggttgaataatagaatagcaggatgggaatgccatactaacgcatggccattagaaactaagtgatcctacataacacatgtgcacagagatgttctttatggtttcatagatttgatgttagtgtaacccatccttttacatgttatatgttgccatccttaaatggtctttggtaaaccacatctgaatttttgattagcaaatgtgaaataaagacttcagcttattccgtgtaggtgctgaataccaattaacaattcagtatgaataacatttccatctttacctaacgagcacattttttttttttttttttttgagacggagtctcgctctgtcgcccaggctggagtgcattggcgcgatctcggctcactacaagctccgcctcccgggttcacgccattctcctgcctcagcctcccgagtagctgggactacaggcgcccgccacctcgcccggctaattttttgtatttttagtagagacggggtttcactgtgttagccaggatggtctcgatctcctgaccttgtgatccgcctgcctcggcctcccagagtgctgggattacaggcgtgagccaccgcgcccggcccctaacgagcacattttttaaaaggttgtccattttatgaaaatgagtagaaatcgaaaaatgcagtgctgataatgctaagaaggatagactcatggagattattatgcatattgtattagcatcaggtggctgtaaatgcattagatataagctggtagatggtgggctacatgaggaagaaaaataaaatcaaagaagacataaaacttgctgacactacaacaacctcaaagttgtgcctaaaagatgagatttaatcgagtatttttaaaaactagatgctagatcttatggaatagaaacttgtttcctatcatgtaagtctattaaaatttttcccattaagaatttatttaaaaattcgtaactgcattatgtagaaattacatggaatatgtcttatactttgtcttttccccaaaagtgttatttcttcccattttatacctaatagagtagaggttaagtaaatggaggaacataatagaactagaaagttgcatagataggattaaaatgtagaatgttttggcttcaaagtctctgttctttctagttcatgacttctttataaaaatatatttatcagtgtttttggttggatcatcacaaaagtgggttcttccttcacttgtgtagacagaaataaagagtgaaattataacatacaagggagtaatttgaaacatgctcatttttcttgctgttgtcgaaaatgagtattttatattgttttctttttaaaacacaatttgctcccctgcacagaaaaatatacccgtttttctttagaaatttactaaatttttaatttgctaatcccaagggaaggattattttcttaggattaagtatagtcaattggtattatgatgttgggaagtaaagtgcagaattctattaaggacttagtgatttggatttgtcaaagaagagccactccgtgatgtaatttgcatggtcatatatatatgcaaagttctgtttcagcttggagactttatctttgaattttcactgagaagatattggcttattcctattttagaatctgtttagccatgactctggacacacatgtatagaaagagtaactcctttgtacatgtgcttttgaaatattgcctatgatcggtgcctccttagggaaagtgagttttttgttaagagtctgaaagtctatttaggaaagttgttttcaaagagtgtcctgaaggttacttggtctgacttaacagcaaagtcaatttaacagtagtctgccttgcagaatcctggatctatcagagattgagttctccatgctgtgtgggaaaattatactggctgattttgggagaagttactgtgggaacacattttggcacatttctgctgaagccagaaacctgaatgctttgttctttgtgaggtatcaaaaataaaaattcctgaaattctgacatcctgcctgctcccttatctgggttaaatgctgtggtaaacttctcttttggttgaaatatttaaaaaggaaagcaatacatatgaacagacacatatttatacacacacacacacatacacacacacacttgcatttctttacttgaactatcttgttgaatcctaattactaaactcacatactgcttcttcccagggaatatagaatattactgttatcaagatacgccacacctatcctcattggcgacctaccccctcaattctccttgctggtttattggattaaaatagagaagcagaaatcttatgtaggaggaatatgttgacaaatggtgggttttgtcttgataatttcaccaaatatgtgaattgactttgtcagtcattaaagtaagtgtgctgaatgccctctgtgtgtgtatcaggataagtggtctaatcaagttcaaatgttctgtgtctatttggctcagcttaattaaaattcagccctgcttttgagcaagccacagtgggttggcagaccttcaaagggctatattgcagcaaacaataaaagtgataaaggcacacaatagcaatcaatacaatgcaaatgcccctgttactcaaaaatccagtggaaagtgattgcttgaaacatgcttatccacttctcatcataaaattaaagtttttgcatcactttatttgtaagtttgcctacactctccttgtcaatgggcttgctttttttttaactacgaatggagtgaaagaaaatgatagtaagataaatcagctcaatacaaatcaaatactgtttaaatttttacagcttttgttttatttgttacacatatgggtgaaaacttactcaaaggatttttacctgtatgaggaagacagccgtaattcatcctccattcatttgtagtggaggtggtatattcttggtgatcatcctttttttttcttccagtccactgtttttggctggctgccatggtcccagattttctcacaaactgccatctggcattcttgctgtccctcacatatagctttgtcaggacctcctccaagcaggctggagaatttcacagcttgggggcatgggagtatacacgaagttgcagccacttcagggttgatttctcacctacaacccacatatctgtcactgctagatgtttagtggaaagagctgctagggcactggagattaggggacctggaaagaagtacccactcacctctgatgagctgtatttttagtcactctgtatttgaagaatagagatttttaaaacctgatctctgtattttacataatcatcgtggaacatcactgtgggtaaattattatgaaagatacttctagaaattcaagatggagatattgatattacaatatctcttatagcacacatgattgttgtatcatctcaaagttttcaatgaatgcttttatctgtaagcattcattgtaagactgaatctgtatatataattccacaatgtaactaaaatataagagaaggaaagtttcacatctcatccaagttaggtacatgaggccaccaattgcagaactctagaagtatttttgttacagtttttcaacccagtgaaacactatctcttctgtgtgtatgctttaagtttcattttggcttctaggctttaatcaagcactgagataattattataaaggtatgcttcaccattgtattaactacatcactgacttcaatagctgaaagagaggcactgggatagcgccatcacaactgttcacaaaattctggccagtggaacagctagtcacaaggccaaggttttgtgaactgtgtctatggctgtatctcagtacatctcttatcttctgcagtggaagccaatgcttctcacttcttttatatttcatccattacctacttattgcccttaaatcatcctaaactttgattgttttgttattctgttaaaaccataaatggcagaaaataaatttgaaaactaattattaacatcagtaacatgctctcttaacatgctgaagaatatcatactttcaagtgagagcagccagatcaagtgttaatttttgttttagatgccatgttaagataatagcttttagaaaagacgtacacctctattgatacactgacgcatatacaaggttcaatgaaattcctactgtagagtattgactgtgacatttatattttgtgtcaaacaattatatagattctgaatgtctacgaagcaaaattgtaaacacaactaacatcacttctttcttagataatttaatcaagatttccctgtgaacataaaatatagaatagttagtggttaatatttttgggaaatttccatcatagtataataaatatttggggaagacaaacctatacttgtaaagaataaaattttcttaaaaagtgtcatgaatatattgctcaaatttattctaatatagtttatgatagaaaaattatttctaggtagttatgttaaatagttacgaaaaatgccaatgaatgtcaggttaaacaagtttgcagtactttcaagacatggagtaatttggtaaattattgtattttaacaacagatgtattttctgatttttttttatgttctgaattttaatgtgcagaacttacactatagtaaccaagcaaaaatctcaaagggtattctttttccaaagccaaaaacaaattaaaaattagatggaccagtggcccccaggtcggcacccctactctccaattgaacagttacttcattcctaagtgcatgtgaccataatctgctttgagcattatattcaaactttatcagtctttgtttcagtctgtccaacttctgagcccaatcctccagccttcctttgagaacatatctagaataagcttaccttgtattacatctcagaagtttcttaaaactaaatcggggatagtatcattggtaagtaagctttcgttgatctggataggagatatctgcctgaaatgtgaattaatctgaaatccttagacatactaaatagttctctatttcagtgaaacagacaagtattcaccgattcttttcagtttgttatctgaagcttaagtttcctacttagttttttcctgttgctcacttttgacctataactaagaatgaggccgaagatatataccatcaggttgccaaaggagaaacaaagtaggtaggttctggggccagccactctgccagtgaccgtctgttgagatctttctatatatagagtcaaccaactgcaaatatatatgagaccaggatgtctccagtatagaatcaaaatgccagatttgagcatcctgtgtggctcacccaacaatgatggtatccatatgttagatggttttattttgtactgctttcatataaactcttcggaggcctttgaatagggatttttttcttctataattttaaatacctcaatgccaatgagatatgaaactcatagctataacttctcctacaattagggacaacaatttaaatttggaaaagtagatgactaaacaaatgtatatgaacatatacatcttcaaatataaatgctttcttaatggaggcttgctcatagaaatcagaaatgtatagtttgtttgctgttgtatcaacctgcatttgactatgattctgttctaaatgtaagtcttgtctcaatttttgaatttgttatggagtcttttaaagagacaggaacatatcaatagaagaaacagattctactgtgtgtatacttgtgtttgtgtatgagagcattcacaaaatattcatacttttaaactaactcccacagaaaaatttaaaactaaaatcacttaaaacatatgattggcaagagcttcaacaacctgagaactctatgcttatcagatgaaagaagaagcagcattatgaaaatgtatctggataccataagataatttcagagtacatcaggtgaaaacagtgagaggggctctttgttcatctgaccttatattttataaaaactcaaccttcgattccatgataaatagaatatcaaaatcccataatgtcagatatgtatctcatctttgatcttctgaaatgttatgtatgtcaagttaaaaaatcttgaactttgatggtaataataacatgcaaatattttgatcaaaactggttactttgcaaagaccgaaatgatattgaagtacttgttttttcaagagtcatatagagacataaatatatttggatagcataaaacttaggaacaaattattgttaatgagagttctgagatagaattttatatttagatttaatacttttaaaataacatttttcaaaatgcaaattgaaatattatatggatgcataccatattatgcacaggtagcgtttatttaacttttgtttcacaattatttattgaatgtctttttttgtgggagatgctatagtaggcactagtaattatgtgaataataaaatagatgcaatccctgacattgtggacttactttcgagtttggtgctataaaacttggttctctttcagtcaaatctaggttgaattattggcttcagtttttactgactgaatccatttgaatttcaataccttatgagaaagctatggcttagatagaatataaaacttggtagtcaataatggaactaggaaataaagccaagcttgcctgactctcaattcaataatttccccgttattctagattagataataaatgtataagtgtgaatttaaaactgcaaagtatgggctgggtgcggtggctcacacctgtaatcctagcactttgggaggccaaggtggtggattacctgaagtcaggagtttgagaccagcctggccaacatggtgaaaccccatctctactaaaactacaaaaattagctgggcatggtggcacatgcctgtaatcccagctacttgggatgctgaggcaggagaattgcttgagcctgggagacggaggttgcagtgagctgagatcatgccactgtactccagcctggctgacagaacgagactctgtctcaaaaaaaaaaaagaaaaaaaaaaaaaaagaagaaaaaaaaaagaaaactgccaagtatggtagaaataacaattggctttataatagctatttaattttatttaatattccttggcaattttatttatataattaaccaatattcattgagtgcctactatttggcaaacatagtttgagatcttggggatattttcaggaacaagaaaataagtcccacttctcagagtactgaagttttagcatgaaaatatagacaataaacaaatacttgagaaaatgtttagtgctaaatgctatggtaaaaagtaaatcagggaaactagatgctcaggaaatctttcccaagtggacctgaatgactaaaagagccaaccatgctaacatgtggggaagaatgtttgagaaagaaggaaaatctagtgcaaagccctgagaatggaatgaggttggtatgatcaaaggtccaagagaaatcaagtgtggctagagcactagcttttaaaatgtgattaccagatcagcaacctcatcatccaagtatttatcagtattctaggcatgttaatttccttgatttgaaaattatgctgtgattcggtaagaccttaacattcagcgaaattgcgagtaaagggtatatggcaggatttcattgtcctattttttgcaattttttgacaaatttgaaaatatttgcaaatgaaaatttaaaaaagaaatgagcaattatacagcaaaaatgaaaggttttaagcagtgcaaccagtggaatactgtgatctagtttgggttttaagaaaaatattattgctatatgatataaaaaatgggttagaagagggaatttaatgcaagcgcaatgaccggtgaaggagctgttgccattgtccagaggagacatgatggtggctggcactggggtggcggcagtagagatgagctgtgaacaagtcgatccaagataatataatttgaagatacaattggcaaggcttactgatggattgattgtgagaaagagttaacagaaatagaaaagtcaaggatgcttaggttttagaccagagccactggcttgatgctagtgatatttatttattgagaaggcaaagattgaagtaggaggttgtcaaataatggcacttgattaatttttacaagtaaattattaaaggaaatctaaacggacaatttgcattatctttgagtatttgtgattattagctggtagtgacgaatttaacttgatgaatgccatattgtctgtaaataaattaactcacttgagtgttctcatatttttcccgattttttagttgaatgcagctttagaacattaaattgtgccatatattaaataaaataattaaacaataccaacaagcactcttaatttgctcttctaaattttatatccttatgtagtttattattttattcaacaaatacttgtggagtggctactttgtaccaggtactcttttcatcactggaaatataacactgaacaaataggctgaaatctctgccctgatagagctttcattctggtacattctagaatgaggcattttaagaaaaaaaaaagtatgatatgtgggtgaaatagacagtttaaacaagaagtaaaatgactattaagccagttaataccaaggatatggaccaaattgaagccaataaggagcattgataatatgagaaaggaagggtttgggtctggagggggttttaacttaaaataaggtcatttggaaagacctctttgattaagagttaagggatggagttacaaagtgctaagaagagaggtcataaaagtgggggaataggcagatataggaagctttgtatgcttatttcaaagacgaccctgtgattgccggaatgactggaaggatggcattgccatttatcgaaatggagaagacagccgaaagagtgggtctggattgtgggcatgtttgggaggtcattttggacctgataaatttgatatgccctttagacttccaagtagagattccagtggctggtaggatctaagagatcatagatcacatgagaggcccatacctctgaatagcaaatgttgtatcaaattaagaagttatatttcagggttttttgtgtttgttgttgttgccaaggaattgatatacaggaataagttcctgataggtttaaatgcagtgaagagtgattttctcaattctcgtgagaatttggatcagaataattttatttcaatgaaaaatctgaaatatcaaatgcagcttaattgcattgacattattaaaagaatgaggacttaagcatatggcaaatttaattaaaatattactcttatagaagagtgatcatagtagaggacttttttctttcttaaagcaaattatatgccttcagcagtacttatttttacaaaatgcagaagactgtatttaagatgatttctagttcatgttattatgtggtgaaataaggaaatgcatgaagctgtgttatgttagtttgggttatcttcgaagcctttgattgggaattgactactaaacactgtaaataatatataagtactaagttctgaatgtgaatgtgatcttacatagtcatcaagccattatgtgtcctttgttttcctatcaaatgtagggggcaataatgtcagctattatatatttattttaaaaaatattttgaaaatgagaacaaggctatagatatacctataaatgtgaatatattttcaattcttcaataaaatatgttttaaaataagaaaacctgttctttttctcatcttcactaatctctttttagcaggaaagattattttttgtttgcaaataacaaggcttaggcattaagtaagcgctagggagaggaacaatagatctaccctagaacagattgaggaatcatacttaaaagacccatatattaacttggaaataagaggtagaagaaaaggaggaaaattaggagaaattactttgctagagattgttttgcattgatcatcaaatgataaaaatgtcttctttgaggttttcatttaggatctctgaactaatattcatattattgctgtagaggtattataaattcccagtcattagcataaggatttagtgacagatctgaggttctccaaaaacacctcaatgccaagcaaatgattctgctattagtcttcttaatgcacctggcaatttcctgtctttctactttgatcttctttctcttctcaggtttgcaacattaagaaaggggtagtggcaaaaagaaagaatgtcaacttagaaggctaactttgggggaaatcagtatagccgaggcatcccccaaaagcttcctttgcgttaatgcaaacttccacacaatatttaccaacttctatgaaccagaaaaggctcattcttaaaaaaaaaaaagacagctttattgagatataatttacatactatataatttacccatgcaaaatttaagatgcagtggattacaggatattcacggtgttgtgcaacctttaccaaaattaattttagaacattttcatcattccaaaaagaaaccccatgcccattagcagacagtcttcattttcctccaaatacaacccctcccttcctcagtcctgggcaactaccagtcgactttctgtctttatggatatgcttagtctggacagttaatataaatgaaatccagtcatatgtgtcctttgtgactggcttctttcatgtaatgtaatgtttttaaggttcacccatgttatggcatctatcggtacttcatttcttttgatttccacacatcgtccattatatggatttagaacattttatttatccactaatcatttgatgatcatttgggtagtttctattttgggctattacgaataatgttgccataaaattttttgtacaagtctttgtatgggcacttcttttgggtatgttcctaggaatggaattcctgggtcatatgataattctatgtttaatcttttgaggtactgccagaatgttttctaaagtggctgcactgttaacattccaaacagcagtgtattagggttctgatttctctgttgatctccaccaacaattgttattttgtgtgtgtgtgtgtgtgtgatacaatacactgaacataaaatgtaccattttacgtgtacaattaagtggccttaagtacattcacaacgttgtgcaaccatcaccattatctagttccagagctttttcacaatctgattgtagccgtcataggatgtgtgatatggtaactcattgtgattatgatttgcatttccctgattgctgataattctgagcatctttttgtgtgattattggccatttgtgtatttttaaagaaatatatattcaaatctgttgccaatttttaaactggcttttaaaattattgaattataatagtgaaaagactcattcttaagttaacaatgaatgtattacatgaaaaactcaaccaccccatggtttcagtttaaatgtattttccagggatcatggacttacccagtgcgcagataggacatctttatgacatcagaacattgatgtcaagtgcctattggttcagggtagtgtggaagaagttgtacaaaagcaggcacttttatacccttctctctgagaacattcatctctaaaaaacatacatgaaaaaactgccaaaaacctgatgcatttgtggtgtaatattaatttattggatatgaacttgttttgttgtaaactaccagagtgctttgaagaggaattttattaaatcatattcttaagaaaagtattaaatcagaaggtgcacatatggatatgcttattagtaagataactctatgttggtgatattcagtgtatagttttccagagctgaagtgagttttctgtttccacagtttaaatgaaatgtgtttcaaaatgacacttaggatatctgatggagatgttgtcccctgtcatgtttatcatttaatcttatatggcctcaaaaagagaaaatcatctttttggcatactggcatacttaatttatgcagcatactatataaatcctaaagggaggactgagccaagccagagaatggaataacctactttatttgcaaatggataaccatagacatgtccagttattattaagataaacaggaaatgatgacaaaaccaagatcttggctatgttaacaaatttcagtttctcagtctatttctgaaaatgttgagttccttccaagatcccatgttccccccacccccacaaccagatttattccaggcaatagtaaatacacctggtattcaagggaaaatattcacatattcacttttaaagccagttttgaaggagtctccaagacattgaagggaaccagatggtgtgcagaccattctacaaaggtttatgattagtttggctaaagcagctggtctctgcaatgaaagagttgtcatggcagaaaaatccccttttccctcagtgcagctgggcttgtccagggacgacttttcccaggcaagtgttctctctccattgggtgtttgcaaagtctgttgtacttagagaagttaaaccatttctgttgaaccaagttgacaaaaaacacaaataagccaatgttatttatttattttttttagctcaggatggtttaattgccttaaaaaaaaaagttttcacctctgagtgggccttttctgtccagtattagaaataacaactgagactattcaggaaaaaaaaaatggcactcttccaaaagagaaagtgaacttcaacacaattctcagattcaaaaggactgcaaaggaggattatttctgccagctttggtcatttgacagctacaattctccttcttcaatatgtcatcacaaatctctctcaacatattaatgggaatcctgcatttaattctttcatgtttatggagagggaggtggggtggagagggagactgagagagaactttcaccttctatatgtgataatatgtttaaatgtaattaactgttctgcttttgccgttaaaatgttattttgcattcccatcgtattgattttaaattgaaactcaatgcttttgcaaagacagtcttggggttataaaatgataggttttattgcaaagagaggaatatttatctgaacagatacatgagtgtttccataaagaatgggcctattttactttatcagcaactaaggggaaggttaatggctatgatgtatcttttctgttgtgtgtgaaacatgcagtgttcttgctgttgagatttatggtgtggaggacaaagcaggtgctattccaagccttctttcaacagcggagtataaactagggcctgaacttatctgtcaaaaagtaagttaaaataacgttagagaaagcctagaatttcacacttttccataccttcctgtctctagctcaggaatttaggcagggtgattaatgaccactgttatttgtgagctttccaagtccctacagacataatgaacttgacttttcagccacgtagaaggaaacaggctgttagagctctacaacatgacatgttcataattatgagctctctgcaattgggaagaaagaggaagaaaagagaataatcttctcatgtcccatagtctcaacttcaaacatcctctactccctctctttcttctttccccatcttcttcccgcctacacacacactcacacacacagaatgtatctatacttttattaatccagaaacaaagtctgactctacttaatcttgcctcttatttttccttcatatcaagcaagcaaatcatgcttactgatttctttgtcagaatatcgtatggatttgtccttccctctgttctattcaccctgtcgtcttgtgtttatgctagcccaatccctgagttaatttaggctccaggcactgtatgctttttgaggtaatacaacctcttcattttcctgtgtcttttattttaaccccagcagtttattttcttgcttttcaaaatcttttttattctgaccccacctccaaagattgtatatgctccctctttttgttatcgctaatgtaaatatctcttatccttttgaagttcaacattcatttccatcaagatgtactttaaatgcatcttcttgtataatccttttcagaccagcttcacctggtaaggtccattctgataaactgcttacaatgtttttaccccgtaatactaatcatatcttagactacttacttaaataaaatacaacttcttgcgcataggtatttgttctaaggatagttgctttgttatctatatagtcagtattcaatgccttttcaaatataattcaacaaggcctgttttcaacctcaaagaagtgaatgaagagtcactaactttaaagttccagcaatcccacagcattccccggctcctccagagtacctgtggaaattagattccttgtaagccactggtaattttaagagtctgctgctcttaaggaaagagtctgctgcttgctacaagatagcagaaattagtgtgttggttagttctgatcctgaaaaccttgcctttatcaaagacagaacatttcctgaatctcccgatgatatagtaaagtagtggggagaaattaatctccatcctccgccaatgtttttaccggatactgcatggcatccttcctattatggagtgttattttgactagaaaaaggattaggtggcaccatgggagaaaggcatagtctggttgaagcttatacgaattttcatttacatcctttctttttgtcttgcaaattactattctttttctctctcatttccaccctagaagtcccttagatgctctctttattctccattgctctctgatgctcttttattgaattctatgctccttgaatacaggtcttatgtcttgtttacctttgtattattacagttatctctgtgccttccacacaacaggtaatcaataacaatttgcttaatggaattgagtaattttagaagactagtctatattatagactctgataatttccttttattctacaaaaaagattttctatcccaatttttcttaccagtatcataccactcacaatacagcatgctgctattccatcagcccagagaatgtgtatgaacacagctactcaggtattccttatttttttcttttgaactaatcttaaagacactgattatatctctcttatgaagagcaattatacaattttgtggtagttctctttttacaagtttatcttcttagagaagtataactcttttttttttttttccaaaaaggagactatttctcagtatcctggggacatagcatgatgtgtgataaatagttattgctcttttttttttttcagagtgtgatcttcaggtgatcttttcatgctttttccatcctttcttcatattgtctttgacttgtcatagtttctgcctggcacagtgcctcctaaattcatctattactctcacctttctttccacttttctcatgtgagaaatacacatttatcttcatttaccctggaaggttttctccttaacaacagtgtcacacatgacatactatacattgcatgctctacaaaataaaacataacctatgagagaacaaattcataagttttattgtaatcaaaatatttttttgaaaaatcttacatacagtattaatttttcagttttctctgatacaaaagacaccctcacttaatgagaaaaaaagtcttagaatacgagagctggaaagtgtctttgggagattacttggcacataaatatgatgcatagaaggtaggaaattactgcataattacacaagtaatcagtgacacagtgtctagatagcccaagtcttctagtataattataaggccacatatccgtcatggtgactcatgtctttattcacactgaccctgtttttaattgtgtggattttcacagaggaaaaaaaatggtggtctttgtagagctggaatgagtgaatactttctggtagatacattcatttttcacatttaaatataatcttagtggattttagtttttactaaactacttaggaaaataaggttaaataagtatattttttaaagatttgaccttctaaaagttcatttaaaagaaagaaaaaatattttaattgatggaaaatgagcaaatttattcaaagtgacattagttgcaaattcattctgagatcatcagatattaaagcaatgcatttagaaacgttattcttcatattaccaaactgaagcaatttaaatgtctatcaatagtagaatggataagaaattgtggtaaattcacacaatgaagaactttttttttttttttttttaacggagtctggcttcgttgcccaggctggagtgcagtggtgtgatctcagctcactgcaacctcccccgccgagttcaagcaattctcctgcctcagcctcccgagtagctgggattacaggtgcatgccactatgtccggctaatttttttttgtatctttttagtagaaacggggtttcaccatgttggccatgctgctctcgaactcctgaccttgtgatctgcccaccttagcctcccaaagtgttggtattacaggcatgagccaccatgccaggccccaagaactattttatcatgaaaatgatagaacaaaactacatgctataacatggatgaagcttataatcataatcaaaagaagttagacccaaaggaatacttattatataaatctatttttataaagttataaagttcaaatctgtgagattagaaatcaaggtggtaattactgctggaaggagggaaggccagtgttttggatgaggcaggaaaggtgcttctaagtactggtaatatttcttgacctattgatggttacacaggcctgttcatgttgtgataattcagtaagcttgggatttatatacttttctatatgtatgtttttttaaagccaaaattaaaaaaaaaaagactaaaggggaaatttattgaataccattagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacgatctcatagagtgaagggttaattggaatactgactgagtgcaatgtacaagaaaatgtacacactgaatacaaacaagggaaaaaaatcaactttgcctaggagaataataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgtgaaataagaatttacgttatgtatataagaaatagttgatttaggctgggtgtggtggctcacacctgtaatcccagcactttgggcagccaaggcagctggatcacctgaagtcaggagtttgagaccaacccggccaacatggcagaaccccgtctctactaaaactacaaaaattagccagatgtggtggtgtgtacctgtcgtcccagctacttgggaaactgaggcaggagaatcacttgaacccaggaggcagaggttgcagtaagcccaaatcgcaccactacattccagcactatactccagcctaggccacagagtgagactgtctagaaaaaaaaaagatgaagatacagttgatttaataaatggttatgatgaatgcatattatcatacttgcaagtaaaaatgcatatgcttataaaatatttttgaacagatattttaaaatcatagcaggttttagaaatcaaatttatggaaaacgtactagtttcatgtgtatactctaacaaagtagaaagagacaaaaatgtagtttgagatcctctgcaaatgccaaaatttagccagagtaggtaaaggacttgacagatgaaatgcactctgtctcttacactgagtttatacggagaaaagtaattttcgtaggcagtgaacacataaggaaactggtccaagtcttatgaatgtgaacattagtagaaaataagttatctttgagtatttagtagaaacaccaggaatactgcatagagggaagaaataatccaggaggtactactaataaacacatttttaattttagttcacatatttgggagaattcttacaaatttcatcggctatataccaaacctgaagaaaatattcctaatcaaattctgtggtaagccaggcacagtgtctcacacctgtaatcccagtgctttgggaggctgaggtggaaggaccacttgagccccggagtttgaggctgttttgaggcttgattgtgccactgccctccagctgggtgacagagtgagaccctgtctcaaaaattaaaaagtaaaacaaatcctgtggtggccactcctcatgatagtgacaggtacagacagtcttgttaatctgtggaaacactgaagtgagccaaatcatgttgtttaatggttcccatttggcattttgagcttgtttaagggtatagcaaatagagctataaatagtgcattgaactatgaattaatatggtctgtctgaaatcaatggaattttcaagccctttctgttaatatagagaaaaccaacttaaaaattatgactagcatgcagttaagaaacttggcaggccaaacatcttagaactaattaaacaaaagtgatacatttactcacatgatctactaattcattattattggtacgttagatgtttttcaaaaaaatactgttgtaaaaatttccctcaggtttgacaatgataaggagtgttgtgaaactactgtgattaaagcaccaaaggtacaatgggtcattttatatatacagcattccgttaagtgaagttgaatgcataatgactatattagcatagaatatatgagattagaattaggttttttttcctctgatttgaaattattggaaatcaaatagtgacaagaatgagtatattttccttcaaggcccttgaaaaacaagtcttctgtgtcacgttttatcggttcttttaaaaagagtaaacttttagcagcaagaaagatgtttgaacattattcgagtagctgccacttttaaaacctattgactagggaaaaatgaccccaatttttccccattatggtttgtctgtgtttgcgagtaaagacgtgtcttaattaaaatgttttaaatatgtacctaaaattaatatgagaaagtcataataaaaggccagatactctttagcatggttcttaaccatcaaactttcacttctggttctaaaattatacacctagaataaaatgaacatgtaaaaatattcatgtgtcttgacattggccttctgataaatctaatttgctaatataaaatcttgtaaaaagactataatctaccaaatgaatttactacaatatactcttctaaatagatcttacttataaacatatatgtgcaaaaagagagagaaaaggtttaatttatagtcttaaaaccaatatgctggctatcttagtgtatctccccagatctacatccaccttccagaacatgctctatgccatgggagggggatctgtaaagaatgcatcaatgggcttcctgtcctcctgccagctgggtgtggccagtgaggaacaccagaaaattaatgaaagggggagaattgggtggaggggtctttgttcttcttgttacatttttgtaagtgattcttgaggtgaactggagaacagatttaccacaccttcatcccagcactttgggaggctgaggcgggcgatcacctgaggtcaggagttcgagaccagcctggccaacatggtaaaaccctgtctctgctaaacatacaaaaattagccgggcatggtggcaggtgcctgtaatcccagctacttgggaggctgaggcaggagaatcacctgaacctgtaagagagaggttgcagtgagctgagatggcgccattgcactccaacatgggcaacaagagcaaaacgccgtctggaaaaaaaaaaaaaaaatcccacacctcctgtcagaaagccctctttatccatcttgccctcaatctctgggttctggtatccgttccatcctttagctttgtcttgcccacatttgtgtgtgtttatatatatgtgtgtgtgtgtgtgtgtgtgtgtgtgtgtgtgtgtgtgtgtgtgttattaaatattcctcaaatttcccaactcaagtatgctgtttgtttcctggaaacaggaagatatctagaatctacttctaactggctttgaaaatctggcagtgacagctgggggctcaattttgtatactttaaactttaaatttatatcatttatatatttataaaatgcatatattcattcattgttaatagtaataaaatatatagcaagcatttgggaggcagttttaaaagaaggccattaattttgctgctttagaaaatgttttatgtaaggtgtttcaaaatttggaatttgactctgcatgtagcaattggtatgtgttttactaaagaattatactctacctgtaaaagttcttttaggtaaagacctggaaattatattcaacatttgtgaattgtacactctttaatgcagtcaggattacaggcaaattttctagtagagtaaaaatatacatgaattgtaaaagtaataagaaaggaaatttgaattttgctatagttgttagagagaaggagttagatgatttttattcctgttgccagtaatactaagataaaatgattagagtcacatacacgttatatatgaaaacttataggaggtatgaagaccagaattgtttaggagtttataatctgaggacttatatgatgttctttaacattttttatgctgagaaagaatattattaaacaatgagttaagtcagaacataatgtgacagttaaatgtctgttaaaaaatacatttttgaaggcagaacttctggttatggtagaatatagagatcagcaaaccctttccccaaaaaagtaaaaataaagctggataacattgataaaaccatgagttcagttttttggaaattggccagaatcataaagtaatctggagagatttcatggctttgtagtataaattacaattattctaaaatatttaatctgaaggctatcatgagattttaaaatggaggggacatgctaagtaaaaaatgacaacaggtgattaagcaaaagtgaaaaatattaattttagtatatgattccagcaagtatgtttggactgttgaactattatgaatatttacctatcattatcatcttttaaaatgtctactcactagaacatctcactaattatgtatttctttatttctccccaatagttgtgctttgatagtttttgcaaatttatttaatcatactttatttgaatgtattacattcatattttattttttaacgcagacatttgatatattcagaatggtagaaaattaaatgtacttttttagtattattattatttgagacagcttctcactctgttgcccaggcggaagtgctgtggcacaatctcagctcactacaatctctcccttctgggttcaagcgagtctcctgcctcagcctcctgagtagctgagattacaggtgtgcagcaccaggcccggataattttttttttttttttattgagacggagtctcactctatcgcccaggctggagtgcagtggcgtgatctcggctcactgcaagctccgcctcccgggttcacaccattctcctgcctcagcctcccgagtagggtagctgggactacaggcgcccgccaccacgcttggctatttttttgtatttttagtagagatggagtttcaccgtgtgttagccaagatggtctcgatctcctgacctcgtgatctgcccgcctcggcctcccaaagtgttgggattacaggcgtgagccaccgcgcgtggcccgggccagataatttttgtacctttattttttgaatttgttaattagcttgatttaatcattttataacataaacatatatcataatattacattgtacccaacaaatacataaaattatttttcaattaaaagtacagttttttaaaatgtcaatttttctttttcaatgattcttttatttattcactttatttttttcagctcttgttttagattcatgtgtacatgtgcaggttttttacctgggtatattgtatgatgctgcagcttggagtaagaatgatctcatcactcaggtactgagcattgtacccaatagttagtttcaacccttacttcccttcctccctccccccacaatagtccccagtttctattctttccatctttatgctcatgagtacctaatgtttagctcccacttaaaagtgagaacatgctgtttttggctttctgttcctgcattagtttgcttaggataatggcttccagctgcatccatgttgctgcaatggtcatgatttcatactacatagccacaaaaaagaatgaaatcatgtcctctgcagcaacgtagatgtggctggaagccattagccaaagcaaactaatgcaggaacaaaaaagcaaataccgcatgttctcacttgtaagtggttgctaaacattgggtacacatagacaaaaagatgggaacaataaacacgagctccttcttgagggggtagggtggtaggaggatgagagtaaaaaacctgtctattgggtactatgctcactacctaggtgataaaatcatttgtacaccaaatcccagtggcacacaatttactcatgtaacaaacctgcacatgtaccccatgaaccaaaagtaaaagttggaaaaaaaagaaattacctatacataaagtttgaggtcttacatttaaatctctaatccatcttgagttaattttcatatatggtgaaagctaagggtccagtttctttcttttgcatatggttggccagctgtcccaacaccattggttgaatgggggtcctttctcttttatttatgccgactttgttgatgatcagattgctgtaggcatgtgactttatttctgagttttctattctgttccattggtctgtgtgtctctttttgtaccagtaccgtgctgttttgattactgtagccttgtagtatggtttcaaatcaggtaaagtgatgtgtctggctttgttctttttccttagttttgctttggctattcaggctctttttggttccatataaattctggaatagttttttctcattcagtgaaaagtgacattgttcatttgataggaatagcattgaatctatacattgctttgggcagtatggccattttaacaatattgattcttccaatccatgagtatgggatgtttttccatttgtttgtatcatctatgatattttacagcagtgttttgtagttctccttgtaaagatattttacctccttggttagatgtattcttaggtatttttatttatgtgtagctatagtaaatgggattgcattcttgatttggctctcagtttgaatgatattggtgtatagaaatgctacaaatttttgtacattgcttttgtatactgaagctttactgaagtcatttatcagtttcaggggccttttggcagagtcttctaggtagaggaccatatcatcagtgaaagagacagtttgacttcttcttttcctatttgaatgcctttattttgatctcttgccttgttgctctggctagcacttccagtactatgctgaacaggtgtggtaggagtgggcatccttgtcttgttctagttctcaaggcaaatggttccagcttttgacagtttagtatgatgttgactgtaggtttgtcatagatgtctcattattttgaagtatgttcctttgatgcctggtttccggagggtttttatcatgaagggatgttgaatttcatcgaaagctttttccatgtctcttgagatgatcatatggctttggtttttaattctgcttatacattcatatttttaaagtcacaaacatatagagttgcagttattaacatgatctctaatttttgtaaataaaattcaaatatcgattttagtgattgatgtaatctctaaataagatctaatgtgtattcaaaaaataaataaataatttgcaagtatttagtaatgtgtagatggtggaggggagtgtcatattgtaattaagagctgatcccttgggcttaaactgccagatcatgccaaagactggctttgtcacttattagttttgtgactatgggaaacttacttgtctcctcagcttcttcaccttttagattgattcagttttagaacctacttacatagggttgttgtaggtacttctatgatataatacatattaccaacttagaatacaagcagacacatggtaagcactcaaaaattgttagttgttcttatttttatattttccttcattataagctgttacttgtgagagggaagaaaaaaatctacttttatcattgtttagaatagtcaacttatgttccagttcttataaaatgacctcaccatatatcgtatatattgcacagtgaaaagatgcttctgtcttaataaatatacagatagcccatagggaccaactctttgtgcggatataaaatagtacagccacaatagaaaacagtctcttaaggcagttcctggaaaagttaaaaatgaacttaccatataacttagccattcaagacctatgtattgacccaagagaaacgaaagcatatgtctatccagagttgtacatgaatgaacatagcagctttgttcttaatagataaaaactagaagcaacccaaatatttatggaggtgaattgatgttttaaatggtggtttaactatagaatggaatataactcagtaataaaaaggaattaactattgttagcctgcgacagcatgtatgaatctcatgctgagtgaaagaagccaaaccaaaagagaatgcacattgtgtgattccatgtgtatgaaattctagaaactgcaaactaatctgtagtgacaaacaacagatcggtggttgcctaaagacagtgaaggtaaagtttgaagagacagattactaaggagcatgaggaaacttttaggtgtgatggatatattccttattttgattgtagcgatgatttcctgggtgtatacataagctaaaacttataaaattctacctattaaatatgtgtggcatttacatttgtatgtcaattataagtctacaaagctatttttaaaaatacatttctctcataaactaaataaatgcagaaatttaacattttggatgttgtattattgcatgttttaaataatgaattcaattggagttttctcattaaaatctaaagttgagtttaggttcacagtcaaatgatgtcctataatctataaaagttattattgcacagtgataaattggaaaccagagagaccgacattatataatatttcagttgagtgtgatgtgtctgttatgtacagattttggcaccacagtgcatggaaatatatacaaagagtcttcaaaaagttcatggaaaatgcatattatggaaaagcagttcagagaaatcaaattttgttgaaccaaaataaactcatactaacatttaaaaacacgtctagatagcatctagtttgaggtactaagatggataagtcatcagtttaaaaagaggccctggcggggtgaggtggctcacgcctgtaatcccagcactttgggaggctgaggcgggtagatcgcctgaggtcaggagttcaagaccagcctggccaacatagtgaaaccctgactctactaaaaatacaaaaaattagctgggcatggtggcggccatctgtaatcccagttactagagaggctgaggcaggagaatcacttgaacccaggaggcagaggttgcagtgagccgagatcatgccattgaactccagcctgggcaacaagagcgaagctgtgtctcaaaaaaaaatcagatttatggtgatgcttgagaggaagaatggtgaaattattgatgttttgcacaacatttatggggacaataccccaaagaaatcaacagtttacaaatggaaaactcattttgagaagggatgagacaatggagaagatgatgctcgctgcagcagactgtccacacagagcagaaaattaatcttttttatgccctgattcaagaggactgaccattcacagcagaaacaatagtgaacaccatagacatctcaattgcttcagcttacacaattctgactgaaaaattaaggttgagcaaactttccacttgataggtgccaaaaccattgaacccagattagtggagacaagagaagagctttcaatggaaaatttaaacaagtgggaccaagatcttaaagcatttcattaaagaattgtaacaggaaatgacatacaactttaacagtatgatcctgcagacttagcacaatcaaagcaaaggctaccaagagctgaaactggtcctgtcaaagcaaaagcatatgaaacaaacatgtgagaaaagttcaacatcactgatcattagagaaatgcaaatcaaaaccacaatgagataccatctcacaccagtcaggatggctattattaaaaagttaaaaaaaaaaaaaacaatagatgctagcaaggttatggaaaaaaaggaatgcttttacactgttggtgaaagtgtaaattagttcaaccactatggaagacagtgttgagaatcctcaaagacctagaggaagaaatgccatttaaccaagcaattgcattactgggtatatatccaaaagaatataaatcatcctgttataaagacacatgcctgtgtatattcattgcagcgctattcaccatagcaaagacatggaatcaatataaatgcccatcagtgatagactggataaagaaaatatggtacatatacaccatggaatactatgcagccatgaaaaggaatgagatcatgtcctttgctgggacatagagttggaaaccattatcctcagcaaactaatgcaggagcagaaaaccaaacaccacacgttcttacttgtaagtgggagctgaatgatgagaacacatggacacatggtggggaacgacacacactagggcctgttggaggtggatggtgggggagggagagcatcaagaagaatagctaatggatactgggcttaatacctaggtgatgggatgatctgtgcagcaaaccaccatggcacacagtttacctatgtaacaaacctgcacatcctgcacatgtacccctgaacttaaaagttgaaggaaaaaaaaaagcaaaagcagattagtcgagagaaaaggtcatagcaacaatttttgggtatgctcaaggcattttgcttgttaactttctggagggccaaagaacaataacagctgcttattatgagagtgtttaaagaaatttagctaaagctttaacagaaaaacatccagaaaacctgcaccagagaggccttttccaccacaacaatgctcctgctcattcctcacatcaaacaagggtaattttgtagatgtagaagttttgatggaaaatcattaggtatgcgccttacagtcctgcttcggcctcttcttactttttttgttttctaatcttaaaaagtctttaaagagtattcattggcctggttaaattccgagcatcttcagttttttaggagtaaactaaatggtatcattgtttacaaaaatgtcttaaacctattttgaaaaataaaatttatatttttaaatttttatcttttatttctatttttctaactttttgaagtcccctagggtgtgtgtgtgcacacatgtatatttgtgtatatatactcttaacccccacatgtacatccatgctgcatcctattgggggaggcagtttgtgaaagcattatccaagaatggtttagttgcccttgattttatatatagtgatccagtcataaaactgtagtttatgtgtataattacaggaagacaattcatttgaagagaggcatatgcacacagttatttcaagaagccattttttatttatgaattttcaggtcaaattttttaataacctaagcaacctttggtaggatgttttaacagaattctaaatattctatattgtagtcccccaaacagtgaaattttcaggaatgtaatactttgtcattatgttagctcatctatgtaaaataggctacatttattccaaaacgagaatactttgaaacttctaatgcttagatatttaaatgtggtgattatgctctcatgaatatttaaatctttggagtcagacatagttgctgctagtgccaatcaaatctaggatgaccaaagaaacactgctttcatgaataagtaatctttctccccatgagttttctgaatagtctaagaactcatgtgggaatagggagagcactgttagaatgacattttatctaaaaaagggagcaaccacgggagcagatgtagtatattataatctgcttgacctgttcacaatgatttgtgagttctgaactctaaaggaaatgctttgtttgattctaaactatagctaacaatgttggatcagtgtatgaataactgaagtatttattattctcaggaagtacatattggtcatccaatatgaattctaaaataatttaatgattgctattattttaactctataatggtaataataataatcttcctacatttcaaaggtcagctttacattaaaactttcgctctgaaatttcatattggccatattactctgtttaaaaacattttctaaatatcacagtgaattatatagaattctgtttaaaatttgaattatacagatactatattgatggtagatgccatgagtaagttgaaatatatattattagaagaatatgtcacaacagaataattaaaagtgagtactaagaaataccttatattagacttaagcctccctggataccaaaaaccttagtgtctatttggggaattcctgagatttcaacatagagcattagccagtgtatttgcaaggccactcaaattcactctcatagaaaggacaagaaatattttattcagaaagaagttcatctcggtaactcaagccaagtgaatcaaaagtctaatgttctttgggggcaaaatttctctattgtactcagaaaaaaaaagtcaaggtagtaattgttactgtctaaagaaagtcattgaaataacaggacattctgaagtttgtacttttacaattccttaactttatacatgcttaattaaaagttaataaatatttaccaaacaccttgtttgtgtgctggggaaagaggtatacatatatgtgtacaacagttcttcatttctcaagcattttttagtgggtagagaaagtggtcattagacatatacagaactgataataatacacagtagattgtgataagtgctaatatcatttaatattcattagtttaataaatacagctcagttctgttgctaggaagatcaaaatggctaatgcatggtctctggtctcaaactcacagagtagtgtgggaggtaagcagatacaatacagaatgataaagcctgcactagaaggttcacatgaaacatagaggcagacgcatctcattctctttgtgaaaaggtggcaagtcctgaagaacttctagtggctttggctaatatatagcttatagttacaaagtaagcagtatgacacagggaataatttaatatgtgaggcattattacatagttcctctttcaaggaaacatagctgtttagtccaatgggatcatatgggcaaaaatatcataaattaatatatataatcttcttaaaattccatatgttactctagaacagcctttgtaagccctttacagtaattaagaattttaaaccttattgtaaatatagtagatttgaactctaggcagcataagaagttttatatgtatattcatacagaaaaggaacaaaatgtacattgtgaatgattggttctttcggcataccaatgtgtcacttactgtggatattttcatgccagatattcagaaaagtttgtgtgtgtgtaggtttctatagtatcagtatagtaattctgtaatatagttcaaattataagtatatttttatataatttactgtgatatttaaacttttttaatatttaggatatacaagttcagatttcttacatgcatatattgtgcagtggtgaagtccacgcagagtaaaacatatatacacatggacataaacagatatatatgtatttacaataggtccacaagttatattttcctagagtaatatgttcattttacaggaaccaataataaataggaaaacaagcaaaagtactacattatacttttctttaaaaattgagattgtagattacatttaatagtaaaccaataactcactttttcctttattctgaacattggtatcagaaaagtatgacttctgtaacactgactagattatatgattcgacgtgaatctgttagaagcaaagagaatgatgaaaaagctataatatttagttacacatggtcattttaagaagagaaaaagcatggaaggaacattctgattgactggtgaaccactaccacgtattacgtgttgcctcaatgaattaaccgagagtggatttgtgtgctcacaatctgcttctgtagaataagaatgaacgtggagtctttacctgcttatagtaagcgtttatctctcaaaaacctttaatcatctgaatatcactaatgcaaaaacaggacccaggtaaatcggagaaaatagttcattctttgagcctttaggaaccagaaatttctgtagcaacaagagactttcttttataaggttttaatacctctgatttatttttcattgcaacagaggtttacaaagccacgcttggaggctttgtcaggattttgtagagtgtcagcatagtcatggtggatgttgcagttgcactgaaggtaccttaactttatgcaggaaaagaaacttaagtgtaactaaaaagctaaattttaaagtgaatcttaatctatgtggtaaggacaaccaccactacattcatagaatggacagaattgatgtttgaagaaatttagtactcacagaaatttggagtttttctgacataatatttgtaagatctgtacctatcatcatggcaaggatagcgagtatgtagctcattttaaaaatagttgatatacatttaaaatattttagattcccctttcttctaaatatattgctgttgattgttcaggttagtaatttgccttgactgtcactgtttttcagtttctctattaaaaattgtctgaatctatgtggatatatcatttattattgattgttccataataaaagaatctcgatttgtaggatcatggaaataactgaatttgaagcatttataatttacctggttctccatatccaattcatgattatcacctttgtattgatattttctgatgaaaacaaattcactgtgtgccaatttctacatttccactctcattgttttactcttttgctctagcaattgatctatgtcttttgtttcattgcctcacagactaaaccagtctctagtattaactccagtaatatttaaggtccttcaattaatcattccttaatgggtttacatattaattaatctgttgatgtattcatgcatgcatttgcaaatataatttgaagccctaccattttctaggaattctgcgagaacctagggaatagataggactacattgattttgtcatcatgggattctggaaacattcaggaggagcatctcatctctagcctagggtgtcagaaagaacttgagtaatcaaggattgggtcttaaaggacaagtgaacatgtgcaggtgagaacattctaaaatgaagggacttgaacaaaagcaaagccatgttaaacagcttgtacttcatctgtaggtagatcagtaaccactcaggggttttaatcagggaaatgatcttctcagatttggcttcatatgaatctctctatttgccttatgtcacagcatatattaggagatcatcagagtagtccagacaagcaggaatgaagataagcatttggaatctagaaatgattacattaaaacaggcctagacacaaaccaccacattttttgccagaaaggcatagaaacaaattgtattagtgcttgccaggttctgggaggagttggagatggagaatgactgctaatgggtataagatttctgtatagtctgttctcatgctgctatatggacatacccgagattgggtaatttctaaaggaaagcagtataactgacctcaggaaacttacaatcatggcagaagggacagcaaacacgtctttcctcacaagacagtaagagagagaagattgagtgcccagtgaaggggcaagctcctcataaaaccatcagatctcgtgacacctaactcactatcacaagaacaggatgagggaaaccacatccatgattcaattatctccaacggatccctcccatgacccgtggggattatggggactacaattcaagatgagatttgggtggggacatagccaatccacatcaatttctttttggaatgatgaaaatgttctggaattagatagtggtgagggttgcacaacattttgaatatattccaaattaataaatggttcacattttgaatatattcaaaattaataaatggttcactttcaaagggcaaattttatggtgtgtgagttatatctcaagaaaactgttattaaaaaaagaacactgcatttagtgatgaacgaacaatagagcgagatggaggtacctaagaaaactcccaaggttcttgctttggtgactgggtagatgactgtgttatcaacaagatggagatcaccaaaaaaggagacattgtggggtgacaatggggataaaattgaggtagttggtgttgatttatttttaattgtgtttaaggtctgtataacatccaattgtacttgaactggtgtttggtctacgccatagatacaaatctggtaaatcttatcccagaaagtgaatggctccccaaatttttctgcctttacatattccagaagtacaacataatcttattaatagcatctccctttgcatgccagtgattctcattcaaggagtggagcatgtcagaatctgccatgtacaagactgtagttcaaaaaggccagcttatcagagatgctgacatattccatagggaatttttgtcaaatctttctatatcctccattggaaattattgatatacatgatggctaaatccatgagttcaggtgtcatcacctacagctttatgtcaagtgaggagaacgttgaagggctcaaagaagtaaaagcagtatttgaaagctcacataaagaacgaacgaatgaataacaactgcaggaaagattcttggcagataatagtttcaaaattagtatttattgagcaaatgcattaataagtgaatgagtgtgttttccagaaaccgaagaatttcaagaataataaactattttaaaatcaagatatgaatctaataagacaaaaacaggtatgtccattgtacagttatgctctgcatgatgttttggtaaatgacagaccaaatttaccctggtggtcccataagattctaatactgtatttttaccatattttttctatgtttagctatgtttacatatacaaatacttaccattgtgttacagttgcctacagtattcagtacagtgatatgctgtacaagtttgtggcttaagagcaataggctatctcacagagcctaggtatgtagtaggctatgccctgtcgcattgtgtaagtattctctgtgatattcacatgacgatgaaatcacctaacgatgcttttctcagagcatatcctcatcgttcagtgatgcattactgtatttggtgaccatagtaggttgactatagtagtacagggatgactaggaaagtaggaggaggagatgagaaggcgatgggtatgaactatgctcttaagaaatgtggataaaggagagggactgagaacataggagggctctagaggaaagaagatagatttaatgctacttttcgcatataaagtcattcttctcctaaataaaagtttctatgattttgttcaggaatcatatttaaccagttttcaattttcctatgaaaccagaattaaactgcacctaatttctgatcattttctttcttaatttgtgtaatttagaaataggtatgacgggccaggtgcggtggctcacgcctgtaatcccagcactttgggaggccgaggcaggcggatcacgaggtcaggagatcgagaccatcctggccaacatggtgaaaccctatctctactgaaaatgcaaaaattagctgggcgtggtggcacacacctgtagtcccaggctgaggcaggagaatcacttgaacccgggaggtggagtttgcaataagccgagatggcgccactgcactccagcctggcaacagagcaagactccgtctcaaggaaaaaaaaaaaaaaaaaaaaaaaaagaacaaagaaataggtatgacatcatcccttcaaaatgtcatctttctccacattccatcttacccatttataggaggttaaattcatgtgtcattttttagtagaatttactgataaaagctggccctttagtggtatcaggtctgtgactgatatgtcacaagttgatgatgactttcccattgttaataattctacagctgtctatcttattcatcctggtccttattcttggtacagctcttctttaaatcacagaagtaaaagttccatatgtatttattataaaagatatgcatatggatactttaaaacgttttattgttccctgtttaagcacagtaatttctactagaatttttgtcatagaaagataaatcttctccctttgctactttctgctttcatcttctttgattcttccttggatcctgcccttttctccgttattttaaatttttaatctgctatttattcactgtcttcgtctatgcctaaaagcagggacttttaggactgttgcaaaacagcagtaaatcttatttaagtgtttcatgtatgttttcagcttcccttttcttcctttcaggatgaagaattccagaattatgtctgcaactgttattttcttgacatacactcactctttaactcattgccttcaacgctcactacactgtgcttttgaaatgcagtcatctccttattattatctattaatattttatacatcttcattctctttaaactcccagcaaaagtagagaaaaggttaattacccctttctgcactttttggattccctttttggacttttcagctcccgattttttctccgtattccatttgcaccttcaccagctccttcagcaagtcctcttcattctccctctcttccaatgtctatgtgtctgaagctacagctttttccttctgcacctttcttccagttgaatttcgccccaaccctcatgagagtcctctattctcaaggcacctgtcaccacctcggtgtgaccaatttttccatgtatatccttttcttctctggtaggccttacctactctctcccacttttgcctggatacatttacttatcattcctatggtaaatttaactttgatatgccaaaaactatatttgatagaaaagtatatttcttgcttgaaagagagattgcttccattcaagtcataatgtgtaccataaaaatatcaaatatggaaatcaggtgatcagaatatagaaacaatgaaaagtagatattgagaaaataacttttaagttccaaatattacctaaatagtcttgaaatgcaaatgtgtcataatgataagttttactttatttgtttttggttatcagagtcttaaataatgggtgattagcttagaagtcccattctgaaattcattaaaaaataaaatatttctctgaaaaggacttatgcctaaagctgccgtcattctttctcatctggcaccccaagcttcatttgattccctgtttccttattgagcataatttaatgcaacaatcttgcttaaataagtattacaagatccaatagattaactttaactctttatcaccaatctataggcttcatagaaatattaaacaactattgattttaatgtataacattgtcataattcttgttatttagaaacaagatccaatctccagtaaaccactcactgcagcccacacttgttagcataatcaatttatcacacttgttttataaagttgtaagagaaccccacagaagggtgttactaaaaattacagctgatgtaagcttttcacttcatgccaaaaggagggcagttgacgctaccatgaaataaactctactgcagcctctttaatcatttgtcaagatgtattatgtccttgtcaatatcaagggaggtaaacactgtcattaatctgcaagtgaggaaataagtaaccacgtcaatgttcaagtgcctggctgttaatgcaaattcatctttattccatctttctccctctttcattttatgatgttgttcctttttcataaaatgtgcagttacattgtaatgtttagaaaatatacataatgcattattaggatgttggccattgtgaaatttgctgggtgtgcttagcaagacaggcactgacaatgcagtagttaagctgagccagcatagattagtctaaagagaacataccagctataaatttaacaaactgttcattttctaaagtgattgctttatgcatctgcaaatagggaataacagaacattcaactctattttttccctaggcaaataaaaaacttagatcttgaaaagctttctttagaaactttaaatagttattttaattttagatgctgtcactgatgtgttatgcaaaagagggatgttacttacagtggatatgaaatggaattgcagttttagcatctattatttgacttgaattgccacttatgtcttgataccttcctatggggaatctatggcttatctgtatcgattagataaatatttaaagtaaagctgaatatagcagtgttttatatccaccagattacgctacaaaatctagtggcattagattttttctttataggatttttaattgaaaccaacacattggcaatataccttgtttatctagcatagttaccctcaatgaattagcaaatcagaagcttaactgagaaaatagtgaaactctaggagatataaaggctgaataaccaaataacaaatcactacttattgagtttatgcctgtgtaagatagtgtactgtcatttcatgtaatttatcaaagagcactatgaagtatttattatcatgcagacaaattaaatgactttctcaaaccacacagataagaagtcatagatcttagatttgaacccgtgtgactagatgaaaaatctcagctattgtgcaatgggtcacactacttctcagagcaattttacctaggaaaatcttcttatattttactttgaaagatgtccggtgtgtttacttaagttatttaagtaccctaattagggataagatatccaccttcctaaagtcccatatttatttttttagaggaccaacaggtaattcttttataaggaatgtgatagattgaatcacgtagtgattaacaacacagattttagccaccaattgcattttttcaaattatgactctgacatttccagtgtgtgatgttaggcaagttacttaaccactctgtgcctcagtttaattacctataaaataggcaaaattacattgggttattgtgaaaattaaatgtaatgataaatttaaagtaattgaaaaaaggtctgcaataaggtaactgcttacttagcagctatatcttatcatttaaagaagcaatgtctttggctcacatatttgttaacatgaatgggaataaatatccgatttagttccttaatgtctttaatgtcagtatctattatccagtcttgtccatccaaagctttctggctcactcttgctcagtctgtcatttttctacagcattatcatgatataattcatatagctacaattcacttatttaaaatgtataattcaaaggttctaatatatttacagggttgtgcaaccatcaccacaatctaaatttagaacctttttgttccatttaaaagaaacaccatacttgttagtagtcactcctcatttctctcctccctctctgcccagccctaggcaaccactaatccagtttctgtttctataggtttgcctatactggatatttcatataaatgaaattatgcaacatgtggtttttgtggctggcttctttcacttaaagtaacagtttcaaattttatgcctgtgatagcatgtttcagcacgtgtttattatccttgccaaaaaatattgcattgcatgtatataatattttatttagtcttcagttaacattcatttaggtggtttccattttgtggccattgtgaataatgctgaatgaacgttaatgtccaagtgtggacgtatgttatcatttttcttgggcgtgtaactaggagtgaaattgttgagtcaatagccttgattatgttttacttggaggaccacatagcctcctagttgggcttccagtttctggcctagcttagcctgtgaatgtttgtacactgctgccagggagatctttgtagatcttaaatatgattgtgttcatctcatgttcatggcctttagtggttcttctgttgttttgggaataaattatagataccttaacttgacatgcattatttaatcattaaatacttattgggttcctactatattctaggcactcttctagatacttgagtatccttgaaatccttgaaatcatgtcacattggaataaattattactaaaatcagaatcaaatttttgtagaatctttgatttaaaaatacactccttctttagcctatttttcactacaccacggtgcctaggattaaagataaatatggtaagataattacgttgctttccatgttgcattattggcaggttattctaaattatggaataatagcgatgtgttgtgtttgcctgtctctttacagagatgcttattttatgtgaatttccaacatccctgagagaggatcatggcaaattactcacttccatcttacacctagaaatgttgagactaaatacgtaaataaagtacagtgtttgctctactaaaggtgataaatatctgttgaagttaagtccaaccatactaggaagtccctggaaaatttatgaactaatttttagtttttgcctttactaagggaaagaaaagcaagaagtgggcaaatgaaagctgagatgactgcaatctcatcaggacctagtatcctggatgcttttacatcctctctcgtgtttttatttgaaaccaactctataatgttgttgataactgtattactttaaataaattaaatgctaggtagtgtgactactgatttgatttgatttgattatcagaaaccatgataacttctgttctgtaacaaattctaaaagccattaatccaaagcaagatttgttttcaaagctcatccaaatttgcagtagtgcaattttaatataaatgtagttattcacacaccagggccagttgggtggtggggggtgaggggaggaagagcattaggacaaatagctgatgcatgcacggcttaaaacctagatgatgggttgataggtgcagcaaaccaccatggcacacaacctgtgtaacaaatctacacattctgcacttgtattctggaacttaaagtaaaagaaaagaaaattaaaatagaaagtgtagttattatagcataaatatttcatcaaatatcctgtattttcagagaaatttgatcatatatgaatattttatttatcacctattcttatttttaggtgagataatggcacaatggttatgttttcaaaatgcatccttaatttttagaaataataactgaaatagtttatggaagatacacataaggatttgtatcaaaataatgtagggagggataaataggagtagagatgaaacaagattggccatagttttagtttttgtaatagactttatcttttagagcagttttaggttcttagcttaattgaatggaaggaacagagatttcctatatattctccaccccatctatacacagcctccccctacaatttacatcctctaccagagtggtacagttgttgaaattgatgaacctacatcaatacatcattatcattcagagtccatagtttacattagagtcactcttagtgttgtacattctgtgggtttggacaaatgtgtaatgagctgtatctaccattatggtatcatacagaatagtttcactctcccaaaaatcctctgtgctctacctatccatccttccttcccactaattcctggcaaccacaaacctttttactatgtccataaatgttccctttctagaatgtcacatatttagaatcatacagtatgtagacttttcaaataattagcttttttcacttagtatcatacatttatgttttttccacgtcttttcttggcttgatagctcatttgtttttgacatgaataatattccactttctggttgtaccacagtttattcattcgtctatggaaggacatcttggttgcatccaagtttttgcaattatgaataaagatacaatcaacatccatgtgaggtttttatgaagacctaaattttcagctccttcgggtaaaaaccaaggagcacagttgttggattgcatggtaagagtatatatatttttgtgaaaaactgccaaactgtcttccaaagtggctattccattttgtattcccaccagcaattaattagagttcctgttgctttacaagcttaccagtatatggtgttgtcagtggtttggattttggccattctaatagttgtgtagtgctatctccttgttgttttaatttgcacttctctgatgacatgtaatgtgaagcaactttccagaaacttatttaccatctatatatcttctttggtaacatgtctgttaaggtctttactgcgtttttaaattggattatttgtttttccattgttgagttttaagatttctttttgtgtgtgtgtgtgtgtgtgtgtgtgtatattatatatatataaatgtacttttaattgaaaaaattgtatgtgtttatcatgtacaatatgatgttttcaaatatgtatccatagtggaatggctcagtcaagctaattaacatgtgaattacctgacataccattttttgcaatgaaaacacttaaagtctattcttgtagcaatttttaagaatacaatacattgttactaactgtaatccctattttaaacaatagatcgcttggacttattccccctttctaacttaaattttgtgtcctttgactcccctcctcctgccagccctggtaggcaccattttacgccctactgttttttttgtttgttttttttttttttttttgagacggagtcttgctcactaggctggagtgcagtggcacagtcttgactcacagcaatctctgcctcccaggttcaagtgattctcctgcttcagcctcccaagtagctgggactacaggcacacgccaccatgcccagctaatttttgtatttttagtagagacggggtttcaccatgttggccaggatggtctcgatctcttgacctcgtgatccacccgcctcagcctcccaaagtgctaggattacagatgtgagccaccgtgccaggcctttgtgccctacttctatgaattcagtgtttttagattttacatatgagtgagatcgttggcatatttgtatttctgtcgctgatttttttcacttaacacaataacacaatatcctccagttttatacctggggtctattctagttctgggaattttctgagcctagagctgctggggtcagcctggcagtaaggtctgttcaaacaactagtccaaaaggtaagcctggatcttagaggtgcaagatctcatctggcactggggtgtgccgggaggtgcagtccatgagtactggcctagtctaggatagtgggtgtattcatccattctcatactgatataaagaactgcccaaggccgagtaatttataaaggaaaggggtttgattgactcacagttccacattgctgggaaggccttgggaaacttacgatcatggtggaaggcaaaggggcagcaaggcaccttcttcacaaggtggcaagaaggagaagtgccagcaggggaaatgctagatgcttatgaaaccatcacatttcatgagaactcacttactactgcaagaacagcatgggagaaaccacccccatgatccagtcacttcccaccagccctcccacgacatgtggggatggaagctataattcaagatgagatttgggtggggacacagccaaaccatatcagtggggtcatgtttatcactgggttttactggggtaggccaagtgttgtggtctaaggcaaaatccagtgctcacttccttaattttcctccaagtagaaggtatctctcttcacagtgctgcctgggattgggggagggctcacacaggtaatgtaaaactgcccttcctactcttttccatacatcttttctcatttttatgctacacccaggtgctataatctctcaactgatttctttagctcttgtgaaggtgattttgcttgtggatagttgtgaaaattgatgtttctgcagagagatgagtgctggaaagtcctattctatggtcttgctgatgtccatctttgtgtattttgcatgacagtcttttatcagatatgtcttttgcaaatattttctcccatttttcactggtcttttcattctcttgacattatcttttgcagaacaaaaaggtttgattataaagtccatcttatcaattctttctttgataaatattgcctctagtgttttatttacaaagtcatcacctaacctaaggtcacctagattttatcttgttatcttctagtagtcttttaattttgtgtcttacatatcaatctatgacccattttgagttcattttcatgaatggtataaagtctttatcgagattctttttttttttttttggcttgtggatgtccaattgttccaacaccattggttgaaaaggctatctttttttcattgtattgcctttgcccctttgtcaaagatctgtcaactatatttatatgggatctatttctggaatatttatttcagtccattgatctatttgtctattttttttcactagtgccacactgtcttgattatcatagctttagaatatatctcagaattgaataaagtcagtcctctgaatttgttctttttcattactaagttggctattttgagtcctttgcctctccgtataaactttagaatcagtttcctgatattcacaaaataacttgctgggattttgattggaatttcattgaatccattgatcaagggggaaagaatggacactttaacaatattgagttttcatgtaatgaacacagtatgtatttctatttatttggttcttcttttgtaggttattttctgaacctgactaatgggtacataggtatttgttttactcctttacctgtgtattttttacctttttatgttttgcctgtatatgttttaccttttacaagataaaaggctaaaatattttatatttttgcctttgtgatactagttttttggcaaggatggggtaaaaagtaaaataggacattgacatttcgaattttgaatttcaaatctcctatcagggaaattgaataaatatgttgaacatggtagtttggcaataaagggctttggcaaagagggcagattcggtgtaatgatagttctattgagatctagaaatactcctatttgaagagtgaaaaagtgctaccaggtgttcagaagaaaagaaatgttaatgagaaggccaaagataaggtgaatcttatatcaaagtactaaagagaatgaaagtgggattcagttccttctgggtgataagactgtcttaaattatttctcaattatgacatcatatttcccccccatttcttcatcttgcataactttgtgtttaaatgagagtttttaaaatgtgtttaaagctagtaatgtatttgactttgattttgcaaggataacacttcccaatatcctttttgagctcatagaatttgttcatgttcttttaaatctcctgattattagtggtttacttttgatgaaggtgatagcatattcttcatgaaataactatcaagcttagtgttaagataatttaggaaactaaagcagaattataacttcttgatttttatgatagtgtcccttggatgtgtaaattaaattacttattttcatttctaatttttgctaaccatttcagaaaagtggttcagcacaatcgttgccaattctacttcaaatcaagaaatctttaagcatccttaaaagctaccataacaggcctatggcactgtgtgtctttaggagattgatttcttttgtgggtattctgtttacttaatgacataaagaatgagtgagggagaaggcaaaatattctcccaggaagatggagaagagtggtcattgtggattagttaggcttttagtaaaaacaacattgtaatgaccttgtgatttttatgaaaccacttataacttggtcttaatttacaaataagttcctttaagtttgcatcaaaagtacagagctctttcttgttattcttaacaaggtttgatacacagcatttcctcatggataatttgtgggtttaaaaaattgaaatgctattattggtaactatcttggtcattgttgcaagatgatttctatagtgggagcatcctttcatacaatcatacggatccttttacggtttttctggttataatatcagtaaaaagtaccacttggccacaagtgacttttgtttatacgttgaatgaaggaagaaattatttctaggtgtgcaacatggagaatatttaaagttctcggaatgtaagtttcttcatatgtcaaagaaggtgataatacctaattttaaatgatgttgaaaaggttgacatataacttatggaagtactacctacgtacccacctacctacttacctacctacttatctatctgtttttatgtctatctgtcatgcttagcatagtaactggcagattgtaggcagttaggaaatgttagttgtcttctcactcatcatatcatgtacttttaaagggatggttttcacatctgtgcaggttgtctactgtaccactttagagggcaatgttcatgtagcaaatattatgaatggcaccactggaattctgtagtatgcaacttgaaaaactaaacatagtgtctgtatatttttaaccctctatgttggtgattctccaaaagggagcaattaaactcttgcatcagaatcacctggagatgatttctaaaaatgcagcttcttctgttcatttccagatctacctaagcagaatccgttgagatggaacatacagatctgtattttttaaagctgctgaagtcattattttgctaacagctatcttataatatgattcatatatcatacaattcacctattttgcccaggtcattcttaagcatgctgaaccattgctctcttgattgtctttgtgagaaaaaaaaaaggtgtcccctggtcttttctttctctgcgattcttcatggatcaataacaaattcttgcacatattgtattgtacatatttcttctataactttcatcacattccttcattcttagtgcttaatctccattttttcttctagcttgcatgcatgcatgagcgtgcgctcacgtgggcatgcacacacacacacacacacacacacacatacagagacacaaaggcttagagtcaaattgaactgagtttgaattgcgggtctgccacttactgtttatggaaccatgggcaagttaccctttcttgattaactgaaaaatgaagcccctaataccaattttataaggttgtatgagaataaaatggaataaaatgtgagatgcttattatactgtgtgacaaataaggctaataatatgttttcattaggtcgtatgagaataaaatgtaagttgcttagtatattatgtgggacatataaaaatatgttagctataattaaatgagagctataattaaattgaagacagtaatatgtactcccttatattccttgaagttcctaattttaataaatttatcaatttattgattacttactaaatacaagatactgtgcctgatgcagtatggaatataaatataaatattatatgagctctgccctgaaggactttgccgtttatagtacacagataaccaaatacaataaatatttcatgatggaataatagaacaaatgctagagtggattttcacaaaaaaatattgtcagaacacagaagagaaaaaaattttatttgagacaagcactgaatcagatttcacaaagagggtagaatttggtctgggactttaagggtggttgaaacatgtctatggagaaagggaaatggggtttggctgagatatggatacacggtggagagtttgggagggtataggcgagatgggagagtcttgatcttagaggataacacacgacaactcaaagtctttgaatgacattctttaagctattagaaaccactcaagacttttaagtaaggcagtgacatccgctgttccatatctaggaaaagttgttttagtggtatgtggaatagtttcaaggagtcagggataggaaatgaaaacaccatttatagggttcttcggaatattagcaggattgtaaaacagaggttaggcaaagaaggtgcaaaaccatctttcaaaattctggacatgtaagatattttaaagctcccaaaagtgaagttttgtgcaaaagttaggtgttgagctagggcagtaccaatgagaatgaaaagaaaagggaaaagcaagaaatgggacacacacacacacacacacacacaaacatttgagagataattggatgaaataatggccatgccacataaaaagaaattatagtacctgccataataacataaatttattccaaataaatcaaatgagtctaacttggaaaccacatcagtcatttatattattgtctaaaaccttttttgacaaaagtgaacacacatgtcaaaaatgttgatacttctcacttcagaacttagtccattttcacatttattcaagtctttatgtcgcaagtattttatttgtatgtagatttttagatatttatgattattttattttctaatgctgatataagtgaaatttattggtttgtcttaatattctgattttgtaaccgagttctctatttagttctaagtgtttttcagttcatatttgatatttttcagacaatcatctttacatgactgctttaccttttatttttcttgtgttataatattagccaggacttctaaagcaatattaactaatatttgtaaaaatctggctacttgtttttaacttaagctttcgaccactgagcaggctgttttaaataatcttcatttgataaagaatggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttcttcaccagtgtttttaattcccaatatgtattttaaaaatcctagaataaatccatgcaaagtatttaattcttttttttttttttctttattgagacagagtcttgctctgtctgccagactggagtgcagtggcgggatctcgcctcactgcaagctctgcctcctgggttcacaccattctcctgcttcagccccctgagtagctgggactacaggtgcctgccaccacgcccggctaattttttgtattttgtttgtttgtttttagtagagacagggtttcatcgtgttagctacccacagtagctgggactgctaattttttgtatttgtttgtttgtttgtttgtttttagtaggacggggtttcaccgtgttagccaggtcgatctcctgaccttgtgatctgcccgcctcggcctcccaaagtgctgggattacaggcttgagccactgattatcaatttgcctttccaatgttaaatctccaataatttttaaaggaagtattgttatagtgagagacagacacctatgacacatccatggagcagaataatgaatgcaaaaacagcaatgaatttagatccaaatgtaacatattaaaaagatttcatttcaaataagggcaaaaatagtttatttttcaaatgatgtttgtaattatgataccatttagaaagaaaaaagttaggtacctactatatagcatacacctaagttaactttaggcgggttaaaaatgttaatgtaggaaggcagaaggcggagaattgcttgaacccaggagtcagagctgcaatgagccaggatcgcaccactgcactccagcttgggtgacagagcgagactccttcttaaaaaaaaaatgttaatataaaaataaagttgcaaaagtactagagaaaatgttacatgaacattaatatagcattggagtgaaaaaaatgctttaaagttataaaccataaaggaagaaaggcatactggaaaatgactaatgaatttaactatatcataacatttaaaggttgttcttaaatatttgaactactacccaagaatgcccaaagcccgtggtggaaattctaatttttattgtgatatgtttgtcatatttaaatgataggtttttgttttaacattccaaaatgcagctcccttttctgcctttgactgccttctatagaaattcccccagctgccaggccaaatttctcatccagattcaggtactcttattgactatccaatagggcattgatgctgccaagttcgcattaactctcttattagcttcgagaagacttgagacagaagctatcaacacttcttcattggcatctatgtggctgtgaaagatggtcacattttagtcaaaagacataatcctgtccagttatatttgaagagaatcatagctaaagaacacatgccatcttccactcctgtttttacagtgttcacaaatataaaatagttactaacttcttatactctttccacctgtaacataaagatggaattctgcagaaattgagaaagagggcaaaaacgcggattttctgagataatttaaaacagttaagaatctgcagccaataagaatttaactcacaaaggcagagcaattgaaactgtttccggccatcagtacacaaatagcaagccaagcttcataattctgtgtttaaatgcaagagttatttaaaacaatttggttttagtttattttcttacatctcttaattactgctggaaaatattgtcaaggttgggaagttcttttaatcaaagtctagaatattaaattttagaatctatagaggtagaaacatcacaaccatttatttacttttatctttgaataagcattgggaattatgattcctttagttttcttacctgcaaaaacctgtatgttcttcatctaattcaccaaaagtctattattctcaaaattctattattttgagaaataatagaatcaatacaggtcaatttttaaaatgtgtgcaggactcagaaccattaatgtgctaatgtgcattctgatgttccaaggggcattcataacatccagcctgtcctataaatttgaacctagaaccctttttgcatgcaatatctattgagttctgttgggaatattgtattactcgaaacataattttgaaagtgctactataagagcttttagaatatgtggtgttaaaagctgtacattatgttaaaatagctcttgctattaatacatctaaataatatttgttgaggacattcccttgaaggccctgtgctaaatggctttgtaactaaacttctgttctgcttcagtgttatactgtggattatatctgatgttcatgtatgaacataaatatgaccagttaaagcaatttcttgccagctaaaagaggatgttttatgtctgattatttaattcaaaaagcaattcactagtcttacctccttatttgccattgtacatgtggttaataagtaaaatctgaattcctaacaatgtcttttagattaatatgttttggttattgacacttcatacatttttgatatggtcaaagttagttcctagatagggaggagcaggatttttctcctcttgcttaactggtttctaatttcttgtgagattcctttatgtgagtttcaccatactaaaaatggaattattttaaaaaattataaaatagagtccccttctctattttaacaatcaatgtacctctgaatcaactggttattcccgtgatctgtgaagtagttaccgtgcttttcaaattgtatttcatgtgtgttcaaaatgaaggataatgactcacattataataaatagtatgacatttatgacccacaaggaggaggagtgtacaaatgaactttaagggttttaccttgaagatttgtgagatacaaaggcacagtttttctaaaacaggaatatacctcagctgtcaggaagaactagaaattatagttctgccttattgggatatagcatgagtccagtgacccctgttctcattgttcatctatctccaacacttcttgttaagaagacacaattaggtcagttttcaatgatccaatatggaacacctctgacaaacgaggtttcaaatcaaggtatctcagacagttggcctcctagcgccctgtcatccctttggcttatgcccaaattcagcccagagccaattagtggatcacagcctctagaatggcttcactctgctcacactcaacaagatccagacagagctgctatgcaaaaaaaaaaatgttcacagggtcctttcgcagaggggcaatggtttaggtactttgagacttcatggcgcatcaagtacacacatgttgaagtaatgcaagtgagaaattttgctgacaactgatggaaagtaacatttaaatctagagctctacctttgtgggcagcctgagacaaccctagattaaacattttaatttttctatttactgtttgtaggtttctgtaattcactgagcctgttctaatatgtacaggtagatatttgcacctagaaagcatgcatcttggatatttatcatatataaagaaaaaactatatatacagccatttaaatatgctacaaatagtaatagaacactaataaatatgtacatgaaatgagtatgtgtttatccttaaattagtggtttggttttcaacattgttttattccttgacactgtccccatgacccatcatgttctgatcactaatattctctttgaccaaaccatgcttctggagtgggggccattggtactagtcttcatgtgtggggacaaagggacagagttttaaaatatactgttgagactttttccagattagagttaatttagctaatgtcatcaagaccaatagttgttaggttaaagtggggaatcattaaaaaattgcacacttgaagtaaacattttacttaaaatatacaagtacattcatttattaaccttttcttctagggtcaagaccttttccttaaatattggattccttagtgggcttctaattctttcttaaaaaaaaactctacccatgatgcatcatctacaatttccaatttcagtttctctaaaggagagcaaaagcataacggtaactctaaagcaatatgcatatagaaaacttatttatttttttacttatccccgtctttaagaattgactcatccacacctaatttaacagcagttgttttagtgactcattttaacccattcttttcaaacgttttgtcttacttttaatagatacaacctttttttgcactcacattttgttcttttgttcaatttgtaattgcataattacattacatattaaactagtatacatagattctggaataaacatgccagactactattaagtagacaactcactggtcaaggaagcatacagaatgctgagggaacaaacatggcctttaatccagcaagtctgttataaaaaaaaagctcactctcaaagcctccttctggagttcataataaatgcttcccagggaggcagtcctctgctctgctttcctacttcttttcttctttgaaggtttccactttaaatcaggcaatactgtctgttgaatactgtctttctcctgaatgaattgttttcttcttcctgtaaaaacggaattcaggatagttttagccctttggtgtgccctatttattgagaaggacattttctgttatgcccagaagtttaggagccttgcatggctcgggcaagactgaagaagcagctcacttcagcctgtttctctactttgtcccctttgtgctctagcttttcactagtggaaatcgcccactctatcacaaatgttttcagaggctacaatccaacttaaggaggataagctatgagcaacttgaactataataatacatgaacatcttgaactataatagatttagaggaagtccaagaagtaacaatcctcaaaaaaaaaaaaaaaaaaaaaaatcctgaggcagtctaatggcaactggccaaagaccaaatcaagatattaaagttgcctgatttagcatccctcaggagatatgcttccaccataccctatatgcaaacaacaacaacaaaaatagagccataaatccccatcctaattgtacaacaaaatcatctgtggaatttttaaaatgcagatatctgggtcctctctaacaattatcaaattgagaccttccagatcaggggcctagatttaaaaaaatgaaaaacattatgggttattacaacggtcagttacatttgaaaagtcagtttaataaagacatgaaatatatttgtactgttggaaaagtgagtttctaagtgatattttcctccttacatatggatgttccttttagtctatgatagcttctaccttaaaacacaccttctgatgtgaatctgcatggggaaaaaagtggtcggctcagtgaatgggtgacaggcaagcagcctctcctgggaggttctttgctgtttcctctggacccaaaagagtcctcttgcttaaaccagctgcttctcaaaacattaaactgcacaaggatcatctggggatagagtgttattaaaagtagatgttgtttcagtaggtctgagatggggcttgaaattttgcatttccaatgagctctttgtgctgctccagagaccacattgtgtagccagggtttaagccacattaatccaccagttttcaccagctgcaactaattgagtgtcaaaatttaggtctacattgtctcttttccatttacaacttctaaactttattaaaatccatgaattattactctaaaaaggaaaaaaataaataaaaagaaacccttttcactttaaacaaagagataatgtgtaaggtgtgttcacgctttatggtgtaggttttttgcctgtgaagaccaggaagtgggtcggctcctaatcaagatcagatcaggtgattccataatggaactaaccacctacagtttccccaccaggctcatgtcagtaaatgccagtgacttctttgtttcaggtttatttgctaactgtagatgttgcagatgattggttagtgtgaaagcacaaacatggtgaaaataaagaggacattttacctttcttctaatatattatatttggtgtagcatttctagtttaataggaattgtcctcttttatagtggaatgagttttggactgaattctaaccaagagtgtatgaatccttcttaatgatagctgtgttatcatgtttcctcatagagcataaatattttagcaaatgttgttactgagtttgtcttcaagcagcccagtgaatgtctgcacccttgagtattaaggaaaaactcattcttttcacttataaaaaggcatatgatgtagagaacattggaagcctatctcaaatcttaatctgctttccctgagatcccatgggacgtatctgcaggcaggggggtggaatttactctcaactttattgctgctatctggtactctttgtctgcatgtagccaccaacttttatttatgagtatttgctggacctcatgctaggtccactgatacagcttacagacttgagaaagatatcctgcctctaaggagcttatagtctagtttatctcaatttatacaatttatacaagcaaccgagcagaaaattttacagttaaacgatgatgtgttgttttaaagtactttcaagattcattgtcagtttgtcttcatttgcatttctggtaacaaagacagaaacagtatagactaggcaataagtaagtgacagtgtgctgaaggagaaaatgatgacaaagaagatggagttgagatgatgggaattctaataacccatataccgtgtattagttctttatttcttctacaaacatttactgaacacctacttaggttcagccaaaaagatgacagttttatgataacagtatgtttccagtacagtataattgttgtcacaatgagctgttcactaaagcacggacattctgtcatctcatctgtaaaaagtagataataatatcctccttatcgaaaatcaatgagctggaacaagtgatttctagttttccttctatgcagtaatagctaagagggggagaaaggaaatgagaacaaatatgagcccgagtttacaatgtcttcctgggacagtatcagaaatgaaacctaatttgtagtgtctctgataaaacatgagcttcatcttctccttcttcccccaaaagatatcaattttcattttaccagtttacccctactagctggagctcagaacataggcccacatgcctatttctgccatgagcagaacaactatatttagatattccagattgttcttattccatagaggcccaatgaatttggtaactaagactgaatggaacttggtatctcatcagtgcctctcaaagatttcctttcacttgtttcttcaggaagacaactactagttggacacataaaagttttaactgtggctaggccccactcttctctagttcccattggaactagaaactgttgtaagaatgactccaaggaacattaaagacattttcagattgactttgaaggcacatataagtgtgttcaatgactttgtaatttggggaagactcttaaactccctattagcagattatcatatataacatatgaatagacctgtttgaggatgtaatgagctcatgcatataaaataactagtaaagtgacctgtacattttcagccctcattgtaagcgtaattatattatattattcatcttttgtaggaaaagttttattgaattggagaacaacagaagacaaaagcgttcctcctttccctttctagatttgtatatattacagaacacacataaaaatggacatttctctgcagattatcttactgttatgtataaaaataataaattggctctctgcctatggagcagacattcttttgtttctttacttctctaataaacttgctttcactttaccatagatagcaatagtaataagtcatggagaaaattaataactacttggactttctacgaaaatgtagggaaagtgtatatagatttttaattgatgttttgattccaaacaaaagaaaaaacttcttacaaatcatttaatttaaagctaaaaattgccttagatcacacatctgtcctggttgtactaggaaaattgatataaatattctcatggctgtcacacacctgttcttcctaaggcagttccatctgaggcatgatattaaaaggaatcagaggtgctcaccaagcaacataacacccttgactaagacaccaacattgtgatgatgtgtgaaatacttacatttctctatggctgccatagtaccttatattggcttcagatctttttatgtttgtgatctctttatccatgaaatctagtttatttgcccccttttgaaaatccatcccctatcctcatttttaattcatccattcttcttcctattcagagtaacctacctctcttaccaagggtgtggccagatgtgatctttttttttcagggccttaaatccagcaaattatgtcttgaaataatgacacgtcataaagtcacttaactttttttccgagtccaccagttctttttaacgtttttcactgtctaataaagggtctaaagccctgactggaatccatgcatggaggtgtcaaagcttaccactgttataaaaatatttccccctacatggcatgtcttcatttgggcatgaatcatgaattcatcccatgcgttctcctttatttcatgaacacccaactgtgtcagaatgccaatgaccttcattggcttggctaatctatggatctgaaccctcctgtaatccattaaaagaataatagcaaattgaaagtgaatgtaaagatacccaatgggaccataaaactaactattcaatgtgacgtgctttggcttaatagggcttttatttatttaatttcgagctccccttggtttctgacagggttagtggaggaaacaaacccagacatcttgtaagctgtcaagctgatactcatctcaggggagcttagagggtatcatgttttaagttttatttttctggagcttggaatatgtctgctgacagacggctcccctgggttatagcaatgcaaggctgttgagacaattgaataagctgaattagacaaaggatttttattacaataacaaccagatggaactttgaaggaaatttttttttaaggtcttagaagttctgttacagaaatcatttaaaacatatttatgggctgggcgtggtggcttatgcctgtaatcctagcactttgggaggccaaggcaggtggatcacttgaggtcaggagttcaaaaccagcctggccaacacggtgaaacccacctctactaaaaatacaaaattagccgagtatggttgcaggtgcctataattccagatactcaggaggctcaggcaggagaatcacttgaacctgggaggtggtggttacagtgagccaagatcgcgccactacactccagcctaggcaacagagtgagactccgtctctaaacaaataaataaataaataaataaaaagatatttatgatgatttttcctattataaggttaaaaaaaacaacataaagatctcattgctctgttttttttaatccctaatgattaatatgtggccagttacagagactcttccagccaacccgtgacatatacacattaataatgttcttttgtatttgcagatcttatttcttcagagtaatggaaaatcctgcccagtactgttctattaatcttcataacgaatgctagggggctaggtgggcggcatttggtgttatccacatgtaatagattttttaaaaatggggcaatgaaaacaaaataagtcttgaaacttgttaacacccacagtggaagtttagcagtggaaatgaactaatattaccagaagacctcttattctctattgcttttcatgattagctagtacatttattatttttctcatgaatgacaagattgcctgtaatgtatttgacatgtggtagttttccaatctccggcaggctgtgtgcatgggtgtgtgtgtatgtgattaataaatacttaaatattttttatatagggattgttttgccctctagaggcagctcaatagaaggagcattcaatgttagtgattgaaaaatggtagatgaaacttggacaggaaaactcgagaggtccaaggtaccttatttagctactgctgtcacggtggatcataatgcagtgggacagtcaggactcaaagcctttcctataaccacatacgatggatattgagcacaatacagaagcaaaagatttgttttaacttggatacttcaactgcaagcgtctctgggcctgatatccagttcagaattcactgtactttttatttcactatcggctttccaaaatatggtaactaaatgagtaaatgaaaacatggcaatacaaaccaacacaagttcttttgctgacagagcatgcaattgccaagtaaaaatattgttctttattaggtttcttttcatcgtacatgtacatattcatttggaaacacatttttttgagacataatcttgctctgtcacccaggctggagtgcagtggtacaatcatagctcactgtagcctcaatttcctaggctcgagggatcctcctgcctcagcctttcaagtaactagaactacaggcatgggcacttgccgggctaattttttaaaattattttttgtaaagactgggtcacctcagccttccaaagagctgggaagagctgggcatataggcaggcatgagccaccatgcccagtctacaaacacattttaaaaccataggccttctagttttttgttgttgttgtttaggttggcttttgacatgctacttattgcatactagtctgtcatgttcctaaattccagttactcctgtagccatttttaaagattattttttaaatttttcttcctcctcctccacctcctcctcctcctccttcttcctcctcctcctcctccttcttcctcctcctcctcctcctcctccttcttctcctccttcttcctcctcctcctccttcttcttcttgcttctttttcttcttcctcttcttctcctcctcctcctcctcctccttctttttcttcaggcatggccttgctctgccactcaggctggagagcaggggtgcaattatggttcactgcagcctcaacctccatagctcaatcaatcctcttgtctcagcttcctgagttgctgggactataggcatgtgtcaccacaactagctaattaaaaaaaaaaaaattctttttagagacgatggggccttactatgttacccagactggtgttgaactcctagcctcaagcgatcttcctgcattggcctcccaaagccctgggattgcagggttcccaagtggccatatcattggatttgtcttcagagtgatgtacttgtgaaacatggatatgaacagggatagagggcaatagcaacacatgtttattaagcactcattgtatgccaggctaagcactttgtcacagagagcctatttaatcctcagaagaataatccaatgaatcactctattttctaggtgtcaaaaccaagtcttaaataagccaagtaacttacccagaatcatatagccacagaaccgagatttgaattcatacattatgacagagtcagataagctagccatcctgcccctacctccagttccagaatcagtgattggctttggtcttactcagcactgtcagttacagaaattggtgtcatcagattatctgtctgcctaccacctctggagcatggcaattacagcatcattgatttcgattgtcctaaaatggaggaaaacttgctgctggcaaaaggaagacccataatcattcatcagctcaataggcttgaatggctaaagtgctcacagccatcttcctgtctcactaattgctgccatttaaagataaagggggaagaaactaccctttacttcagtttacaaaacccaccgaagttaagatataccaaaggatgtatccaagaacccagaacttctggatggaaggttctggaattgaatcctcatgccctgcagtataacctccatacacccacatggcttgggcctcttagttttgcttggctgctactacttttaagtaaaaaaataaaaattggttatgcagttttcagaatgtctttcatttcaaatacattcttaatccatcaaaagggacattctaaataaagacttgtctctacatgatgtgttaatgaagaatggcaggggcaagtaaaacaaaacaaaaagctatgtagtgaggttctttcaagccaaaccacagctgtttgaagaatgacaatatgatatcatgcaactgccactatccctcattaattgattttacagatttttaggtattcactgatgtgtcttgtacttatggctgaaaatgcacactaacaatctgtagcaatgttacaacacagatagcatattgtcaaatgctgccatggatgaaaacttctcatttgctgtggatctgttaagataaacctcttgagaattacagatacatttattattggcattttcaaaatggcaaagacatctgttgctaaaagtctctgactggaaaggatttgggaccaagggtaaggttagctaacacttcttaaactagacaagtatgaacagtgaacatctgaaactacctgtgaccacagagcccaagtaatgtttaatggaggcatacatctttaaccattcaatataaattcaacctttttttttttttgagatggagtctcacactgtcgcctgcattggagtacagtggtgtgatctcagctcactgcaacctctgcctcctgggttcaagcgatcctcctgcctcagcctcctaaattcaacctttttttaaagttttcctcattaactgaattgggcacttccccccctataatctcttacataatttgttttaattcttttgacgtatgcattacataccacccttgtattggaactatgtatgtatctctttttcattcactcccctttccttccctgtcccattccttaagagaactgttatcttccatgagggaagcactcctgcaacttttacgtgtatgtgtgtttgtcaccatcttctaccacgtattaatgtcacatattaatgtgccagcccatattagtgtctcattctatgaatgaatgaataaattaatgaagaatgaattatgtatgtaatgtagttcaacttactacataacaccaagtaaactaaaccatccaagataagtttttgaatcaaagccaccatcctactaataaatatggtttcttttgtataaaggtgctagaattcctagccaaatattttattagtgttctatgccaaaacttccattcatcaatgacttatttcaatgataattacttcaagtctctgagtgtaggtatcagatgttgaatattagtatcctggtgctcaaggagtctttcacaggcttttacatatgcttctccatgtgattccaattttagcatacaaatcttttatttactatcaacctacttagtctacttgttgagaaaaaagtgttcatcatatttcttgattctgcatatcttatcaattgcaatttttctgctctattaatgtttagatagagaggaaaattagggaaggacaccaatcctgtgtgtaagacaaaactggaagtcattcacaaatacaatatgcatcaaatgttttcttctgagtggttctatattggttctaaatataatagtaccagcttatatgaaaagcatgagggattggcctcaccagtttttatcaaatgtaagatgctattaatttcaagatgcatcactcttttatgaaccacaaaggaagaaaagaaatgctgccaaattaacaatgatgttgttgatcataagttatatcttgatttcagagatattaaaatgggtttagaatgtatgtcttagaatagacgaaatatagtatttgttcagtaagtatggagtgcattctcaatgctctattactttcaacattgatatgcttcttttacaaatggtgaagatatgatagggtgtttgtgacacatgcttttctagcaatctgtctaaaacctagcatgcattgcaagacatgtcactgcaactctgcatgtgctaccacagctttccagaaggtaacatgcatcccacaaagcttccaaatttcttttcagaccgttttattggcctgatggcaagctaactcaaagcagtttgccatacacagaacacattcaccaaccttggtataatgttccctccgcttctttctaacaagtcacattttgccttttaaggttatccatcatccagtgttttaaagcattttgctttcaatgaggtggcacaaaaaaccatatttttacaatagccctaagttttaatggcaggcaaagagaatatgactacatatctcagcagacaattagagtaaggagggtgaggtaagaagagtggtgcaatggaaccgtgaagatagggagccctgaccctttcattttctgttccgtacatatttgaccttcagtcctgcaattgcagaaaacaaactgcccaatcttacccatgggacattttgtaattactttcttgtctcttctcttatgggtgcattgactagcacatagtacttctgctactgatagctcatatttatctagcactcattatgtgcctgacagtattctgtttcacatatattaattaaactgattaactttttaaaataaactttttattttgaattaattttagttttacaaaaacattgcaaagataatacagagttctcatacattttttatccaattttgctaaatgcaatgttaacgtattatacaactgtggtacattcgttaaaactaagaaattaatattgataaattactgtaaactaaactccagacttcatttggatttcaccagcttctccactaatgttctttttctatttcaggatccaatccctgttggatccatattgcatttaattgtcatatctccttcacctctttggatctgtgagagtttctcagtctttccttgttttccatgactatcacactatttttttcagagatggagtctcattgtgttccccaggctggatttgaattcctgggctcaagcaatcttcctgccacagtgtccctagtggctccaactataggcatacaccacacccggcatgactatcacacttttgaagattaccgattgagtattgcataggatatcctttcatttgagtttgcctgctgttcttccgatgattggactttggttatgggtaactcatccacttttcacaacagcctataagacggtactattatgattctcttttatagatgaggcactgagggagagaacagttgagtaatttgaaggcctgggtgcttgaatccagagggtctggttatagacctaaagctcataatcactatgttattattgagttataatttctaaatttgaatcttgacacactacatactaactcatatttattggtatcagatcactcaactgtgaagcaggaatgatcattttacttacctcatatggcaatgcttagcacagtatctcggtcacaccaaatttctggaagatgttagctgttagttttacttaactgtttgccattatttttcaggaagctggccatgttaattttctgaactgcacaatcacaattttgtgaaccttaaggtgttctgaaattacgggctcgttgattctgccctttgtcttgcttctcaaagaaggtgtgctggcactccatttaagtgctttatttgtcaggagaaagtgctcatttgaatctgaaaagcaatccatgtacaaaggaagaaaacttggaaaccctgatagtctctgcatgtttgagaatcaatgaaaaaagtaatgccactttccacatgtgcttttagaattctaggaatagatcagtctcaggttatactacaggaataatatctttaaataacaccatagaaaaacattccaaaattgtttggtagtggactgtgtctacacagatacttatacatgttttttggaaggtcatattatgacatatagcaatatcagaatttctacaccaatagcattaaatgataatccctctctgtcaaaccggaacatgtgttgtaggtaagcatgtacataacagtgtcgatatctttgcctgaagtaagaatattgagggaaaataaaagcgttatgagatgtgttcctttcattttaaaaaatgaaaaaattactccaaaatggtgttatggactcaacattgattctcctggtttccaatcccacacaggttgagttcttactacaacaaggcattttccttggtgccatgtcctagatcatacttttctgtttaatgcagaattttcttccaggaggctagaatgcttggaaaagtgtttgtcatatgtcggaaagtgagcattttctcttatgaaaactattcgtgcttttatgtaaaagtattgaaaaggaaacttcacaaaccataagaaaatacctgaagaggagatagaaagcaatccggctggggatcacgtagcaagtgtcttcattgggcagggtagaaaccttggctaccttttgctgctttccaactctgaaatcctaagtttctctgatgttaagttacctggttgtaattataaagtgcttatcattcagacgtatgtgaaatacttggaagtcagacttcctgccagtgtttaacactttggaaggatcaataagtaggctttattcagatattccaaatggccaccttcttggtgtcatgtgacgctatgtctgtggcctataatacatgtagttgtgattaattgacttttgtccagcatcctgtattttcggctctcttttagcggtggcaagcaatggaaaacattatttctttgctcagatttctcactatatgtgtaaaaaggtgatattgtgattccatgtttccaaatgagtgagactctatggacaccttccatatattccctccatatcaggagtaaagaaaggtatgtcccaatttaaatgggaatttagcacctctattaaatttttcacacagcttccattctgtatttttatgaactataccaaatcaaacatatttatctttttgttcagagaaatgaacatgaactccttatttctgttaaacctgcttttcttgcagtcttcactgtgtcgaggatgtctattccatcccactagttactcctagggaaaatcttggggtttaactccttcctctcacacctcacaccctaaccatcaacaaatcctcttagctttacctccacagtatgtccagaattcagtcatttctcgtacctctcttacaagcacccagttaaagccaccatcttcacatttaaaattccctgtgttagcaattttgaggtatacaatacattattactaactatagtcacctggttgtgtaatagatcaccagaatgtattctttctgtctaactgaaattttgtaccctttgaccaacatttccccttttcctaccctcccccacccacctcagcctctggtaaccaccactctactcttatcttgtctgaatttgaattttcagattacacgtgtaagtgagatcattcaatatttatcttttaaaaaaattttttttgagatggagtcttgctctgttgcccaggctggaatgcaatggcatgatctcagctcactgcaaccgccgcctcccgggttcaagcgattctcctgcctcagcctcctgagtagctgggattacaggcacctgccaccacgcccggctaatttttgtattttttagtagagacagggtttctccatgttgtttaatttttattttagttcagggatacatgtgcaggtttcttatatagataaacttgtgtcatgggggtttgttgtacagattgttttgtcacccaggtattaagcccactacccattagttattttttctgatcctctccctgcttctatcctccaccctctgataggccccagtgtgtgttgttcccctttatgtgctcatgggttctcatcatttagctcccacttataagtgagaacatgtggtatttggttttctgttcctctgttagtttgctaaggataatggcctccagctccatccatgttcctgaaaaggacatgatttgttctttttttatggctgcatagtattccacgttgtataagtaccacattttatttatccagtctaccattgatgggcatttaggttgattccacatctttgctattgtaaatagtgctgcagtgaacatacacatacatatgtctttatgatagaaggatttatattcccttggatatatacccagtagtaggattgctgggtcaattagtagttctgtttttagttctttgaggaatcaccacactgctttccacaatggatgaactaatttacactcctaccaacagtatataagtgttcctttttctctgcaaccttgccagcacctgttatttttaataaataacagcacctgttgagtttttaataatagccattccgactagtgtgagatcagttgcttttggaattttcatcatgaaatctttgcccgttcctctgtccagaatggtattgcctaggttgtcttccaggaatttatagtttggggttttacatttaagtctttaatccatcttgagttgatttttgtatatggtgtaaggaaggggtccagtttcagtcttctgcatatggctagtcagttatcttagcaccatttattgaatagaaagtccttttttccattgcttgttttcttcaactttgtcgaatatcagataattgtaggagtgcagctttatttctgagctggtatttatctttctgtgcctggcttatttgacctaggataatgtcctctagattcatccatgttgttgcaaatggcagattttcattcttttttaaggctggatagtagtagttcattatgtatgtataccacatttgttattcattcatctgttaatggacgctaatgttgtttccaaatcttatcatgtctctctccatctcccttagatcaaaattcaaattctgtgtaacatatagaaagacttgccccctttacctgactgagagcatcacctctacttctctcttccccctctacaccagctataccacccacctcactgtgtttcaatatactattgttctcctgctcagaagctttgaaattgctattccctctttttgaaatgttcttctccaaggtattcattttcagagtttgctccctcactttattcagtctcatcagagaggcctttcttgactatccgaaaccaaataccgctgcctcccacttacccctcagtctccttattacgctttgtctgcatatcgcttaccaccacctgttaaaagataaagctgagctcattaaacatttaaagattttatttgagcagactgattcataaattaggcagcaccaaatcacaagctgtatgggctccaccaagaaggtgtgagaggaaaatttttgtaaggtgttctaggaagcaagacaaagaaaatatttgatttattgaagtggaaagtccctagttagaaattagttggcagtttcagattaagttaaatgtttacactgaattgggttttggtttgtctacataggaacccagggcactggagccatctcagcctagtggcctcccaaattattttttttcgacacacgtgacatactattttattttctgtctttatccattacaacgtaagttccatgagagcaggaatgtatctgttccttttgttgccttatcttcaaaatgtagaatagtacacaatacttaataggacattaataaatacttgttgaacaaatggaagaatgactaaatgtgattgaaaggcagactagtagtaaattggactaggtcaaatacatgtgcagaccagtgttcaatagtatgtagcatagtttatatttacacatattcaatatttagcctttcaaaatgttttccagttacctaaatataagtatttagcattataggtggaaatctgtcaaattattttaactcataccacatttgagaaactgtgtggaacctttactattcctcagttttgtttttctataaatataatatatatttccttttcctactgaatgttcccctcagtgcaatttttttccagctattttacttgtagttttgatgtcttgctttgtttttacctatgaagtctaatgaaagtccagataagagcctataattctatccatataattcagtaacttccagaacatgttttatctgtcagactatggttcacattatcgtaggtgtaatgcaaagtttagagctgaaaatgtagccacgttcctaattcttgctctagttatcaatgtcaaatgcactatcaataggacttgaaaaacatactcagtaatattggatgggtactgacattctctcaaattatagtattgagtgcgctatactaaaaatagtaaaaataacatggcttagacaagtgagaaaacaaagctatgtcctactttattttgagaagcaaaatacaattttcctgtttgttttttctttttctcaaaacaactaaaatttgtaggaggataatgtttaaaatttgttcacatggttaaaattagaaaaataaataaactgacatgaaacatacattaaatttaaagattcattgttttgtataaacacagtgtatagcttataagtcattatgctattagattgactttttaacttacgagaaattggcattctaatttagatgcatgtatatgacttcccatgtctattttaggatagatttaatcataaaatgatttaccttgggcaaattacaataaactcacttgagtaattaatcgaggtgtttcaaggagttaatttagttcacgtaaataagaacgttgtttcaaggaatcatttaccactctgtattgccatttggcctagactttttccattttacatccagaagacaaactgttgataaactatttgttatttttttgctaaaaattgatacctttagtatagatagtactgtatcagaaaccatagaaactgatgctttaatatggacatgaactcattagacatagaattttggtcagtctctagttagaatcattgcttctatttattttcaagtttgtacctgaggataattaatattattgaaaatgggttaatttgcaactgaccttgaatcacaaagtggtaggaaaggagatctcttgttttatttatttatttattaacaataaggatttgggcattgtcatatgcattcttctgtagcttacaattaccacaacacttcacatcaataatatactggtgctgatttagtttaaatctttcatatacgtgtttattgtaaatttctttgagtaatgctgggcactgatattaacagaggattaactttatggcacattttaatagaatgcacaatattacttccaccaaattttcttcttttctttgtgaactgttattcattttcagacatgaagaaagtatttctttatcttattttattttatgttccagggtatatgtgtaggatgtgcaggtttgttccataggtaaacatgtgccatgctggtttgctctacctatcgacctatcccctaggtcttaaacccatcatgcattaactatttttcctgatgctcatttcttagtagacatggcacttcaaccattctgaagcttaaaaattatttgttattttaagcccgtaagagcattttaaaatctgatacatctgagcagaaacttttggtttttagtttttttataaattaaatgaaattaacacattaactatttcaagcaaataagatccacttacataaatgaccatgttagtttgagaagttatagcttactgatctgaaaacattaattgaacctccaaaattatacccgtggggtaatttctatcctcgcagcggtgtgcactttaggacaattaaagtgccaaaggaatctcattttatttcttggttattatgtctaggtaaactgatggctcatttttaagatctgtttagtatccaatgattaaaataaaaatgatgacctcatcatgatattcacatagcacatttatccatttctcttttgatttatagcttatttttacctaatgcagtttactcaagtctcctgggcttatacattttttagtctttgataatctatactaatggaccacaagggtagcaatataatctaatgaagtggttaacccagagtcttgggagtgaactattgtggtttgaagcagatcatgtttgtttggcctactttttttttttctttttttttcttttttttgagacagagtttcgctcgtcacccaggatggagtgcaatggcacaatctcggctcactgcaacctcggcctcctgggttcaagtgattctcctgcctcagcctccttagtagctgagattacaggcacctgccaccatgcctggctaattttttgtatttttaatagagatggggtttcaccatgttggccaggctggtctcgaactcttgaccccaggtgatccgcccgcctcggcctcccaaagtgctgggattacaggcatgagccaccgtgcgcggcctgtttagcctacttttatgactgattcacatttattaaatagctcctagctggatggatcattcagaatggcatagatctgagtagagacttggagactattagcagagctagcttctaggaatagaagtagaagtcaaatatttaaaataatcaccgtgaatcaacatttggtattacctgatcattctcaaaaccctgttccctatttaagctttgatagaattatatgttaaatattcagatacgttatgtaaatgacgaccaggacttagaagttgtttattattaccttcctttatgtggctactaagtatttctgtccatgaaaaatgactgaaatcataatgttaaaaataggaaagaggccgggcgcagtggctcacgcttataatcccagcactttgggaggctgaggtgggcggatcacaaagtcaggagatcgagaccatcctggcctacatggtgaaacccccccgtctctaccaaaaatacaaaaattagctgggcgtggtggcacacacctgtagtcccagctactcgggaggctatggcaggagaatcacttgaacccgggaggcggaggttgcagtgagctgagatcacaccactgtactccagcctagcgacagagtgagattccatcttaaaataaaaaaaaggggaagaaaatacacttacacccattcccaggtaaaatgtcacatctctgtttgaaatgctcatttgcatgaatacattatgaattgcagttccaatatatacatttctgaatatggaaacctcaataatattttctctttgtgttttatatttagtactaaaaaagtgatttgtggctaatataacattcaattaaaattaacatttatcctaggggcattccaggtactacagtctgtctcattcattagagcattttgtacttatctgcagagcatctctcctcagaagagaatctgctgaatttttgcatcttatccagcatcaatcactttgattaggatctcactccatgaaccaggcagcttctcttccacagcagttccatatgtctcctacagctgttctactttctaagtggaacgtgactctcttcagctcatagtttgtgtccccatcaaaaaagactgtcaatagctcctttattcttttgatttgctgtactctcttatggcttggaatatgacttatagtcagtattgaattaggatatgttcgattaagagaaattgtgtccatgaatgttttgataagtgaaatatttacatcaaagctcatgctaagaaactatttgaagagcaaagacagagcagaaactttgcttgtgaaggaatttctccagggaaattttcaccgtgcaactcggtggtggaaggctgccataattttggtttatgttaatagaggttaagttgatttttattattttctttggttggtttataatcagcaaattttatcttggaaagtagatttttttttgcccaggtactatgtttgtgtgttagactatggaaagccagaacaactattatacattgactgcaaagataacagaattttgtgtgtgtgtttgaaacttcctttcaacctcaacacccgaaatgtttgctgcaataccttttctatatgaaaaccatagaataaatagaatggaagtaaaactaattcagaataaaagaaactatcatttctacaaatggcaacctcatttatttacacctaaaactatagttttcatagggcttaatgtgaaaagataaaagaagtgaaaaggtccttgagaaaataatagagtattacctgaagcttgctgagcaaacatttttggggaatgacaaaaaaagcttttgaacatgaacttctgggatttcaactgaatgatcaagcatgaagaaacttgattatcctgattaaagaataatgctgggaagtctttgcataatttgataatatttttagtatgagctgatgtctttaaccaaaatagctaccaaaattttagaaaacactatcacaccatgcatgttgtgaatgaaatttttatttactcacttgttgatttgggagagctatatgaacaattattatcaccaatagtattcatggtcttttttaaaaaaagactaacaggtcaaagaaaaggggtttaatggattcccaattttagtatgttgtacccttgagtatcagatgtctctgttcttagcaactttccttgcttgtggaaatctagaaatggtttactcaatgtcagttgatcatgttgttttatctgaaaggcaaaaacactaggatactttcaacttcccatagagaattacacattcaaactaaagtctagttgttcaaatggaaaaatcgagaggcagacaaattaatgtaattatagacttggtagggtgttgcaaatgaataagaaactggcaatttgagtagttaagaaccattgtatattttattatagctgtaatgttttgagttcataaagccatattgaagtaggaatacacacatacactcatttttagtaagcacaatagaagtaagtcatttcattatcattttagggctgattcttacactttttagcccacaattccgtaagttgtctaattcgactgatacagaccagttctagctaccaaaatattatgtgcacaaaactccctttcattctatttttctgatcacaatatccatgcccacaatatagctaattagttaagtgtgggaggaaggcttttgttagaattcttactccaatggattaatcattggaaatcctcaaattgcctgaagttgttagcatattttaaaatcaccagataaatacctaactagaacatcagataatacatgacaattagaattattctagcgagctgtagtcacatctgaaagttaccatattcttgctcctcaaacaccttaaatttaaactctgatgaaatccatctgtaccttctctaatatctccccagatagtcatgaggagtaaataacatactacaaaatgttaaaatatttcaaatacaaagttctatagaaatgttacacagtgctattatcactatttctcaattaaatgtacattttaatattaaatgttactgctaaaattattttgatagtagttatttataaacattcactattagtaatagccaactattatgtatggttactttcacttaggatgaaataaaaaatattggcttatttatatatttcagagtatgttctagattcctataatggggttctaatggggctaaatatgtcaaattcttataatatatattaaatgtgtgactacagcagtgccttttaatgtgggtcttcttttagtatctgaagaaagctaaccaaattttccattgtaaccaccaatatcatatttttaatattagaatataatacttaacaaatacaatagttaaatgtttatttaatactaactaaacattgaacaataattcttaaagagattcacaaactataaaacactataccagactataaggtgcttttactaatcaatttggaaaccataacacctgtctgatgagcatgcttattttaaaatgaacagatgcagggtgtgataatataccagattaaagttatgagtgaatagatttccttgtaattacaagtcatatagtgaaggtatcgatgctatatatatttctgtcaatgaagaaactgtataatttgaagtgttttaattttggggggatgggggacggagttttgctcttgttgcccatgctggagtgcagtggcacgatctcagctcactgcaacctccacctcctaggttcaagtgtttctccagcctcagcctcccaggtagctggtattacaggtgcccaccaccaggcccggctaatttttgtatttttagtggagacagggtttcaccattttggccaggctgctctcaaactcctgacctcaggtcatccgcccacctcggtctcccaaagtgccgggattataggcgtgagccaccgctcctggccacgtgttttacatcttatttataaactagcctttggaaaatgggtaagaactgtagtgctttttgttggtaatactgtgtagttgttctttagttgtcatttcaaaaccaaagctaaactgtttacaaggaaataaaaacttaacctgtgcacaaatttagcattatggatttacatactaccaagtactagaactttttcagtctcaaaaactaagcccttttgaaatttagctatttaatatcaggaattctgaaaacaagggatatgggatgtaaggagaaaattattcctattctatagactttgttatgtatgttttaaaatgtaattaatatcaacgtaatattgtatctttcagacactgacttccatttcctgattggttataggtaatttgaagatttttcactataccagtagagatacaaagtaaaacacaggtatagtctcctagaaaattaaataaaataacccttgagtagacttgtaaggtgacatagaaccagatatgcctgtcttctgttttgctaaaaagaccttgtttccaagtgttattgaaaagtgtcataatgaaatcagaatttaatgttatttgccctggcaaaatcatgtgtaatggtaatcataaatcagttaaggagtaatacaagatgttatgcaaataagcactaaagtttcacaccaggtaaatggctgccttcgtgagtcagtggtgaaatggtaaggttctagaatatggatattgcaatggacattaaaagcaaaatgcgtagagacattttcttaaagtagtaattaatggtacatggaggtgtgcttaatgtgaaggaataataaaagcaataaaatttcaaacaataagcattcatactgatttgatttgtgcttgtataattctctttacaactctatcatatatgttcatctatttattacattttggatgttactgcattcttgtcttagtttattaagcttcccttttaatatttgcctttattttaccctcttctcatattatgatttccttgatcctagcttcttttttcaagtccatgcatcttagtatttcatggctggcatcaggaagttttctaaaattttgtctggttttcatggaaaaaattgcaaagtctcatttattttctaagcttcaagacaagtgtatccatatggattcagaaaatttctataggcaacttctattgttcttttcactgagccttaaattagaagagctgtatgtagacttagtgttaagtacaattattgatgtactgaccttcttctcttatttttcttcataagtggagattgatatacataatctatacctattcccagtaccgacttagcctttacccagcactgctttcctgatggatgtggagttttctccaaataaaactaccatatcttgtaaccatattaaaaagtagaagcattctgtatttatattttaacttaaatatttattataaaaaattctaaatatatacaaaatagagaatgataagtgaagattcatctacctattagcaaatttcaataattataagcattttaccaacctttgtacctattttctatgtaggtgtaatacatggaagtctatatcctcactatgcactgttgtagactcttctctcaacacttctgcttttcctgaagtgcctagctatctgagcatacaatagggctaccaatccatttttgttctccaactatatttttatctgtgatttataatatctgaatgaaagcaggaagagacaagatagaaaggaggaaaaggaaaaaataaaaactataaataagagtgtagtagtttaaaggaaccagggaagtaaatgcctgatttgtggttagtgcagtgctgtatactagagtgaagaaaccttacactcttgacaatatcctggtaattcctgttgagagggcaaaacacgcgtagtccagaactgcatttctttaactgaatcatccccaaaaacttaaggtcgtggaaattctctctaaattttggtgtctggttctgacatatttttaaaattcagtgcttccccaacacctgtaatatgtatattttaacaggtagttggacatggtatttcaggctttcctatttttttcctatgtaaatatgaaagttactctatgggcctatttccctgaaatgttggacccactaacacaatcagactttctacaaactgccacactgattctttgccttcaggtacacctatagaaagatgagtgtgtggggatggcatagacccaaccagcagcaagagggagtcattatttcctacccaagagtagggcagagagaaagaagacacatttgctcagccattaagcataaaccaatgaatgccagactctttatgatcttgccagtcaggattgatccatcctttcatttagaggaggattgagcaagaggtggaaacacacgctagacatatttttctagtataggtcattacaaggaaataccaagatgaagaagacagttcttcctaacaacctctgccatgaaataattactgaccaaatatatttgggaatatgattatgctgaaagggccacatgaagtccttgtttttttattatttacagatttgactattttttttttctattctaatactgtgcttcctgatgctctattataaagaacagaggggattgggaagctggggttcaagccaaagaataaatccatgatgtattttaaagaagttggtagaagaaaagagaacaagtagatttttttgttgttgttttttgtttttgtttttgtttttgtttttgttttgttttgtttctttgagatggagtctcgctctgtcgtccaggctggagtgcagtggcgcgatctcggctcacggcaacctccacctcccgggttcacgccattctcctgcctcagcctcccgagtagctgggactacaggcgcccgccaccacacctggctaattttttatatttttagtagagatggggtttcattgtgttagccaggatggtctcaatctcctgacctcctgttccacctgccttggcctcccacaatgccgggattacaggcgtgagccattgcgcccggccgagaacaaataaatatttatagagtttggtgtagtaatatttttacttactctttcttattctctttattatttgctcctgaggatatgagttaccatctaactagcatcatttccttaagccaatatatctttgttcccttccacctcatttgttttgttgttgtcaaaaatgttatgtaatacataagttataggtcccaaaataaagttatatacatgttgttttatacagttgactttgaaatcaggtgaaggaaattgcctttatacttttttttttttaatatttacataattacctttactccttgtttttctgcaaggattttgcttatggttactttcagtttttgtttgtgtggggatgtctttacttcatcttcatttttaaaagataactttactacatataagattcttggttgatgattttgtttctttcagtactttgagtatgctatcccactgtgatcaccattgtttctgctgagaagtgagctgttggtagttcccttaaagttattgaagttcccttgtaactgataaattgtttttctcttgttgagttaaagattttctctttgtatttggctcttagcatttttcctacaatgtgttaggatgtggatctctttgtgtttattatacttgtagtttgttgagcttcttggttgtgtagattatttttcatcaaatttgaaaagctttcagccgtatttttatgtttctcttcactttctgtccttctgttctgatatgctcattacgtgcatgttgtgtgcttaatggttgcccaactttctgtgaggctctgttaagtttttccattctttttcctctctgttcttctgattgcataatttctattgatttatttcaggtttgctgattctttcttctgtcatttcaaacctactcttgagcccttctagcaaattgttatttcagctattataatttttaactccagaatttcatttggttcttttaaataatttctgcttcttcatcaaaaactccatttgatatagcattgccatcataatttcctttacttctttaaatatggtctcctttattattttgaacatgcttatatggctgctttggattatttgtattaatatattaaacctgacatttggcctctttcacagtcaatttatgttgcttggtttgtttcccgtatatggggaacacttttttctttctttgtgtgtcttttttcttattgaaaaatggacattttagatactttattatagcaactgtggatactgatatcccctaatctggagattgcttttgttgttgtttgcttgttcatttattctgttacataactggactattttagttaaatgtattttcctgacagtatgaagcttgcaatgtccttcctcagaggaggcaaatttgggcatgtgcatagtcactctgggatgacagtggttttaggaagattctctttgactgtatctttccctgatctctctgttaagctgtcttcctctgctggtattagaccaagtttttgtactacattatttgcctgcttattgttttggataatacgttggggtataaattgctccacattctgatccagttaaactcaagcccctttggaagccaattttgctccaaagttcagggcaaggccactggcctacttctcttgaagtgacacctgtgctttatgagcagggtgttgaatagagtctgtagcctctggccttctcagcttatctccctcagcatagaacctctgccctaggaacaagataaggtgagggcagtagaagtgggaggagcacctccagtattctcagcatgcctcacaggagctgaagcccctgccctatgtgcaggaattgggtggaggaggggagctccaattctctcaaatgcactcactagaaatttagcctctgtaacatagagcttcagggcatgacaaatgctggtagcctgctgctcttcagggagagagtcgtctttgtctgggagctggggagagtgttaagtcccacttttttggccacacctgtccagattggagcttccattctgcggtgcagagtggggaggaaggatgtagaccatgtgtaaacgccacagactctccttgttcttactgagatttggtagagtttcttcatttgctgcttgcccttagggaaccttatggagacttgaaatggttgttattgtttgtttgtttgtttttaataattgtcagtaattattgttgtttccttgggagttggactacagagctcatcatactgctgttctggaagtgaaagtactccatgctgtattttaaaggccttctgggatccctgttgcataaagattaaattaagtgttaaatgccactgtacgtttcatgatactagcaagaaaaataaaacaggattttccaaatatccttgattcagactgagaaatagcaaactctcaaaacaaaacattaatgtgttggtgaaatgtgcaaaatgctagcttctcaatcatctttggatgcggaattgcttaagcgaaatgaagaaaaatattccctcattgttaagctacaactgtttcatcattggagtgttccacgaaacagcctatttcataccagttaagggcctagctagaatttcaaatgaatgcaaataagaacgtttgtaatgcaagttgcaaggtgggaggaacaactgtttatgtaattttcctctcttttcaactttcacagagcattgcataatgttagaatcagactgcttgtattttaatcctggcttcatcactaagagatgtaggcttttgaccagttaatctaggtttcagtttcccattaaaaaatagaagtagtacaggacctacttgtaggtttattataaggagcataaataattgatcacttgggtaaagtgttaagcaattccccaatgtataaataataaatttaagatggtaataaaattaaaaaatcacaaaagcattaaataaatattatctctttagcagcttggcataatcagtagaaatttgagttctacaaaacttattgctgaatgaggtatagatttggatattagacaagaattttttaatggtccttatattcattggttttaatttagtgggtttccttaagcttaatgtatctctagtatgatcatctccacaagaatagataatactttttattaaatgctagcttagtccacaaaactttgttttattaaagtagataaattaagcaatgaaactattgatacaagatgtctttatatctttcactccaatcagttacatagctttaaaactcagaattatttttgtgtacatccactgtgtagtacctgaagtgagatgaacttttatgctatgctttttttctatttggtattcattgagtagcttttaaccaatctccttcttctattatacgagttgctctactgggcttttgggatgcagaaatgagtgagaagtggtttcttcagccaaaaccagatagccatttaagcacacaaataggatacatttttagaggtactattggagagatacctacaaggcgttgcagaaacacaaaaaacaaagagtccctggaggtatagggaaaagcttcaaagaggacacgaaggtgaagtcatttgagattgattatataacctagtgaagaattttccaggtacagagagatgcaggaagaccatttctggcacagggaacagcagatacaagagcatgaaataattaaagtactgtgttgttcaagagatgctgaaaagttcagatatttggaaagttcagtgaatgggatgcggaaggataacggaataggatagaaggggcaggttgaagccagatgtaaagaacttttatgccttttttaagagttcaggcttcattctttaggcaaaggcaagccagaaaggattttaaccagtaggagtgacatggtcagttaggtctttagaacaataactctggcttcattgtgaatgattgaagggcatggtgcttatatttccattgtaatagtctaggtcagagtaagtcagagctgaattaaaaatagctggatacaaaacagcttttctcttccatgcaatagtgtgtttcctccctaagccccactctctcccagcgaatacagttagtcttgttttatgaaaccagttaagttattaagattcaagcacccagctttctttgcttagctagctcaggtaaattgctttaatgatgtccatactgtaagggaagcatattctaatatgggaaaaatggatcagatgtctttgaaattatcctttttagtgcaatgaggaaattgaagtgcatagtgaaatgttttgaaatgttgttaataatgatattatctactaccgacatgctgtaatatccatttaaaagaaataaagttaattttgtatttttctgctctaacaatgaggaaaaatggtaaatatttgggaacgtaatcgaatgtggaggttgtcataaagtgagttatttttttccaaaggactgtaatgggaaaaatacataagtgcatacatatggaaatgacttgatttggtagttgagatttatatgtgacttttaaaaatgatttccagttgctattcctaatccattattttgttgtcttgagctgcagattgttgtctaggtcactaaatggcacactaaacacatttgctcaccatgcccctgtttcttcagatcttttcctatagaacacacacacacacacacacacacacacacacacacacacacccctccccttcacagtttttatattttcagagaaatctatgcatgatcttctgtcatgcaatcctatcaaacatccaattcttttaaacagctaattttttatttcttacttttgttcccaagatgtaaggcacttgtaagattgttctcctttcctgaatattagcaacaacagccccaccagccgttgcagattctgccatcaagttaacacatggggtgtgtagatttacaagtaggaatgaaattatattagagataatagctcttacattgctcaagaatagatcaccccatgaccacctggtcctatatcagttcatttctcttataattcaggaattagttaatgtttttggattgcacgggatgtgaaacatgcctagaagctttgccttatatgggaatctcttaaaatttatgaattcttatatcaaggaaatttttaaaaatgcttaatattacaaaacacaattctgttctttatattatcatatttgcttaaaacctttaggatccaaagaagtgtttttcattttgacatcctactttggttttaattgtcatgagcactagaatgatatgtattgcttccaaactgagtagattctattcgctagcttatgctgtacttagcgagccgtcatttgtcttaactgtatgaaccttagagtgtttataatttacttagaagcagcagatatcagcgccctaattaacaccttcaccattcctctcctggtacttgagaagttggcggcactacaaatggaacagaggctctgaaactaaacacggacctgacacaggatggacatcaattgtctttcatggccttgaggttcttccaattttattttgtgcaataattcccctggatcctgatttctatctcccagtgccatgttttcccacattgttcattgcccaaacctgatacatcatgcaccaaaattaggaagttgacacaagtctggatctcctagtatacgtaatgtggaatgaagatttgattagtaaagggaagtaaagatatgcaaaaaccacagaattattaatattttttcctgtacacttctatagtctggcaaaaaaaggtttggaaatttctaaagatagtagaaaatggactataaatgacttgtatacagaaaaaaagtgtttcaaaatattgattcatgaggttaataatagcttaatattaaagcatttatttgtgtcttttcttacatatctaaccatattgcacaaaaaacagggtcctagaattctatacagaatattacatatctatatcagacatgatcagaaatcagtatcagtacataaaatatactttatattacttaaatggaagaatttaaaatgatattaccatgtaattgaacagatttgaggtgcctgaagattgaaaaagaaataattattttcagatcttgagaaattctacaaggtaatcctgttgaagtcttcatcataagtgagttttccatttgtattattagtgtttgtattttttgttgtgagaaagcgatcctgattctgcttattttaacaaagacgagaataaatatatcagaaggtcattgggtcaggcaaagagttgtttgtttttcaacataggccacaaggatgaacaggaaaaggacatttctagaatgtactgttacagttttatgaaagtaattcaagcaaacaaaacagcaaaaagacatagctgccatttctcagtgttctagggaccaaagaatgtacttacagtgctaggatgtctgcatctttccagctctcacaactaaaataattcaagtatttatgccattattttaaattttgttattactgcccttgcctagatcttcattttcactcaattgaaatagtatgggaaattcctaagtgggatgcaaaccttcagtctttccaacaggattgtaataatctcctggctggactgtactgagtttatcttcttatcccctatagtatctagcacagagaaggaaagtgtgtgggaaatgcaaccacgccccttttcttcctttatgacagatggttttaatagattctagcattcttttcctcacaagtctcagcataacatgctgatttatcagagttggcacatgtcataaaatctacttaccatttctgaactgataatacttagtaggcctaaataaatgtttatcgaactaaagtattgcacatacccagaaatggaactgggaggataagtgaaaagaaattcttaaagaattatttcatagtttttctatttctattcctaaagctccccttttgtttccattgccttcagcggcaatggaagacttacaagagacaagtgctaggtctcatcaacttgagagtctgttcattattagtctcttctttgctcccagctgacttatatttaaatatatggcttccatccaatgattcccagcagggccattaaataaagtatgtattatggacaaaaaatggcaaaaatgtacttggctcagggacacacctttctccagtgacttggattcctttactcattaaggaaaaaaaaaaaatggttctatcgactcgtcattgttgttttatatcagcatgtcttaaccataggaggaaaaaggcagttacagttttaataatgaatcttaaattactggcacttcactcataaatgaagaaaggacagtataatattttattctcagaaacttttctcatctcccctttcctgggtcgtgaggtcaactaattttgattttatctgctctaaactcatcctaatcctataacttagtcacgttggttttaatatttgaagattgttttgtttcttgagattttcctacttctctctaaaattgcatctggggcatggagaaatggctttcatgacattgtgtagttgagaggaaatggatcccctcacctcctgctggttcttgggggattggtgacaggatttatctatgggatggtctttagcatatgctaattgaagttgacacttggtaaaattcatagtctaaattatctcagcttggttaaggcctcagaaagatccctagcttgttcatccactctaaactctaaactctgagagtgtctgctttgcctttcatctttctcctggtacaggctatccctttatttcaaggttgctagaccttcttttagaccttctttacagtggggtcagtggctaatctgcaaaacccgaggaaggcctgggagggcaaactagaccatctctctggctaatcatgccagtctgcttcataagctctgcgttttcacacaagactgtgctttcacagtcaccctgcacagcagccttgtgctagtgttcaaaatggcaacagaaacgtcctatttcctacaatttatggaacatatttcctcctctccactaaagcatgagggagggaagtggagatatgtatctccctcacctatatctgcctccagtccttttcctgtgagccttgaggaaaaagaaataaatcatattcttaagttttcaaaaatcttaatcatattacattatcagtagataatagaaattatagaaattttattaaactttttctttgtggtatctataaccttaatctcttcactctcactaaatcttcaatctgttatgtttgatgtattgcaatagtttttaacttgcttcttgcctccttttctctttccactccaggctattttgcatcctgttgccagactattcttcagctctctcgctttgattacaccgtttttcattaagacatttagaattttgtctcatcatttatctattattctttttcaatcatatgcctgctgagtcctaagactcttttcttcttattataatttctttactacattacccctaaatttgttccttcctcgtttctttatcatattaccttgtaatgataagacatccatatactgtctgattcttcaaagcctagctttagaccctcttgggtgaacctgactcactccataactagagtatttagtctgtagaacatatcttgatatgacattatgagtttgagtaggtattctctcttttcttcatatttatctttcccactaactcttttatttttttaaaaataatcttcccaacaacccttcagtgtgggtgttgatatctgcaaattacagacaagaaaactgaggttcagaaaagtgaagtcacctgcctaaagccacaaaactagttgatttttggagctgtgattcagatccaaatctggtttcagttttaagttcctcactggattaggctgcctcttcttaacagaaggggttttacagtatattttgagggatacttcacaaataaggtgatgtttgagggggcaatttattgattactaaatgctgaacacagtatatcatgttatcctttcaacaactctgagagttaggtgctaccaacagtctcgatttttcagttatggaaggtgagtgatagagggaatgcaggggctaaataatgaattgaacacaaggccctaatcatcatactgctctacttcccacttattgaactcaattctacacatcagacccttctcaatctagtttctgggctctggaggttgtggcgatggatggcctagcatttcctaggatctaagccctgggcatagcctgcttccaacattgggagcatagagatgagtcaggaaagcctgaccatggcctaactcatttttaagcatcttaaacaaagaatagtgtttagtatttgtccacggttattataatgtctaataggtggtacagagcactaaatatttacttcattatacaaaatctaataggacttaaaaaataaaagcacgtactgcaaaacacaggtttgaacaataagaatattgcttttttgctgttctttagacttcttttccatgttttcattaataagcatgtattattcttataatttacatctgtgttagttcaacaatactgtaatttaattacattgtgatccaaacaattagactgtgacattttatttaccaaacattactaagtctgcagttaatcataaagcagtatttctggtgttcatctccaaacattttatctacattattaacttagaatatttgcaacatgctgcttctcaactgtgactatgattattcacttatatttgtatttcatcattaaaaagaagccctcattttctcattattaggtcttaaactgaatcaacctgacatgaatataaaaaaattagagtagtttaaaacagttggttcatcagagatttgaactgaggtaaacaaaattaggtagattctgtaaataatcaaggcattttattttaattaatggccttgttacagttctgtttcaaaaactgaaggatttggatattacacccccttaggttttatatacatataatgacaacgttggtttggatgacgtctttgttctttctagctgttacattacattctgtagttatctgaactgcttgccagactgtttagggaaatgcatgtatcacagttaggggggattcacaaatggtaggtttctctgcaaaattgagacatatttagagtagaaaacactttgcctcttggaaatagaagtatagggtaatctctttttgtttgtaggccagaagtttctgtggactataaatagaaacagctcacagctaggatggagaaagctagagaaatgtacctatttgattgaaagggatagctaatgtactcaaaaattgctcttgagaaagagcaatgacacattcattctgaaggactacttaattgcccactcttggaacaagttggtcttcagctctaaactaaactgaagattttgaaaatgatagaaaaatagtgcagcaaatgttaaatttatgaaataggcttgcaattttctcatcaaacttagaccaaccttaacgatattgtaagagtaatatattctcaaggataaaatgttctctagttcaacttctacatagaaaatgagtttaaatgagccagtcgtcttaatatttggatacaatggtcattttgaaatatgtgaaatgtgttccactattattagaaaggaaaaaaaataaatatgcttatctttgatttgggcaatacccaggactgattcatagaaaaaaatctaatatatttatacataggagtgctttctctctacttgtacctacaataaaaaggtcgtcgtttgctttttaaaaattattttcactggagtatacttgaaactgtacatctcaaatgttttaacaaatatacctaaatattaaaattactaagtaattttgtccattgaaaaatgtggctactgcatatataataagacatagtttcttctcaaaagtgcctaataagactaaagagagtgaatcaatggaattatttatttgttaaaatcatgttaaatgtcttaaaggtgttattctttctttcctaattttcaaaagaaaatactttgtcttctttcatactcattgtttctaactctttctaacttttagtaattgtcaataacacttatattacttaaaatcttttccttaatttatcttcttctacccttctatccaactcttctttattaaaaacatgtcttcaggataccacaggagaaaaggtcagaaaaagaaaagggagttttagtgtatacctacctccaaacagtcattattactgtcaaggcataaagccatatgttgcatatgacaaattctgtatttctactggggtgcattgtactgtattttcataacatatgccaggcaacttctatgtatttcaggtcactaagtatacttttcaacaagacaaggaaactttctccctcccatcccttctgaaatctttatttggagatctagctctaagttttatgttttcctggtggtctttcgattcattccattccattccattccattcattcattcattcattcaaaaacattattattcacataccataggtcataaacctcattacttatgggaaatacgaaaatacttaccattctgtcttctctcttctttgaggcttgttctcatgaaataagacagatctatctatctgtctgtctgtctgtctgtctgtctatctatctatctatctatctatctatctaaacaatgaagtgatagattaagtatatgaaaggaaaatgaaaagcaaagaaaaaaggaaaaaggcctctgctagttgcgttgtggatttggaaaaacttcatggatgagatgatcctaaaagattactctgggtattccatgcagctaaaggtcgagggccaaggtggctgtaatagtccaagtaatgtggaaagaatttgggtgtgaaaagacttgccaggaagttttgactccagaaagattctaaaataaattggtaattataaagatgataatgtatggcctcgaaggccatgttcaggaatttggactgtgtacagacagattgtggaaagctattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaaagactctgtctcaaaaagaaaaaaaaaaaaaagaaaaagaaaaccgaaaacctaccaaataagtggagataaaataaagaataagaagcataccagactatagtgagagcatatgaaagccaatttgatggttgaaggagaaaacattcagtattagaacaatcacaagacacggcaaatctaggggggaatactgtttagttagaggcatgttgcctttgaagtgcctgagttgagaaacattggacatttagaaagtgagggtggtggtcataaatctgggagtcccagagaggtagactgatccatgggattgtctaagttgggagtgggaagagagcatcttgataaagaagaaaagccacgctacaagactagagaaaatcaacataaagaacaacaggcggcccagcacggtggctcgtgcctgtaatcccagcactttgggaggccgaggcaggcggatcacctgaggtcgggaccagcctagctaacatggtgaaactccgtgtctactaaaaatacaaaaaaattagcccagtgtggtagcgcacgcctgtaatcccagctactcgggaagctgaggcaagagaatcacttgaacctgggaggtggaggttgcattgaggcaagatcgtgccattgcactcctttgcactccagcctgggcaacaagaacaaaattccatctcaaacaaaacaaaacaaaaaaaacaaaaacaaaaacaaaaaacaaaaagcaaagagagaggtttgtcaatcacagtttaaaaaattaaggcaactgggataagcaactaatatttcagccatttgagaatgactctatctcttcgtacacttgcaaatagaattgtaatcacatgagatttcaaccagataaatttggttacccagaaaaaaatgaggtcatgacatagatttgaaggccaacaaaaattacataatcagtgctccgtaaattagctattacgtaggtggatgcacattttgtttcatgtccatgaagattcgaagcgttaagttattttactcatgataacaatctacttcctatcgaaatttcatggagagataatagatcagtatttattctatactgagtatagaccatgaagattaaaaatagctcatgaataagggaaagggaaactctatatgtgggattttatgtaattatggtaacaattccttggagatattgtggtctgttatgtaaatatgtgtaattatgataatttcaaaaaccatgttatttactcagtagtttaacagctccttcacaaagcagtcactttcagaactcaggaggggtatagcaatactttccataaaaatgaggtaaacttaacatctcatgtgaatttaaaatatatttttataagaaagacatcagaatttaagggtatatttaccccatttttactttcacacaataaagtactgctgtagcacagatcattattacccaagttcagggatgacatacacaaagattattattgataaataatcagaatgaattggtagtatttgcatagatttttctggaccatagttgtttttacctgttgtttgagggcctattatggggggcatatttaatatatgagtgctataactagaaattcaaactgtcagagggaaggaaaccatccatctacccattcattaaatgaatatttattcaaggccaagatgtgctaaatgtgggactgaattttgggaccaaaatcttaaatgatgcatatgtcctactattacatgctgtctaacaggcagaggtaatcaggtaaataagtcagtgaaataacatcattggagtcttcacatttcacttttccgggggacaccattcccattgttgtgaaatgcaaagaccctgagtgttctaggtgttataatagaaagaaaagtagggtacaaaaggggaacaattttatatggtagagctaaggtcacttaggatgatccaagttttaatgtctccactagacagccagagtaataggtgaatgtgtgtgtgattaagaaaaatcatccattgccactcattgatatgtaagggacaagcagaggaggggaagcactatcagaggagaatgagaaggaatagttaaggcagaaaagaaaaaaagtgaaaagtacatttttttctgaatgtaagattccagaaggcagtcggtaaaagttccaagagatccacggaagtcaagtaaaatgagagggaagagtccattggatttgaaaattaagtcatgagcaacttcacttagagcatgttcagtaaagacatacaaataaataaaagtgactttgatgataacttttggttggcaacaccaacaaaccaattttgaataattcctccaagaaccgtcatagtgaaggaaaacggagtggtgttcctattctaggaaaggtttttgtttgttctattttggttttgttcttggattttttttagttttagtttcctgtggtattaaaacatgtttatataaagtaaagggggctgggcacagtgtctcacccctgtaatcccagcacttttaggaggcggagacagaaggattacttgagcccgggagttcaagacaagcctgggcgacaaagtgagaccccatctctacaaaaaattagttgaccgtggtggtgcatgcctgtgatcccaagtacatgcgaggctgaggtgggaggatcacttgagcccggaagattgaggttgcagtgagccgtatttgtgccactgcactccagcatgagtgacagaacaagaccccgtctcaaataaataaataaataaacaaaaataaaaacaaaaaaataaaaaagggaagaatggttatatatggtaaaccaggactcctcaagaaagggagaaattagattcagaccaaagaaggagtaagtggctttaatctatgaacaagataaagggttcatccttatctgaagcaggaaagaggaagggaaagagagaaggatggattctaatataaatacatgcagaaagttcttaaccatatttttcacttagaatcacaaaaaaaagacatataaaacaaagtcactaaagaacataataatgtgcttatattacactgaaatgatactctactttcctctaattattattcttccaagcaaatacttttttttttttttttgacacagtatctcactctgtcatccaggctggagggcagtggcgtgattttggctcgctgcaacctcccactcctgggctcaagcaatcctcccacctcagcgtttgtagtggctgggactacaggagcccattaccacatccagctattttttttaaatattttttctttctttctttctttctttctttctttctttctttctttctttctttctttctttctttctttctttctctctctctctctctctctctctctttcttttcttttcttttcttttcttttcttttcttttctttctttttttttgatggagttttgctcttgttgcccaggctggagtgcagtggtgcaatctaggctcactgcaacctctgcttcccgggttcaagcgattctcctgcctcggcctcctgagtagctgggattacaggcatgtgccaccacacctggctaatttttgcgtatttttagtagagatgggatttctccatgttggtcaggctggtcttgaactcccgacctcaggtgatccacccgcctcggccccccaaagtgctaggattataggcgtgagccaccgtgcccagacacacacccagctaatttttgtatgttttgtagagatggggttttgccatgttgccctggctggcctcaaactcctgggctcaagcgatctgcccacctcagcctcccaaagtactgggattacaggcatgagccaccacgcccagcctcaaatacttttttgacccgaatatcctgcctaattgtgtaagagttaatctatattgtccaaagtaccagtaaggtttttcttcttaggcaaggatgttagaaacatattaggtttttctgatcaatatggctcactttttaagaggaaattgttaatatttttgagtcattgactgcctttgtgctgtttcagagaatgtacaagagtgcggcaataaaaaatggcatacgtattgaaaatattattgctctggttttcagttatttagctcaggttttagaagtttcatctgcctggaaatattttcaaacatccatctatattattgccatgtgagtagtggatctagtgtgacattgcctcttctactggcaatgatatggcataactctagtttgaggagtcaaaataggaggtagcagatctattgtgaatatccaaagtgcagactgcctgttcataacaaattctcttatgaaattatacctttgtaagagcttccataatatatatcttatagagaaactcccaaatggaatttctctaacagactttgccaaactttgatttcttggttaccgggctatagttaatgtgttcataatagcatattgctaacacaaccattaacatgacccttgaaaaataaaatttgatttcacaatgtcacagccgtacatggaattttgaaactaagtcttcttataaaatcattttgagaggtagtttatttctaagtgaaggttacttgtaaataatggtataaccattagcttttgacttttaccacaatattgttggctagtcataatgttcccattcataaaggataactgtgtaatcatttgttattcagatgttgtgccaaaaatccaaaataacatttattcttatttctaaaagtatcagaacatttacaatgaagctgcagttgttttttggtttttgagtgaaatatacaaccaataaacaggataggattacagtatattctgataaaaagctaatttggggcaaatgagccatattacagttgttacctatcacttgattgaaaccaaatcattatctagctttggataaccatgcaccttaaattgaaaattctacaacccattctatggcatacttctgaaaggctctggagtttctctagatgaaatcaaacacccaaagaacatgaaattttggtcagttttcttttacgtgcacatgaaatcatgttctgtcaagtgtgaagattgcggcaggtgttatgagtcagcacacagcataagcaaagctgtatgattgtctacctaatgttctcacgatgatgtttctgcatagttatggaaataaatgtctgtctgaatttttagagcttcatcaccacttatctgaggctaaggtaaatccaaggaggatgtaacatctttttctttacatttttgactatatatatatatttcttttaaaagttagcaattaagccatttctatgtgcctaacacagtgctaaatccttgatagctgtggaaaaatagctgtcataaatcactgtccttgtatttgtggatgctggtatataattttctgtagaaaggtttctgatttgtatttactttcatggaaatcagtgacaggaaactggaaagtatgtagggggtggaaagatcatttgagaatgatgcaaatattgtttgaaaaacttgtatttatatttgtatgctctggagatgcatatatccaaatttaacctcatgaaaattccaggaactaaaaccttgaagaccagaagatgcataatctccttaacaaacaggcttgtttcacatcagcaagctatgatattaaaagggtcagcctatctcaatttgattgaccaaattagaaacctatttaggatgcaattataatgcataagagatcactgtgctctaataaatcctgaaacacatttcatggccagcaccaaggtaaggggctgcccaagttaaatatagaaacatgtactgtgaagggtcagaagtttgcttcttggcatgcttttattcagcactccatgattatgcagtagtggccagtgtggtgtggactttgaggacttgccttaccaccaactagccaagtgagcttggaaagaccccttgaactgttctgttactgcaatgatctatgagacaatagatttgaactaaatcattcctaatagtcttaatgaatagcagtttcattagtttagtaatgggataatactaaagaaaataaaaaccccaacctttgttaggtacatagagtatagtaaagtgattcagataaaggttatatacagagaacaaactaagaattttttttaagaagtaattgacaaaaattgtgtgaaggcaaagagagctaccagtataaaaaccattccaggtagtgtttgtgtcttcagagagaaagaaaagagaccagacaggtctggttaggatattgttggggaataggtagccaagcaactgcatgaaaagccaccaaagggagccttcttcaaagggatgggcgcatcactgagataatccctggcttagcctttgacaggcttgcatctcagcattcacttctgtttgagctattatgtgctgacttcagcatgggagcaatgaaattggggcatgactacacatttcattaccgactcccaagccctgggaaaataatacttttttaaaaaccctgtacctaccatctaataaggtaatagtcaagttgtcttattagattattcattaatgaaacaaatctgtgatgaaacagacttcagatgaatatagctgtaatttttttatcaatgacataaaactgacctgctaaaacagtatagcaactggtaaaatagtttattaaattcttttaaaatatgaccagttacattatatagaaataactggactgtggtccctaaaaaaagagaaatctgcttaggaaaaatgtaattaaaggcgacaaaagaattggactgtcttactcaatgtaaaacttttaaatcaatcttattattttaggagattcatacatgaggactgttgcttttgtattagcttaacaagcacccagggagtcctcctaatagttaagtttatagaattaaaagaagtagggctaatgtgggcttattttcctaatgtgcaacattatttggtattccaaaaaaagtacgtgatcatttattcttttctttgacagagtttcagtcttgtcgcccaggctggagtgcagtggtgccatcttggctcactgcaacctctgcctccccgcttcaagcgattctcctgcctcagcctcccgagtagctgggattacaggcacctgccaccatacctggctaattttttgtatttttagtagagacggggtttcgccatgttgggcaggctggtcccgaactcctgacctcaggtgatccacctgcctcggcctcccaaagtgctgggattacaggtgtgagccactgcgcccagccgcatttattcttttaataagcatatattgaaattccactcaaattaaagggatacatatgtaaataaggactctgcactgagaaggttaactttagtggtgatccaatagaattctattagaatagactaatggatttatataatgatagtacataataataaaactaacaaatatataataaagtataatattatattctagagaatttggaggaattttatctagataagccagatatattttggtcagttgtgagaaagagtgaaattaaaagtaaacagctgggaatagtgcatattaaaaagctgtagcaacagtagtggtgataatggtgatgactgtgatcatgagaaaaagaaaagaagatagaggaggaggaaaaggagaggaatgctagctaaccctgtagatcttactgtgtgctagacatttttctaagagggtttttatatatgaacgagttaatcctcacagcaatcttttgaagtatatgctattattggtcccattttacagttagggaaactcagatacagaggatttagcttgcccaagatcacatagtaagtgtataattgcttttaaaatcagagcatacccattaaatataaaggtaaatattccagagaaagtctgaaaatgttgacagtttatatcactcaaatatctaccgtagccaaatagaaatgtgtataaaatagggcataagaaggagtggtgggcacgatagcaaattggagagcatggatgataaactggagagctacagcccagctaaacatggctagtgaactacaattgttgtggcccgctagaaatgctgtctccgtgttatcagatcatccaagtttggaaaggatctgaaatctggattcataagtgaaacctccaggttattaaatatttggcatttaattaatttttaagataaaatgttagtgggcttgagaaaacacatcagtcactgtgtttgatatatcctgagagccaccagttcatcattccatcattatacagaggcatttattgacttttcccaaatgtctaataatctgaactcagaacgaaatatgtagtagctaaaagtcactttccctcaataataaatattgcttatagcttagtgggttgatttcagtgctaagatattcatttgaagaataaacacaggaacatgtgaaaatcaaagtctagcaacctattttcagtttgttgctttagcttttcagctccaacattgtgagcatccctacgtttagtctgaataacttctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccaagttatttctattctgtgttttattggttcttaatatattattatccttgatctctagtcctatcataacttcattttttgtaccaaatgttgctttgtaacatagagaacttaaatgccaatcacctattaacaagctaataaatgtcctggctagaagtgtcataaatggtgaagggtcttgacacaataccatgtgaggattacttaaatagattagggaaataaataatatgtagggaaaatataatagctatgctgaaatatttggaagattggcaatgaagaagctatagtgtttggctagtttgaaaatttattctgacttggaacgtgtggaagctatgagaggtagagtttagtttaacaagtgaaaatatctcttcataaagagattaacctaaaaagtataatggatacctcaaaaaatagtatgttatagagaaagttccagaattgtcaggcagaaatagttaacctctgaatctgtgctctgtctccagaaatctagacagaagctattaagtaatattatcatttaagatgatttttatgacatgacagaggacattatttaaaaattttttttttttttttttttttgagacggagccttgctctgtcgccaggctggagtgcagtggcacaatctcggctcactgcaacctacgcctcctgggttcaagcgattttcctgcctcagcctcccaagtagcttggaccacaggcgcatgccaccatacccagctaatttttgtatttttagtagagacggggtttcaccatgttggccaggctggtctggatctcttgacctcgtgatctgcccgcctcggcctcccaaagtgctgtgattacaggcatgagccaccgtgcctggccagccagaggacattattttatcgacagcaactacaaacattgaaagagactacaacataaactgttattattagagaccaagggtttgttgctagataagaatatgaataaataccatattctcttgtattgagcttgtttttcaataagtcactgaacaacaataattaagcaatgaagccaatacatctagagaaaaaatttaagaaaacatcacaatgtttcaataactatttccatctatacatatttcacacattataaaataatcagttatatcacatggttttatttttaagttcaaaaagtcttcataggctgagctcaatggctcacacctgtaatcctagaacttgggaggccaaggccaaggcaggtgtgcttgagcccaggagttgagaccggcctgggcaacatggcaaaaccccgtctctacaaaaaatacaaaaattaaggcatggtagcatgtgcctgtagccccagctattcaggaggctgaagtggaagggtcacttgagccccatggatgttgaggctgcagtgagccatgattgtgccacttcacactaacctgggtgacagaacgagatcctgtctcaacaacaacaacaaatgtcttcatagcactttctccctactcgagtcttccataaagctgttgaaacacatgcacattatatctgttttttagcactctatctggtaatagtttgtcaaatacgtgctggactcactattttaacccatatttaacccaaggttgtggcaattatcaaagaaaatcaagcaacattactgaacaaaaaaatattttctatgttgaattatgtagttaatgttccatcttctctttgctttcctatccaggtctagctttaggtacattacaaagtgaactgggaagaaaatgctgacatttaagtggttcttgttgcatgtttacattaagaaataataaggccgggcgtggtggctcatgcctgtaatcccagcactttgggaggccaaggagggcaaatcacctgaggtcaagagttcaagaccagcctggccaacatggtgaaaccctgtctctactaaaaatacaaaaattagccgggcatggtggtatgtgcctgtaatcccagctacttgggaggctgagccaggagaattgcttgaacccaggaggcggaggttgcagtgagccgacatgcgccattgtactccagcatgggcaagagtgacactccttctcaaaaaaaaaaaaaaaaaaaaaaagaaaagaaaaatgcactactgtagaatatcttaataattgtcttcagaataagtagattttaaataactacgaactaacacatagtgctttgcaagtgaagtggaaataaattcttaaacaattatatttaatgcaaaaaagaattataaaaaatccctataaagaaaataatgtagactgcattataatcttagtctgtggccctgaaaattttagtcactaccattagtctctacagacttaaccatgtcatgcttcagtgttcgccagttgtcaagaaaaaaatgtttcctggagaaaatgagaacagtcctacctttaagcaaattgattttgatgccttttgtcctagaaatgcacttgtactttattaatgttcttatgtggatcattttgttttgctggtgattttttcaggtaattctgcatgagggagacagcagtaaagaggggagtagtaaagagggaagatgtagaaaaaacactgctggatttagggtagacatagcttgaattactcaaaagcatattccccttcagctttattgagatatgattgatgaataaaaaagtatacatttatggtgcactacatgatgattttatatgcatatacattgcaaaatggttactaccatcaagctaattaacatactcatcaccttacatagttaacttttttttggtggagaggacatgtaagatctactctttttttgtagtctacagtttataattatacaaaacagtgttaactgtagtcatcatgctgtccatcagaattcaagaacttatttatcatataaccgaaagtttgtaccctttgatatttcactgtcttttttcagcatgtttttaatatgtttgtacctttttttttatttcatattttgtgattcctcttcaatctctttgcttttactctacaggtttggcttaggggaagtgtggagatgttggtcaaaagtgtattttgatttaagtttgaaatctttccctctattttccttatggtcgtcgttcgtttttctacatgaaagcagagaaatatgaatatatatatatatatatatatatatatatatatatatgtgcatacacagacacacatgtatatgaatgacacttttttgcattccctgttttgcccaaagctgatagtgaactgttatgttagaatatgagatgaaacatctgattcaggtcagcatgctcaaaacaaattgtagggcttcatttcctgaagtctttttcttattcatttcatcccagagaaatagaagccctctcatagcttaaatttgaagcctaggtgtcaacagaaccggtcactatgaaagtacaactgtaattaagtggtctgcaggtcatctcaacattactgcattgtataatgttctggggtgcatatctcaagctctttatttctgtttcttccctacacctatgtcagctttttcactgtgcaataataactcctatttatcagtaaaatagatgttttaaaacatgatattcttaaagctagtttgacaacttaaaaatagggaaatatgttaaacagatatgtttttaaattttccgtacgtttccttttatttgcctactccccactattgtagattatttaaaactgccctctgtccaaattgtatccttttggagaaagcattttaagtaggagaatccattaaacgcttttttctaaagctcaaactgagaggaaaacttttacatttaattaatgagaattcagctctttaaaagtttgatgacttttcaaacttatataatctgattccatctctggggaggaaaaaagacattttggttttattaaagaagaaatgaccaaaaacattgaccacacgtttgctgttaaagataaccgtacttaattcaacagaaatgggtttttcaccgagtctaaatgacctgcagcattatagaattggctgccattctctctcagtcagaaatcaggctgtggaaagccagaactcttctctacatctagtacaaagattgtgcttagggtttaaataaaatgaaaagaataaggtggaaaattagaatatgttgaaggttgaaagatttgattctgtgacttttacataactcaggaaggaaataacccaattcctctccacatttagtgaaaaagcaactcaaaaccatagaggctgagaactttctctgcatggcttttcaaacgatttatataaagatgttggagaaattcacaaagacctggataatgttggaaaatcttgtgttttgaagacaggacagagctgtatgatgcaacaatgccatctattggcttccaaggaatggcactgaccacagctagtttgtagtgtctggaaaaggaagagattatcagtttggaacatgtgaatataaacttattaatgaactagatgctatctttcgtattctttactcctgaatgtggaactatacatgatgcatataccacacacatataaacataatgcatagagatatgctcacctgcatcttcaacaatcctctccttgatgctagaagatgagcttgccttatcatcatactgatacagtagctgggttttgtcttcctgtggactagtagttgtcatacaagaggatgtgtttttaccagaactctttattcagggtgttactcatgtcttagtctcccctgctctgctaatcccaactgttactgtaatttctaagcacactcagacaaaaacgtacaggactggggcttctctcagttgagccaaatcaattctacttccagatattgcaatccagagtttgatagagaatttttggctgctttgaggaaagaataaaacatttgattgtgactgtcttagtttccttgtttgccctttaagttcattaaaagatacgtcctataagagtcagttgtgaaacctgtgcaatcatttgaaatgagagtatagatttaaaaataaatacatgcctgatatttacatgtgatttagaaaatatacagggagtacacatattatttcaaataatattaatactaagaggctcagaagtgccataacctaaaaacaataaagacatcaaaattgtttccctaaaatggaactagaagttaataaagcaatagttccaaaaactttttgtttttaaatattgagaaaatacaaaacaataaggattttgttgggcaataaattgggaggcattttcccctgattttcttaaagatggtcaaaaaaagtaaaataaaataataggttcccaaaattcttccattgtatgtagtttttaggttgatggttgcacatgtgtagtatagtttttgaacaaccattgcaaataaaaaatctgtgctaaaaataacctttttatttaataactcccttctcattttcatcaatttgatcacttgctttaattcatgggggttctaggtggcacttcaactgactgctactgattagtaatttaactaattgattgtcaaattgtaattattgctatgcagcataagtgtttacttgaggatagtaaggagtagccaagtctttcttatttaaaacacttacactaataagactctagtcaaacaaacatatttatttgaatactgtggctcatttgaaagcagaattaagttataaaacaataacccattgtattgtttctgctttctgagtaaaaacaaaatagcacactgtttcccaaacttaagtgcttctaggcccaccttgtctatgtctgccatgtctgattactaactgtggtttatacacaatatatttccttaagttgactctcattttttactgaaatatattttcaaaggaaattttatatcactttcataaatgaaaaaaactagaatatctataaatagtaaacaaccatttaaaaattgatcataatactactgttttaattaatataataaaccattattacatctaattgatttatcaaaaatgaaataacttcttcaggattaaaaaaatatatgtcatcagtcagcaataatgacatgtttggcttaatttaagttaaggaaaggttcttggttaacaggaagtttctatttttagttctaatgatgactagcagtgagaatcacaatttgcatatgtaagttttgaaaaaaataaacatcatttaactagttattgtgatagtgttggacactgaaatcaatcctggcaacatgttgtgagtgactttgactcagcaaatctttgtgtcaagaggccatttgaagcttctgctctttagaatgggctacgttatttaatagaatctatattaaccagtcattactgccatgttgcttggaaactgcaaagatgttatatcaagttacttagccatcttttcataaattttcattaaaatatgactgccaaacaagatcaatcaggtgaccttgatatattaggcttttctcatattgctataaagaaatacctgagactgggcaatttataaagaaaaatggttcaattggctcacaattccacaggctgtacaggaagcataaggctggcatctgcttggcttctggggaagcctcaggaaacttacaatcatggtggaaggtaaaggggtagcaggcagttcacatggccagagcaggaggaggggggtgggagataccagttacttttaaatgaccagaatctcaagagagctcactcaccatcactagaacagcatcaaaggggaaatctgcctccatgatccagtcacctcccaccaggcattggagattataattcgacatgagatttggtggggacatagatccaaaccgtatcactttgttattggtagttgtttgtgggttgaaagcatgaatgatagaaagacatgttctcaggatgcaggctgggataaagtagaagaacacgttctataaaggaacacttattatgtgttaggtactatgctaaatatgttacattaattatcatctcatttaatcctcactacaaccttcctaggtaggcattatttctactcctactttgcagctagggaactgagatcagacaaggtgaagtgatttgattagtctcttaagttaaacttactgccttggtgagcaatggtaaggtattagatgctacaggtctgctgcatacccaaaatcctgaactttggctccaggcctggtctgtgggtcccaagaaaccaaagtgtaggcgagcctagccctgagggatcattcccaggtttctcctcaacccttcttgcccagcctttccctggaaacccaatagcagagagcataatcaagaatgtataaatgtgattataaggagccagagcaagaaatatttcttttttcttccttactgtctacctcacctggtttaatattccctaccacctcattctcacagtctatgcacctatactttagtctgggtacccctaaaaaattatttcttgtaccatgagtgtgcatgcccccctttgggatcactgacgattaaaaccagttccaaatttacaagcctcttgggatatgtttgactcccatataaatgtagctattttatatatttttgtgtatatatgcccattttaatatatgatgaaaatgagttctctaaaaatgttaaaatatgtaatgcatttctgaaatttacaatgagtgcctttcaattcactatggcattgttataaggcggatttttagttgtatcgtagttgataacatattggttttcttttaaatttctagattttttgttttacttaaagaaacatctattggctgggcatggtggctcacgcctgtaatccctgcactttgggaggctgaggtgggtggatcaactgaggtcaggagtttgagaccagcctggccaacatgatgaaactctatctctacttaaaaaaaaaaaaaaaaaaaatcagccgggcagggcatggtggcaggtacctgtaatcatagctactcgggaggctgaggcaggggaatggcttgaacccaggaggcggaggttgcagtgagctgagattgcaccactgcactccagccttggtgacaagagtgaaactccatctcaaaaaaaaaaaaaaaaaaaaaaaaaaaaaagaaacatctatttaatagaaaacacacctaaaaactaaaaaaaaaaaaaaaaagaaaacaactactgatctcactgcctggtattaactacttttaagatttttgtgtatatctttctccatttacattgatttttaatttcagttaagtgagaattccatctcttttttatagctttcactttaggagtaatttactttagttgagaatttcacattcatgtatcttaaagtcctttctctttttggattatattattattttatttttagtatagacaaagtattcttgcttccccaacaagatatggaaattcatatattttgacaaaatatgatgctattttccatgtaaaggacagatatgttttctttgatttctttttctcatagacttgtttatcatttctcttgctctaaattttagaaaggtgttgtttttgccttcctgttaggcttcacctgaacagttatagtgatggtgtggaaggcaattcttactatattagtcatttgatggtagtctgcaacttcaggggctctgtcttaatagttttacattgctataattcagtggctttgaggtctagcttaatacccaaattactaatatatttaggattgttgaaactgcaaatgttcaagctttacctcaaacagtccacaagatattccctaggcttcagggtttgagaatcctctaaatgaacaaagcccattaatccatgctgtatcatagtgactgacacatggtaaactcaataaatttatctattttaagttaatagaattctggcaagattatctgttcattgcatgtataacatggtgaccttaatcttttgggtagaaataaatcagctatcacttatgattttctcaaggaataatggtaccttttcaaaaggataggttttatatactatgagatgtcctgatataatttgaattcatggcaatactgcatttgcctttttttttttttttaccatctttcaagagggctgcctagagataagaatttaagggccatgtgttgtatttttgctagtaccttgaaagaagtttttgctttgtttttaatggcaatacaaataaaatccaaaaatcctggacacatatgataagttcagttgtttatttgaaaagtaaatgcctcacatgccttgctcataccactttaaaatgggattgattgataaacacaaactctaactctcttacattaaagagtatcaacactctgaatttttaattatctttgataatccccatgaacatttttaggactcacacgtaaaatagtcaagtctatttcaagttatgtcagacaatgctttttaatatactgttcagtgcagcaccctaccaaaaactagtcctgtggttgctttatctaattgtgccttggtaagggatttgttaagagtggggaaaaaatacccccagaaatgctttaattaaacagcttcaaatacagccattgttcttacaacagaattgtgtaagtcttctccctgaagagaaatattgctgtagccaatatagctatacaattagtctatgtatattaatgtaaatataatttcattataaaaatgcttactcgtacagaatctaatttttatctgattattttttcaaacactggccagtcccatgagtgaaaatacctataatgtaaggtcagttgccaattataaaaaacattgtttagatggaaacccagggtattcacccaatgtggttattacttgtgcttacataatgaaatttgatcagcttgttttaaaataatctatttaggtcctagtattcacaatatctcttcccagaaataaagacttccttgaagaaagtaaatgatttgaactggaaaaacatgtaagaaatttaaaaaaattaaatatatatttattttaatatatgtatgaagaaagtttttcaagatgttatgatgaaattgattttctttgaggtccaaaatggcctttacatgaggtataggactaagattttagtaaaaagcacgtaccttggtcatcacagaattgttgggaatcattcagagaccatgtagaaatgtttcccagggtgagaaagactgaaccctagactaatattggctctgccaaaaataaaataaaataattttttaaaaattaaagaacttatggagggcacaccctttcattctgtgatttccacgtcaagaggtctcagtggagcatacatctgaaacaaatcatttaagctataaatttagtcactaagatcatctttagatccaacattgatatgttaatttatgaaatcaaaaagtaatatactttatagcttcctcctaaatcttagaaggtactggaacacccatactttgaccattcttttacgttcactaaatttcctaagagtgtcatggaaacagaagaggaatagaaaatctatcaggtaaccctgccctacctggcaaatttttgtgttgtagttgcttttgtttaacatttcttttatcagttaattatacgctgatagagattttagatggactcttggaactccaagaaaaaagaggttctgattcagatgctcttggaaatatagacacatttgagtgtcttaaaagcatacacgagacaaggtctattttccaaaggtgcagagcaagtactgaagcttctccacttgaaaacaacagtataaaaactaccattaaggccatttgttcatttgcccaaagtatccaaggagttgtttaagctttcagccccttatgcatttccatcaaatatgaatatgtgttgctccttctagtagttaagaccagtgacacccatttcttccttgatggtctatattttattgggtatttaattacagagcaatcaactacactgaaaaaaaaataacttgattcagttaagttcttaccccacaatgctcacaggctttactgattatacaccacctcttatgtgcaattgtctttggactaatcagatgtgatgggcttaatgttgtttttaaaccctaacaaatctggtcataggcaaagcaaacctgctaaagatgaagggactagatttaaatgaccttgctgacttccagacccttcttttgatcgtgggcagaatggatatgctcttgttgtggaatataactatgtatggatttataaaagtttgtcaaatgaaagttgaaagttctatattcactttacccaatttactagaaagggaaccaattttctcgttaattacaggctgttagaaaggcgtaatgaaatttcacaactgtccaactggtgcttgatgagaagattactatctatggatgagggttatgtctacagttctttaatctttcctttctttctttttttcctctatagtgtctcctctgtttctcccaaacatctgctctattccttttgatgtcctgttagtcatccccattccatgccactaccactgctctccttttacacttcctttcttctgtcttgtgtcttctacttactcattgcatcccctgaattgttgttgttgttgttattgctgtagtttaaacacatattgacctccatggttaccctgttcaccttttgtgtcaattcatcattttacaattattataatgtatcattttatttatttggaaataatatttatttggaaaaatgtatttatttggaaataaatgtttcatttccaagtttcatattagagcttggatactcaacttgtggtccttggaccagcagctgcaacatcacctagggacttgttagaaatgcaaaacctcagcctctaccctaggccttgagtcagaatctgaaattcaaaaagttactgaggtcactggtgtgcacctgagagtttgagaagcactgtgttggaatacattctcattaacagaagaatttacaaaatagtgttagttatttggtatttaatgaggaaaatggtaaaagatgtttagtcctttttttctcattacattggaagcatatgaggatgcagacatccttcttaactatttaataatgttttaaaaactttaatgtatggccgggtgcagaggctcacgcctgtaatcccagcactttgggaggctgaggctggtggatcatctgaggtcaggagtttgacaccagcctggccaacatggtgaaaccctgtctctactaaaaatgcaaaaaattagctgggcatggtggtgggcgcctgtaatcccagctactcgggaggctgagacaggagaatcgtttgaacccgggaggcagaggttgcagtgacccaagatcacgccattgcaccctagcctgggtgacaagagtgaaactgcgtctcaaacaaaacaaaacaaaacaaaacaatctttaacgtatgatggtattagctgtcatttaaagaagatttttaatcagtaggtcttgcaaacgttacgatttatcacatgtatacagtcaaaagacacaggtaaaaataaacttcaattatttcctttgaagtctgaaggccataaattatattatattgatgtttggttgataaatcaattatgtttgattattaataatactattataggtagtgtttgtggaaaatttactatttgacaaacagtgtacaaaacactttataaaagttaacttatttggtccttacaataacattactaaatttcaaaattacaactttcattttcagaataggaatctgaaggcaagtttcatagcttaaatagtgggcagaactgagatttaaacccaagtctgtctcatgctacaactgcagtttgtaaatcccatgtgttattacctccgttagtcgataatgtacagtttagttcatcagctatgctagtgatagaaaacaatgataccataacagcagcaaattataggcatttgtaaacttttcagaatgaaagttggtagttcttttaataatctcactggaataaataatctcccttcattttagtctttttatgttagacacgttttctccataatttctaagaccttcaaaacattgcaattatatattattaattattaatagcttttatttggtaactttgtaattatatttatatgagtttctctcctcagtattatgtattaggccgggcgtggtggctcatgcctgtaatcctagcacttagggaggccgaggcgggcagatcatgaggtcaggagatcaagaccatcctggccaacatggtgaaaccccgtctctattaaaaatacaaaaattagctgggtgtggtggcatgcgcttgtaatgccagctacttgggaggctgaggcaggagaatcacttgaacccgggaggtggaggttgcagtgagccaagatcgtgccactgccctccagcctggctacagagtgagactccatctccaaaaaataaataaataaaaactttagacaaatttaatattccaggattaattgagcaaataatgatttacaaatcagacagccctcagaaccaacagaggttcagaaatctccacttcacaatgtggacaggcagcctttatggacagaaaacagaagagctgtaaagagaccacttgatgagttacagtctggagcttgcctcccttgaacatggtatgatcagttggctacctgtgattgactgaagttcacctactagctactttgattggctgagactcagctagttgttatgaaagtctactcctgtggtagactttcagttagtttacatactaagttatattgtagtttgttacataaggactcaagtacagaggcatgcttaagtcaaatttagtttaacatgtggtagttagacccttagtttcagagtccaactcttcgggttctgatctgggctttagcatttattagatgggtgaccttagacatattagccttctctacttcaaatatctattagccttctgtacttcaaatatctcattgttaaaatgaggatataaaaaaggcacttatctcacagttttgttgtcaggtttaagttagataacttatgtaaattgcttaacacattgccttacaaaaattaaacactcaataaatagtaactattactattatattttgaaatattgacaatagagattttatcacatgcatccttttatatgtgaatgttggtatacaatgggtagttttgggaatgtgtataactgtaagcatgggcaacctatcagtaacttaaactgataatggcttattttatcatataaaaagaaatccaaactggggtttttgaaggaataaataaaattaacaaacctttagccagactaactaagaaaaagaggggaaacccaaataaataaaataagagatgaaagaggagacattacaaccgataccgcagaaattcaaatgaccattagaggctactatgagcaactatatgccaattacttggaaaatctggaagaaatagacaaattcctagacacatacaacttaccaagattaagtcatgaagaaattcaaaacctgaacagaccaataacaagtaatgagatcgaagctgtaataacaatcttccagcaaagtgcagcttcggactcagtggcttcactgctgaattttaccaaacatttaaagaagaactaatactaatcctagtcaaactcttccccaaaatagaggatgaggaaatacttccaaactcactctacgaggccagtattaccctgacaccgaaaccagacaaagacacatcaaaaaaagaaaactataggccaatatcccagataaacattggtgcaaaaatcctcatcaaaatatgagcagacataattcagcaacacattaaaaagatcattcatcagctgggcgcggtggctcatgcctgtaatcccagcactttgggaggccgagacgggaggatcacttgaggtcaggagttccagaccagcctggccaacacggtgaaactccgtctctgctaaaaatacgaaaaatgagctgggtatggtggcggacacctgtaatcccagctactcaggaggctgaggcaggagaattgcttgaacccgggaggcggaggttgcagtgagctgagatcgtgccattgcactccagcctgggcaacaagaacgaaactctctcgaaaaaataaataattaaaaaatatcatttatcatgaccaagtggaatttatcccagggatgtgaggatggttcaacataggcaaatcaatcagtgtggtaaatcatatcaaccgaatgaaggaaaaaaacataggatcatttcaattgatgcttaaaaagcatttgataaaattcaacatcccttcatgattaaaaaaaaacacccttaaaaaaaactgggtatagatggaacgtacttcaacacaatgaaagccatggatgacaaacccacagctagtatcatagtgaatagaaaaaattgaaagcctttcctctaagatctggaacatgacaaagatgcccactttcaccactgctattcagtgtagtactggaagtcctagctagaggagtcagacaagagaaagaaataaaaagtatccaatttggaaagagagaagttaaactggccaggcacggtggctcacgcctataatcccaccactttgggaggctgaggcgggcggatcacctgaggtcaggagtttgagaccagcctgaccaacatggagaaaccctgtctctactaaaaatacagaattagctgggcatggtggctcatgcctgtgatcccagctactcaggaggcggaggcaggagaatcgcttgaacccaggaggcagaggttgcagtgagccaagatcatgcctttgcactccagcctgggcaacaaaagcaaaactccatctcaaaaaaaaaaaaaaagtaaaattatccttgtttgtagatgatatgatcttatatttggaaaacactaacgactccacaaaaaatattagaactgataaacaaattcagtaaagttgcaggttacaaaatcaacatacaaaaatcggtagcatttctatatgccaacaatgaataatctgaaaaaagaaatcaagaaagtaatcccatttacaatagctacaaataaaataaaatacctaggaattaaccaaagaagaaaaaggtctctacaataaaaactataaaacgttgaataaagacattgatgaagacacaaaaaatggaaagatattccatgttcatggattggaagaatcaatattgttaaaatatccacactatccaaagcaatctacagattcaatgcaattcctatcaaaataccaacaacattcttcacagaaatagaaaaagcaatccaagaatttatatggaaccaaaaaatacccagaatagccaaagctatcctgagtgaaaagaataaacctggaagaagcacattaccgagcccacgttatgctacaggccactgtaatcaaaacagcatggtactggcctagaaatagaaacatagaccaatgaaagagcatagagaacccagaaacaaatctatacatctacagtgaacttatcttccacaaaggtgccaagaacatacattgagtaaaaaaccatctcttcaataagtggtggtgggcaaactggatatccatatgcagaagaatgaatctagacctctatctcgaccatttacaaaagcaaaatcaaaatggattaaagacttaagtctaagacctgaaactatgaaactaccagaagaaaacactggggaaactctctaggacattggactgggcaaagatttttagagtaataccccacaagcacaggcaaccaaagcaaaaatagacaagtgggatcacatcaagttaaaaagcttctgcacaacaaaggatacattcagaaaagagaagacacagccccaagaatgaaagaaaatattagccaactatccatgtgacaaggcgttaataaccacaatatacaaggagctccaacaattctatgggaaaaaattaataatcaaattttaaaatgggcaaaagatctgaacagacacttctcaaaagaagacaagtaaatggtaaataggtctatgaaaaggtactcaacatcactgatcatcagagaaatgcaaatcaaaactacaatgagatatcatcccaccccagttaaaatgggttttatccaaaagacaggcaataacaaatgctggttaggatgtggggaaaagggaacccttgtacactgttggtgggaatgtaaattagtacaaccactatggagaatagttttgtggttcctcgaaaaactaaaaatagaactaccatatgatcttgccagccccctgcaaggtatatacccaaaagaaaggaaatcagtgtattgaagtgatatctgcactctcgtgtttgattactgcactactcacaatggcaaagatttggaagcaacctgtgttcatcaacagatgactgaataaagaaaatgtggtacatatacacaatggagtactattcagccataaaaagaatgagaccctatcttttgcaacaacatagatgtaactggaggtaattatgttaagtgaaatgagccaggcacagaaatagaaacattgcatgttctcacttatttgtgggagctaaaaattaaaacaattgaactcagggagatagagagtagaatgatggttaccagatatgagaaagggtaaattgggagggggagtgggagtggttaatgggtacaaaatttagttaaatcaaatgaataagatctagtatttgatagcacaacaggctgactacactaagcaataatttattgtacatttaaaaataactaaaagaatataattggattgcttctaacacaaaggataaatgcttgaggtgatagatatctcatttactatgatgtgattgtcaggtattacatgcctgtatcaatacatctcatgtaccccataaaaatatacacctactatgtacccacaaaaaaaaatttaagaaaaaatctaaaggcaggcatatgagaactgatgtgccactaagcattaaggtttctttcatttttctgccccgctatcttttaatttgtaagtttcatcctcatgttcacagaatggctgcagtaagctggatattacattcatatttcaggaagatatgggggagaagagcaaaaggggaaatacaaaaacctgggaatgatggggaatgctatctgagtctgtccatgctaaaaaatccttcctggttttcctatgaaaagatttctgcttccatcatcttggcaaaaacctggctaggtagctacccctggctgcgggaaagtctaggatggtaagtattttagttttctattctctatataaaggaagacattggaattgaatggctttggggtaattgattcataatatctactatagtactcattaatcagtcagcagccagtcaatgaaccaaagaaaaaagtcaatatgaaaccctttaaatgaagcatatcaaacctttttaaacaaaatgaaattcatgtatatttaaatatgatgatccctcttacccagtattttgccactaaagtgttagaagtaaggaatgaaactttacacagataatttattttggcagcattgctatggtgctaggaaaaaaattgtccctagaacagaccctgaaaacaactgctcatagcaaatactcataggtgtttctgctgctacagataatcacagaagttgccagaaattaaaatgtgcaaaggataaatacaaatctttctcctttgcaatgttggagagatcttgcttcttttttaacctccataattttgttgccctgttttgcagcatctttgcaatgtttctgggacagctcagtcatcaccatctcaatctcattcaccacagaacaagtgcttgtcaattgtaaatgtgtaatctcaggaaattcttgcctgctctcttcatctctggccatttgtcctccaacccatccattcatagtgctgttataagcttcccaccccagggttagtaatcttccagggctctgtttcatccagaaagccatcaatgggctgtacctgctgcagggggatctttcactttccacacccttacagcctcacatttatgaaagtcttctccaaaaaatcttccttattctattttgaaggaaataccttctacctagaatatgtttcattaatcctcaaggcaagatataattcttccatcaacttgacttgaactaaactgacaccatgctaattttttctttccattctttcctcattgtcaatatgtttttactgattccttgcttcattcattgattcatctggcaaatactttttgagcatagaatatgtgcgagaacttttgtgaaagataggatttatagagatcaagaaaatttagggcatgttctcaagggggtcacaagcttttgaggaggaatgattctacgtttatattgggatagcctctggtgttttggaagtcttgagctgtaaccgaccaacctttcattctccctttccatcacccctttgccaaacacacataccttgctatgaaaaattcttaagggcaacagggattcattctttccttttcttttggctttacatcccgttctacaaggactcagtgggattctaaaaaaaaaattattttttctaaaatattctggaaaaatatttggaataaaattgagatggagtgagataaggatattttcttgacttgtgagaaaaataacacaaccaaacatcatacaatgtgattcaatgaagattcatgaaaaaaatacaatttcaaacttcagaaattaaaaataatagacctaataatatttccctttgtatgtatgtggcatgatgttgttatattacttggtagcagagtggaaatttgagcataatctaggttgagagaaaaggtcattattcttagttctgtgtttttccaatatactgtgttcttcaaaatataccaaaaattataaatcagtaataattgatactttgtacagatttttttattttatattttcttgtttctcttgcaatatcttttctttgattttttgtttgtttgtttgaaacacgtatttgccactgttcaactcttacacctacattctcttttgcttactgaggggaaatgggccccataaaataggtgtaactcagtatctcagttcatgttcaaacatgtataaagatgacctctttttctattcttgagcaaaaactaaatgctcatgatatattcttttatgtaaaatctagttattcaagttaagttctaaatgaatttttcttcatcttatttaagagtaagtactttttttcttccatagtactaggtaatcgttttcagtgatctgaaatacttacgaagaagttaggatctttgcaactgtttgaatctcaaattattatttgttctctgttggctgtaagagctcactcattggaattacaaaaccctttctctttatagctgaaagcgtttaatgtatgcaaacttacatttggcttgagaacatttttaaaaataaacttttcaaattggaatgttcttactgaattcaggcttttatgatgctgtttgatttggcatatgttcctcctgatatctgcattgaaaacactttgcatttgagagacttttcctgccttattgggacatttcaactcaatttatagttatcagtaggaaaagaaagaaaacatttccatccaaaagaggtttcagtaggatttagcagtaagtgctttaaaaagaacaacagcagcaagcttgaacctttgcccattaaaaaaaatatatcaaaaacaaagaaacattacaagattctctttccctttttaaaggatccacagaaggaaggttcttcctagtctatttgaaaatatatcagacttactcaagagactttttttgtctattttacctgatccacttacattcagaatcagtctgaatttattacacaatgttacgtttactgctaaaatgctggtcgttggttcaatacttggatccttcagagagagcacatatccatcaggatgcatttggctttacgtaatagtcaatttttggaagtttagaccatgaagatgactactctttacttaacagaagtctggggtaggtgttgctgtggttggaaaggtgcatgtatgataggtggacagctccctgtttctttataaatggcacatacctggagaactagcacataggtagctcaataaacagaatgttaccaggacccccagaaactccctttttattctgttttggttctcactctccaaaggcaatcagcgttcagagttctgacaatgtaagttatttttcctatttttgtaccttttataaatgcaattatgcatgatatactcctttgtgtcaggcttcttttcttcaacattatgcttgtgagatttactcacactgtggcttgtagttgtagatagttcattctcattactgtatagtgttacagtgtcagaaatatgcaccaatttatatgtctattctactgcttgaggagtttccagtttatggctattacaaataatgttacaatgagcattttgtttttgtttgtttgtttgtttttttgagacggagtttcactcttcttgcccgggctggaatgcaatggcatgatctcggctcactgcaacctccgcctcccaggttcaagcgattctcctgccttagcctcctgagtagctgggattacaggcatgcgccaccatgcccggctaattttgtatttttagtagagatggggtttctccatgttggtcaggctggtctcgaactccagacctcaggtgatctgcctgcctcagcctcccaaagtgctgggattacaggagtgagccaccacgcccagcctatacaatgagcatttttgtatatgagcatttagtatacgtctttgagtaaatacaaacatacaattcggcttgatatatatctaagaaaggaattactgagtcatagggcatacatatgttgagcttcaatgacgctgaagagaaaataacacaagcaaacattatgcaatgtgattcaatgaagattcatgaaaaaaatgcatttcaaacttcagaaattaaaaataatagaccagttttccagagtaagacatctttttttttcattcttagatcatattttgcgttttgtaaatgcgtttcccaatcagcagggaaaaaaatataatatgcaaactaaagcatgtatacaatgaattgcatttagtttaaaacaaaagatttgaaaaacgtaggaggagagagttatatttgtattagttcacaaaagaacatattcaaaaaaaagcaaataattgtattttgagtgtatcatagagttaaaaaggatggagtcaggctttttgaaaattgacttgttttccttctccccttttaaagaagataggttattgaggaaaaataaatttttgtcatttcagagagtacctgttcttttttttttttttttgtagaaaataaaacccacctataaaacatgaagattaagcttggggtagctcaagggaaatgactcaaaccatccaaacacttgttttttcttttttcagtttttctaatgtaaagttaaatcattaaataaaattttggtagctatatttaagtctcccttattttattttttagtaatattaaattattttaggacgcctgattttgtggtaagaaacatcaaaggtcttgatataatttttgaccgatgggctttgaatcaaccaattctagcctgtgggtagaggacagagcactgctgtctcttgcatattaacctttatggggctgctggagttgtggacattgagtatatagtgctagtttgtactcggattgatttattttcaaattttcaaaagaatatctaagttcaatgatattcttttagtttatctctcactgtcaaaaagtctcctccaatgtcattttaagtgagaaagttaaatgatattttgaaacactggcttggggaaaactgcagttcagtttgcttcaatgagaaggaaaaataatttccaatattagattacagtgaaaagaaatataaaagagagttttactggaaggtctgccttttatccttttaacgtttcatggaactagaataagaatatcccattttgtctaagatgtacctttaagcaactttttaagcctcaaggcacttatcttatacattgtgctcttcagctgtattaccagaagtcttttgtttaaaaaagcctttggtaaaattcttcaaatatgaatttaagcctgaacaacaacaacaaaaaggtacttaacattgctgcctttctttatgtaatgatcaagtcctcccatgttctcctttatatcagtaagccattttcttgaatccctttctaaaatgaggttaaagaaaaatgtgacataaatcctatatgtatgttctgatttttaaagggtctttatctttacttttactggttcgaatatagaaattatctcctcccgtttccttctcctcaattagctgccaatggtctggaatttaacgattttacctcatgtgattctatttgtttgtaatcctatattcaacattgtactgaagtctgttaaacattgataagccggtttttatgcagcaggtcctcagagagcattgcactaaaatgctgcaaagactgggattaggtttacgtattgtaaggtggtttcgagacgttttcctagtgtctgttctttcaaaggtgccaaatcaagttggccttgatttaatattgcgaaaattgtaatgctgagctgacttggagcttcacgtacttcaaaacgagtttttccgggggtgatttaacaaacagttctaattttttgagtgctgccgaatgtaacgcacatatgggacattattgtgtagtttctgtgagacgctgaactctttgccaaaaacttaagtttctttcattgctattcaagttataccttcttctgttatctcttgccaggattccaacagcctcagctgatactggtttcatttagtaaggagagtggcattggattgtatttcttctgatttttacaaaataaaaatcctcctgcatcccatagataaccactattagcatttgggattatatctttttcatatgtttcctataggtagatataaattttgaaaaaaaaggtattttgtttgaaagattcttttgtaactcactttaaaaattttttattatgtaatcatatatataaaagaatatatatgcatatatgatacaaagaataataaaatgaacacctgtgtaaacaccacctaccttacagaatagtaccaatgttttgaacccccatgtgtctctaccaaatgttcatcttttccctatcttgcaaagataactgcgcttctgaattttgtatttgtcattctcttcctttaaaaaaactgtttcactaaatacatacgtgttcctaaataatatattgttagtttgggtgtgtttttgaactcgatataaatgtgataatgcatataatcttttctgactcgtttataattccacattttctccgaggtgcctccacactgatgagtacactggtagttccattgttttgactgctatttagtattgtatgatataaacatatggtgctttttacttaagttcttgttgatggtgggtggcttgatctcaacttttgcactgacaagcaatcgtcttatgaaaattcctgtatacgtctcctggtgcacatgagcaagaatttcttcagggccagtgactagggatgagactgttgggttattagataaatgcagtcaaacttcaaggcgatgccatattattttccaaaatgattcacaaataacgctaagatgtcattgtgtcaaagtttctacactttcctcgatccttaatattgttctaaagccttcataaaatactatctcattgaatttacatttccctgatagtgatgttgcacatcattttataagaggtaactatctgtccctcctgttctgtattataattttcatcagcttttatattgttaaatattttctccctgtttgtaggttgtattttcacttttcttttttttttttttttttttttgagacggcgtctcactctgtcacccaggctggagtacagtggcgccatcttggcttactgcaacctccatctctcaggttcaagcgattctctcacctctgccccccgagtagctgggactacaggcaggcaccaccacgcccggctaatttttgtatttttagtagagatggggtttcaccatgttggccaggctggtctagaactcctcaaagtgatccgcctgcctcggcctcccaaagtgatgggattataggtgtgagccatggcacctggccatattttcactttattaatagtataatttgaagattagaagttcttaattttaaatattatcaaatttattgttaatatttgccttaacggttagtgatttgagtctcatttaaaggattatttcctaccctaagatcatacaaatattctccaatattttcttctgtaatgttaatacattttctgtttatctttataatctaccaggaattgagtctttgaatggtgtgagtgatttgatttcttttttttttttttcaataggaacagtcaggttttccatcactgcatattgaagagtctattcttcccctactgaactgcagtaactaccctggtcctgtatcacatgtattagaatagaaccagctgctataataaatattcgccaaatgtcagtgacccaatacagtgtgactggttttagtcaatgctttcctccacttgcttatttaatgacccaaggtccttctctttcatgtctgaccattcactaggacattatagtctactgcagccagctggcagatggaagaagaaagggtagagaaggcatgtcaactttggtttttttttttttttttttttcctgaggtggagtcttgctctgttccccaggctggagggcagtggcgagatctcagctcactgcaacctccgccccccaggttcaagcagttctctgggcctcagtctcctgagtagctacgattacaagcgtgtgccaccacgctgccaccatgcccagctagttttttgtatttttagtagagacggggtttcaccatgttggccaggctggtctcgaactcctgacctcgtgaacctcccacctcggcctcccaaagtgctgggattacaggcgtgagccaccgtgcccagtcagcatgtcaacttcttaaacaccttgtttagcaagtgattatatcacaaccgttcataatccattggtgaaaactagtcatttagccctatgtaaatgaaaagattgctgggaaatgttccctgatggaaagcagcttctcagaagcatctctatctacagtgtgggataatatgaatttggggtgtttagctagctgtctcaattatatcaagttttcgtatatgcactggtctttgtctggtagggctagtccctcctctttattgatcttcttcaagtgtgtctcagctattctttgtcccttttcaagtatcacaaagaaaaaagtcactgtttgaattgggaagctctgaatctacagggcagtctggaaataatatatttacataatgaggctacttacccattagcagtgtacctctctgtttacttacatggtctgaaatgtctttcagtatactttacagtcttattcaaaaggtcttatatcacttttgttggatttattcctagagattctgcttttttgctactattataacctgccttttctaaacttccctttcatgtctgccaatacatagacatgaaattgatttttgtatgtaaattttgtatcttgacatcttggtttggtttgttattaattccagtaatttgtgttcagaacttttggagggggcttgtatgcagatgatcatattatatatgaataatgataagtttttatttctcttctaatttttatcttttatttgcttgtctaactgaaaagcagtgataggcatctttgatttgttccttattttagagggaattattttgacatttcatcatcatatatagtttgctctagtttttttgtaatgcattatatcttctttaatacattgcgtgattctgtttgccaatatcttctttagaattttccatttatgttcacaagtataatattagtttatgattttctgttcttatactgttctgtgcttagttttggtatcaagattattctagcttcattttggagttgaaattttcccattttctgtttcctaagaatttcttatgagtttggaatcatctgtttttcaaaagtatagtagaactcacccataaaaccatttgaggctgctgttttctttaagaggacattttaacgctaattttgattttctaatagttaaagagcttttcagttttctcagctcttcttagatcagtgttgataaattctgtgtttcaaaaaatgtgtttgatttattttagctttcaagtttatgggcatacttccttcatggcttttaaatctcttgtgagaatatatgcacacctcttccctttattgatgtcttctttccttttgtcctgatcaatttttcaagtaatttaaaattttgtctcttcaaatattgtctctttaaatattggatattttgaagttctatattgatttctgcccatttatttttttttctgctgctttattagtatttgtttggtttttcttttgttggtttgtttgtttttttgagacggagtttcactcttgttggccaggctggagtgcagtggtgtgatctctgggctcactgcaacctctgccttctgatttcaagcaattctcctgcctcagccgcccgagtagctgggattacaggcatctgccaccacacctggctaatttttgtatttttagtagagatggggtttcaccatgttggtcaggctggtctcaaactcctgaccttgtgattcgcccgcctctacctcccaaagtgctgggattagaagcatgagccactgagtccagcctatttgtttttccaattaagtgtttattatgtgtatttatgttaactttctactataaatattacgaatttttaaaattattccttaaaggacctcaaatattttgctcatttacttctactatgtttacatttccattatgatttcttcttttacccatgaattatttggaactgtatttttaaattttcaaatgtattttcaggttatctgtgttatttctgtctaatttgattatattgtatggtatcaattttttaaaattctgagaatgttttattgcacagtgcatgacagctttctgcaactgtttcatatgtgcttaagaagaatgtgttgagtacacatttggaaacgtgatttttgcaggttcattaaatcaggcttgttgattgggttaatgggatcttccacatgcatgtgttgaaatgacccactaagctcccagatttgattagttaccttgtagttctgtctgtctagtttcccctatatatgcggaggctgttttctgaactcatttaaagtttggaataattttattcaccaggaggattgacctttttattgttatgtagtcttttgtctgatatattattatataatttatatgttagctttcttttagtttgtattttcctggcatatctttagctcgtatcctcaagttttctgttctcggtgtttatatgtctctctctcccttataaaaagtctattgctggatttaaaaaatctgtaactccacagatatcctgtctgaccacttttgcctttcatatagggcttttagttcactcatattttcatgtatatttattacaattacttttatacttgaacttatttatagcattatattttctgatgttgactttctttgtctttgctcctctttttccttctttactgccttctttttgagtggttgagttttatattcttactctaattttccttcttccattttggaatttgtgcactctttctattattttaggtgttactcttaaaattttactatgggttatttagcaaattaaagaataatcaatggtttagtttttctttccagataaattaagaacctttatgaataataacttctctctcattgtacccgttctcattatccagtgtttagttctattttgtatactttaatcttcaatattacatattatagctatagttttatataattaattttatttaaatgtattcacatgtttaccacactctttgtataccatttccaaaatgcttgggtaagaattgatactttgtccaatagcaagggggggattatggacatttttcatctgaggaaagacatgatcaaaatgatactttaggaagattaatctgatgcagtcaaaaaagaatggagggaggaggagatgataagtagaaacacaaattaaaggctatgacccgggaacttggtacaatgatttgaactagaggggtggtaaaggagaaaaggagtaagaacaggaagtaaaagtcactgtgaaagaggaatacacagaaattaacaagtggtttgcttgaagtattgaagaaaacaaaaataagaatgagatttttgaaccaaggttactgaaatattggtgaaatattagcaagtaggaagtcagagaaaagagctgctttcaggagaaagataaagaaatgcccatggcatataccaatgatacactcagcacagaggtctacatacaacagagtacttgtaaatacaatagggtacttgagagaagttaagactggggaaataggtgttatagtggtaagcatatatgggtcattagtggagaaaaatatcgaagagagtgaatgatgtcaaataaaagtgctttgtgtaatgttggacagagatatacccccaaagaaaatgttcaaattttgaaagcccaacaagagtcagcactggagatacagaagtcaagtcagggagaatctgcttttgtggaatatcatctatatgtggtactgagatagatatttcatatatattacctgatataactatcaaatgaggaggtggtatggtaccagtggaggagaatcattcaaaaagaacaaggtgttcagcagtgtcaaacgatgcagaagcactaagatgagaatgagaattaaagaagatgtaattgtgtgattaggatgtgattgaaacgtttgcagataatgagttcccagggaaagagacagaaacaaaactgtaaggacttgatatggaaatgaatcctgtgccagtgaacactgaaatgcaaacaagacttaataattcagtgacaagggattgtagcaaggctcagagaagatgcttctgatttaaaatagaatagctaagttatgtgacgaccatactgtctatacataatagacactaaatttatttgttgaatgaaaagctaagtgttcagagtttgaaaaataggaaccagagggaaggacaaataagcaattgaaagttactgaattgataagttctgtgatttaaaaattccagcaatatctgtaagaaacacaacttcgtggaattctacagataaagcacaagctttggactttttgtgatttcttttctgtacgtgtttttaaatgtacagcaagtgtaggaagataagcgttgataaaacattacttgagaaatgttaatttgctattaataacaattgacatttaccattttaaaggccaaagagaggtgaattttgataaaagataggttcttacttggaaacgtgtatgcaagtacactgaagaggtcttcttaatatagcattttataactcatctcaaatgttagcagccctgtttttcattcgtttccaaaactcatcaaccccagtcataataccagccacttaatacagatcccataagtctgtcatgtgttgtttacttaaatgtgactgtttctgatgacttttaaagtccccaaagcagttttgtccacgttaattttgctctgtatctcagcattcattgcagtacctattgaaagtgatttcactagcataagataaaaatttgatgacacatttaataggcttactctcaaacaacggattgactcaaatattatcaacaatgcaaggtgggctcttatgccaagatgtgttcggtttttcaaattttaatctaacgcctgaaatttgtgttgcataaatgtttgtcttattctgtgtataacatatttgcatatgtatatttgtgttctgtataagtacagaatagttaaaatgtgttctctctatgcttacataaatgtagcagtgagatattgataatagcaataatagctacatttattgattgttaagtgcgaagctctgataaaaatgttttataggtatcattgtacaaatcattcaaataaacttctgtggaacatacaatggttattcctattttacagaatggggtgaataaagggacacagagaagttaaaataatttactcgtggttacagagccaggaagttctagagctagatttctaacccatgcatgctcactctattgtgtacccagtaatcaactggatatactgtgattttatattaatcaaaatgcaaagatgcagaagttgtgagaaaattccctatctctagccatttattttcctgaataaaaatacatctataaatttccccttatctgatgacatcttaaggaaatggtcatgtaagccaagaatatatattatagtttactactaagttgttagaacaagctaggcaccagtttatatagtctagaacaatatactcaagtactgatgcttattatgcccaggtggtagtggcattatttgagaggttatgttttgtgtgaaatttctactttaaaaaaaatgaatttgttttgacaaaaaatataaaatgggcaagagattttgaaacaagtttacctagatttgcaacaatatatgttagaaactgtttgctttgattatacacacatatatgatatcctaacatgtatgaagcaattctttagttgatagtgacttatcttaaaaatgtataatccaagaatcatggagcattgtatttagaatttaagagtatacattttaacaaaacacataagaatataatttttatacaaaacgaccaaaactgagtctttaggatcatagtttaaaaaatgcaatatatgttctcataaatatatgtaaatatgtatcatatatagtaaatatatagttacataaaatacatatatttacatagatgtaaggatgtataaaatgtacccttaaacatgtttaaataataaaagaacacataaacattatacctacatttattttattctatattctataattctccaaaagtgggaaccattttcttacaattacttatggacccaaattcctcaaaattaaaagatcatttcattggcacacttacaagagacttagctgacaggggtagtttttaaaatcaaattaagtggactccagtttcagattcatcagttaaggagcttagaaattaccactcaattcttaacaagtaaaaagctgaacaaattgaaaatcaacaacttttctcagatctgtcagacaactgaggtcacagggcaaaaagctgcccccaaaattgcagaaacagattgatggatacaaagaatcacaattttctgagcagaaacctccaagggaactagttccagggtacaaaaacctgtaattgacgaatctttggaggctaagtgtggaccaagtctgagagttaaaaactacaggacagcccagtcataaatcatagtagggggctgatgcttttgtgagttttaccttcaggagccttaccaagtcctaatagtgagcatcagagaaaaatccctggtgcatccatcaaggaaagggggaaaatacagattttgaattatacacaagataattctgttgttagcaaagtctgcccttaggagaaactatttttccagaccctagccttatggggtttaatcagagcctaacctacctggaaggaattgaaataattcaacttcagctccttctagtattctacaggggcatagggaaataacaaattccaccccgctctggccatcctgcccacccaaagagggaaagaaaacaactcagactcacttgtgaagctaacagtctaatcacacagacttacccaagatagtttcttttgctgtgcagaagctctttagtttagttcggtcctacttgtcaatttttgtttttggtgtacttgcttttcaggactttgtcataaattcttgcccaaggcagatgtctgcaatggtgtttcttaggttttctgctagaattattatagcttagagacttacatttaagtctttaattcatctcgagttattttttatatatggtgaaagacaggggttcagtttcattcttctgcatatgactagccagttatcccagcaccattgattaaataaggagtcctttccccattgcttatttttgctgatttggtctaagatcagatggctgtagatgtgtgactttatttctgggttctgtattctgttccattggtttatatgttgggttttgtactggtaccatgctgttttggttactgtagccttgtagtatagtttgaagttaggtaatgtgattcctctgattttgttcttttcacttcagatgactttggctattgaggctattttttgggttccgtatgaattttagagtagtttttttttctaaaattgtttcaaatctctacaatgtcttccagaagctagaaccagaggaactagttcttaactcattctatgaggccaacattaccttaattacaaaattagtcaaagacattacttgacaagaaaaatgcaatccaatttctctcaagaacatagacgcaaaaatcctcaactaaatattacaaatgaatccaataatgtataaatagcatcatgcatcatggccaagtgggatttatcccagttatgcaaaactggctcaacactcaaaacttaattaatgtaatctaaaatatcaatggactgaagaagaataatcactttatcttatcaatagaggcagaaaaagcatgtgacacatcccaaaaccctttcatgataagaagtctcagcaagtagggataaaagaaaacttcctcaactcgataaagaacatctacaaaatacctacagctaaggtcatagttaatggtgagaaacaccaagctttcctgctaagatcaggaacaagacaaggatgactccactcaccactgcttttcaacatcatactggaagtcttagctaatgcaataaaacaacaaaaaaagaaaataaaaggtacagatgctccttgatttatgacaaggttacatctgcaaaaacccctgatcagtagaaaatattgttaagtcaaaagtgcatttttcaacttaccatatttttcacttattgatgtgcttatccagatgtaacactatcttaagttgaggagtgtactgaatgtgtatcccttttgcaacatgataaggctgaaaaattgcaagtcaaaccactgtaagttgtagactatctatatagacagggaaagaagaaatagaattgtctttgttttcagatagtatcattgactatgcagaaaaccctaaagaattgacaaaacagcagcagcaacaataacaaaaaaacacctggaacatttccctctgatcctagacagaaaaggttctccacctttaggtccttaaggactcatgtgattcagttgagaccactcagataatccacaataatctcctcatctcaaattcttaaccttaatcacgtctgcaaagtcccttttaccatgtaaatttgcatgttcacaggttgccaggattagaacatgaacattttcgcaaagggctttgttttgccttctatatccagtcaattacttccagttaaaaaacttatttatgttatataacacttgatatttgccaggtgttatgctaggtgatatttaatattttaaaatatctgtgaaattagtgatatcagccttagaaacatagatggaggggttggtcaccactcattatttaatgtaagtaacttatctttgtgtttttatgtaattattctctgaaatactcttattcaacaagcaagagtattcatccagcattaggaaaatattttatctttaaatttaactagaactataacgttttagaagtaggccatcactatttaaactcttaaaaagtcatagttaattaacaccctcatatgggtctttgattatcgctataataaaatctccatttatagataagagcaatgtgcatcacatgtaatgtaaacctgtattaatagattagatgaaatattattttctaactgtaagagttaattactctgaacaattccacaataaatagtcatagaaattgatttgggatatatacatctctctctctctttctctctctctctcacacacacacacacacacacacacacacacacacacactcgccccccccacccccaccccacccacacacacttctttctttgcttcttgcctggctgtaaatcggctatttttccatatcccatcatgagcctaaagggaaacatttgtatatttcaggctcctaggaaagcattttgaaaattcatttaacaaaattgggcaatatcaatgacttcaaaattagcaatggcagaaaagaagtagtaattaatagcagcggaaggattaaaatgtgttaagattaagttaaacatgtcgttgaatcactgtaagagactgctgattgcagagcctcttagtgtttgatattactctgacttgatgctgtggaattatatttctgaaataaatagttcttagttctgaggttatgctaaaggacatgttcaggaagagctttcctttcttactgcctagtcatacccttaggcaaagaagcagtaattttgaagggacaatgtaaaatagaagaataggcaatcttggatatgtgtagtttcacatttcatgtttatagatgtaaaagtattatgttaattatagaatagcacgttttatttatttatttatttatttatttatttatttattttttgagatggagtctcattctgttgctcaggctggagtgcagtggcgcaacctcagctcactgcaatctctgcctcctggtttcaagcaattctcctgcctcagcctcccaagtagctggaactacaagtgcctgcccccacacccagctaatttttgtacttttagtagagtcggggtttcaccatggtggccaggctggtctcgaactcctgacctcaagtgatccacccgcctcagcctcccaaagtgttgggattacacccggcccaatagcacattttaaagtgaatttatgttcaggtaacatgaatagaaagatttcttgaagtttcaaccagcttctgaaactttgtaaacagattaaataaaatttgatgattaaaatatattcagttaatacatatgaaaagattcaactgtaaaatatgactaaggcttcccgctaataaatggcattatgacgaaatctgtagtaaactgtgggcaatgtatatggatatgattttaaaatcatgagaaagctcattactgttggctatgtcattatagcatgatttttttccttataatatgccaatcaagagtaactatgttatgttaaaaggagaaaatgtggtgttttaaaagtgataaacctgatgtatttaaaaattttttgagatttcctctggagctgcactgcccaatatggtagccactggccccatgtggctgttgagcacttgaagtgtggctagtagactgagacatgttgttagtgtgaacacacactacgtttcaaagacttcatatcaaacagtaaaatactttattattaattttaatattgattacatgttgaaatggtaatattttagatagattgtgttaaatatgcatattattaaaattaaatttagggtttttttcacctagtttaatgtggctactagagcatcttaaaattatacatggggttcacatttgtggtctgcatcttatttgtgatggacactgttgttctaaactttcctaattactgagacatttcccttcatcactttttgggatgcagttttcatttataagttaatggtaaaactgcacaagtaacggaaatatacttaaaagatcaaaatatgaaatttagcactttcaaaattcctcatttaatgcttgagtcaatccttggaaaataattgatccagaggatatttacaaatagtccatcatcaaaaataaagaggggcatagaaggtactagagctctatgtataaaatcctgccctctggcctattctattatactcagaagagtctgtgtcactaatatatagtaattatcgtcggaaattatttgctatattaggattccctatggaaaagtgaattgattgaaaagatttagcaaagagttaactatcaactttggtttttaaataacatgtgaaagctaacttactctaatcactctgtggccataaaaaaggctctgcctccaacctccagaatctacatccaacaagaagtcttggtgaaaaggattggcaaaaagactgcaggttctggcaagggtttgtaagtggaccaacgaattggcatttgaaattgttagtcttataaaatgaatcattgagactggaaggtcaatgtaattggcaagccatgtgtcacctttttcttgggagaaaaacacatcatttccataaaaaagtatagagcatataaaagaataagaaagtaatgataaaacagaacttacagtgacattaaacagaaaggtatttatggtaatggatttggtactgaataataattaggctaataggataaattgctcacaaatggtacatttgggcaggaatagtgtattgttcactaatgtatctacaaaactgaatctaatgcccagcattttgtggaagggaaaaatgaattaacgactaatgtcatatatacataaactagctatcaacaagacaagctagggattagagaagacagggaaagaggaagtaatgctgatgcctctaaacatgaccaagatttattcttcactccttttagtgttttcaacgttaattcctgtagtgttctcttgccttctcaaaccagacttatttttaaagcagcttaggctgagtagcatatttttataaaatggtcctctgcgccatttctaagaatcataggtcaaattagtcaggctgctgttctaacactgataattatatccacctcctaccaaaatctgtagttaattggtagaaattcaagctttgtagattttagttgttaaaagcgtcacatggagaaagtacaaaggctgtcctaagtaaatgactttaagattgatttttgaagccttttctttactcaaaaaaagtaatggccagcttaacaaatgcctccagatgaattgcttgttgtgttcatcattattatattacacattcccctggaaactgcagatgataagggtgcattttattctgaatgttgtgtaaggcacactgcattttgaaagagttcagtgatgttaggataaatgtgtatgagaaatacgtttgaatagattcagtaagtctattcactagtccctttttcaccatttgctgtttggaatcaagtttgggatgttccatgcatggtcatcttactttagggtatagaacatcaggagtttaagaaactggggtttttgttttgactgccatcattttgctgtgtattacttgacaaggaatagaaggggaggcagggattagatcaagcaaagaagtacccagtaagaaagacctttcaacaatgtataaagaatttattttaaataaatttctgaaatggttaaaaaaaaaaggcagagatgagttaggtgaggtgagtcaagcaaggtggctgagggtttagattttggaaagtcacaacataaccttttacaactgaaatacatcatctgtaccatgcggataattgcatttatgtcttggtggtgttggaagaattaaagggtataatatatttaattcacttaatagagtgcctgacatatattaaattttcaaattgttgttagagtggctgcttcaaagaatagctaattttacagtatggtatcatggacacagactgtcaaaagccaacagaataatttcaaattcaactttttttccacatatggctttgtgagttgagtgcatactttagtcaaaaatatgttttcacagagtgataatttctaggggtgattaaaagtttgattataaccactcttgggtttcataatctaaaaacattttcagaaagtctgtgattaatttttcccatttaaaattttattctcaataatgtgcagtattaaatagaatttcacaaggcatcttgggagttacgctctcacatattaaactacacagaaaaagttatatgtcatagctggtcaagaactcagagcaaaatgaaaagataagcagatagtgcaatgtggttcatggtccttaaaagaccttttaatgtggttggttattttctaatgaatgcaagtaacacattgaatgcccacctatgaacagaaccgaaattaacaatttagaaatgtgaaagtgacataaacttttactttcaccatttttcacagggtcatttgttggtaaaattatctcctgtacttgcttcttgtcttactacatcagtcacctgtgaatttaaattagaggcattttgaaaatataattagtaagtcattgcttggatctattgagtagtaaatttatatttttatagtacctcagatatagtgtgaaactttgaataattcatttctcacatgaaataggcacattacaaatatccagcaagttgtaattctgggtaagagtccttcaaagaatgaagaacaacagttaagctgtacctttggtcatgcatggcaatatgtaattactatctgcaggtcctcaagatcaacttaatctctagtatgtaagtcaaatgcctgttgaactgtacagtataatacatggataaacaatccaaatgactcattttataagtaggtaccactttttataaacagagcgttttataacaacctgctgttggtggtggtggtggtggttttgttctcctcctgtttcttattctttattattgtcatcatctatacttactagatacaggaaaaatgcttttacaaaaatgacccaattcagtggtgctgaaactctagagacatcagaatcacctggatggcatgtcaaaacacgatgcatggtgcttgcctcagaatttttgattcagcagacataatgtggaaccttaggatctgcatacatagcaagtacccagatgatgctgatgctgctggtccagggaccacactttgagaatccctgctcttgtaaatgcttctttgtttcctgatctagcccttcttctatcattttaatgctaattatgcccaaaagtatagtagtactgctctttgcgtctttgcacaccaatctctgtggacaatctcatccacacgtgtggctactcacaaatataaatcaccagccctaatctccttttgagtgtcagactaatatatcaactgcctacagcacacctccacgtggaaatcccacaggatctttaaatttaatatggctggctgggtgccgtggctcacgcctgtaatcccagcactttgggagtccgaggcgggtggatcatgaggtcaggagttcaagaccagcttggttaagatggtgaaaccccatctctactgaaagtacaaaaaaataaaattagccaggcatggtggcgggcgcctgtaatcccagctactcaagaggttgaggcagagaattgctcgaacccgggaggcagaggttgcagtgagctgagattgtgccactgcactccagtctgggagacagagtgagactcgatctaaaaaaaaaaaaaaaatattaacatggccaaattggatctcttaagtcaacccccatgaagattgtttcaatcaagaattgtcgcattttcatgaggagcatatttttatggtcttaaaggatccccccacaaattacttattagttgcataggaaaaataataactatacattgaggaaattgaagaacatcttggacaaggtgatcaaaaatatcatcaccaaggaggggcaaatgagcatcatgtaatgccctaagatacattacctcattgctcttaaagcatgacccaatacattacctcattgctctttaagcatgacccaaacccatggcctaccatgcaagtctcctcctttcccagcctcacttctcctcaattcacacctcacagtcagctttacagttttaccaatacacctgagtattgaagaacgtgccatattctctcttgctttagggtctttattcctgctatttcctttgcttggctcgccttgcctcctccccaagcaccttctgtctctttgactagtgaaaacccatggtccttcaagactaaaattaatattatcttttcagagaaaacttccatgctgattcccctttcatgagtggtttaacagctctgtcctgcttggggcctcctagcacttaccacagtttattataatttcttacttgcttctctgtttcctggcttgcctctgagttctgaaaggtgggaattgtgttattcaccattgtttcctcagttcttagaatactgttaattaagatacagttccttaatgaatggatggatggatggatggatagaaaaaattgaaaatgtcatgcattttaataaacacattaagtgtttatttttatttggtagaaaactgatggaggaaatgaacaataatgtttagttttatatttggtgctgagtcctggataaagacaattgaatatgtttggtgttcatctaatttgcaattcaaaaccaccacgtgtagggaccttttctgccttactatttaaaatagtttacaaaattttgagaaaacgtagttttaattttacctagaatctttttttttttttttttttttgagatggagtttcactcttgttgcccaggctggagtgcaatggcaccatctaggctcaccgcgacctccgcctcctgggttgaagaaattctcctgcctcagcctgccaagtagctgggattacaggcatgtgccaccacgcctggctaattttgtatttttagtagagacagggtttctccatgttggtcaggctggtctcaaactcccgacctcaggtgatccccctgcctcggcctcccaaagttctgggattacaggcatgagccaccacgccagcctacatagaatcattttacatcagtgttttagatatgaatatttactaatctattatatttgatagcaaccataaatgcttaaactcacaattttttgtttttatgtgtgggaaaatttaaaaaacaaagactaaaaggatatgtataacaaaattttatctctatattgtgagattaatcttctctttgtattttttaacttttctaaattaatgtgaattaactgtatatgcagaaataatgtaaattttttttttttttttttttttttgagacggagtctcgctctgtcacccaggctggagtgcagtggcgcgatctcggctcactgcaagctccacctcctgggttcacgccattctgctgcctcagcctcccaagtagctgggactacaggcacctgccaccacgtccagctaattttttgtatttttagtagagacggggttttgctgtgttagtcaggatggtctcaatctcctgacctcatgatccgcccgcctcggcctcccaaagtgctgggattacaggcgtgagccactgcgcccggccaatagtgtaaaatttttacatagccaatgtttgctatgaatgtggttttctaaagaaccctcatattttctatatttatttgaaagggaagattttgggtttttcaatcgttttctgaccaactatcattacatttttggctgtaaagtgaattgatacacaaaagtcttggaagcaatttactacccacccctagctctggtattcttacgagggatgatacaaagacactaccttttctacaagctcttgtgtttacaagcataagagaaaaacaatatgtttaaggtattaattacccagaattcagcagtacattcctttgatttttgtatacaaatgctaacatatcacgaaggggaaagtgttcactgttttgtattggcatttaaaaactttttatgtatcatttataattgtgagagtaaatctgtagttggcttcttaaaaattcttgattacattggttctttatccacttatttatgttgatccgatgacaaagagttgttaataagtcaagacattttaacttacttattgacaagctaactaagaaaatagccaaaatagaggtattacaaatttcttattcaactcagcatgttcactgttcacttagccaaacattctccaactgaagaactccaaactagtttactcttcatatgactatattgagcattaccttactttaaattgtgccacttaatagtgaagttcggtgactatttcagcattatgatggatcctcttggactaagatacaaaatttacagttaaatttggtatttgccatcataaatggcccagattagctggtccttcccctatcactggagaggagtaatagtagctggaacccagaaacccagtgggtactagtttcctttctctatcccactttactcccctttatctcctttgcttacttcaagttttaaaaattacttacctggctaaccatgttttaaaatacattttattctgaaaatgtgaaagcattcataatacggattttttaggtcaaacttgccacattggtgatagttggggattgcggctgatttgtcagatgtatcttaccattggagtctgtgataattaagagcagtgttggactgtggtcatgtcagacactgcggagaagaaaaccgtgttttacatgcatattcagctgctgcatgatgtgttactgcatttcacattacatatagtagcccagtgccaactcactgcagtaaatctcagtgctaggctcttgccatttgtcatagtaacagaaaaacatgtgcagttttccattttattgaatgaatttgaattcatagaggacatcagattgtgctcactctctagtttatatgcctgtgtgtgtgtgtatatatatatatatatgctggcaatacaaataagctgaccatcccaggcagactaatcgaagatcttgtctaatattttggaattgtgattatttctatttctctttaccttaacttagggtacttcatctgatcaccacccctctaaagtatagaggggggtatttttggctcttgttctcattaatttaaaagttctcaatttttttgcagaggaaaggaaaacctacctgttggctgttttgacctatccatttaaccagtaatgcaccacagttagcacttctgggactaatctggccctccaaccttgaatagggtttacatggcattgccttaaggatatgtagtctttctattcctctaaatcagtggctctcaaatttgacaggtgtcagtcacctagggaacttggtaaaaatacaaaaccctgattcttactccagtgagtctggccaattctgatatgcactaaagtttgagaaccactgctctagacactaaaacaaatcaaaacaaaaagacagatgatctgaccaaggtagaaatgcagacagcattgagttgtccaattggcctgctatccccgtgccccaggctacttttactgaactctctcctgctttatggctttacttgaaggcgacgttataagaaacagccctcccagtatctgtgaactgcaaatcacagatctctcaaaatggaatgctttctgtaagtctgatgtcaaaattcatttgggggtaaatttaagaaaatatattattccttgtagtgtaaatatttatgtgtttaagtgcagaaatgttaatacgcttaactctagggtgctgccctaaagcctgctagggttttttcaaaatatttgaaatgcatactgaattagcttccaaaatccaaaaaaagtccactttaataaacatcttagtcccaaagatttcagattataattataaacaatgtgcttattaatacagtcatatgccacataatgacattttggtcaatgatggaccacatatttgactgtggtctcataagattataacagagctgaaaaatgcctattgcctaatgacatcatattttctataatgtcatagtgtaacacattaccttttctatgtttagatacacaaataattaccattgtgttacagttgcctatagtattcagtacagtcagatgcagtactggtttgtagcctagaaacaaataggctgtaccatatagcctaggtgtgtagtaggctctaccatctaggtttgtgtaagtaggctctgtgatgtttgtacaacagtgaagttgcctaaggacgcatttctcagaatgtatccctgtcattaagtgatgcacgattgtggtgtgcttctggagaaatggcttatttttatcttgtggacattgaaaatgacttggcagaccatactgtaaagctctaagccaggcttttgtcttcccttgatcaggagctctgtgacgttattctacctttatctttttttcttggtatcttcctacctttttattggtattattattatccattataatgattttgctgagtgcatttactcgttggctttttagatttttttgaatgtgtataaactaattgcttcttcatttagttggatatatagggtgataaaaatagataaatatattacttgttctggggcattgtctgggggagatttagcatagttgtcctcagttgtctctttctttcatgccataataaaataacctctattgtgaggataatttttcaaaaggacttagtgtaatgagcatacatttttggctaggtcagatttctaatagttggcagcccaggtattagcaacctcatattctacttccctgaataagaagtctctaggagtatctatctaccaaaaccactcaaatccctacaatccaaagaattccaggcttttaagttatgtttctgattctaatcattatttattcagtaaatggttgtataaaagtgacacaccctcaactgcaatttcagtttccctgggggaaacaaggaccctgaagggaaaacttgtacatagtgttgctttcttgctccagatcactggctcagagcatgaaagaagtgaaataacaaaccactgagtttcccctcaggtcttaaactatcagcctggatagcaaacaatttttattgcaaatttgagtagttactatgctttaggtttttttttggattaatgcagtttattttagagctgttctgagtttatacaaaaattgcaccaaaagtacagagagttcctatacacaccttcattctccatcccacagttttccctattaatagcatcttgcatttgtgtggtaaatttgttacaattgatggacagttgtaatacaatatattgacatattattgttaactaaatccatagtttatgctggggttcactttttgtgttgtacaattctatgcattttgacaagtacatgatgtcatgtgtcaccattacagtatcatacagaatagttttattgccttaaaaatttcctgtactccacttgtttatccctccttctcccaacccctaacccttggcaaccagtgatctttttactgtctccatagttttgcctctcaagaatgtcatatagttagaatcataaagtatgtagccttttcagattggcttatttcacttagtgatatgcatttcaatttccttcatgtatttttgtgacttaatagctcatttctttttgctactgaataatattccatggtaaggacttaccacagtttatttattcattaacctgttgaaaaatggcttaaacttttggtcgtttccaccttttggaaaatataaataaagctgctataaatatttgtgtgcaggtttttttgtggctgtgttttcaactcatttaaataaatactttggagtgtgacagctggatcttatgggaagaatatatttagttttgttagaaactataaaactctcttccgaagtgactgtaccatatttgtttcacaccagcaatgaataagggtccctgttggtctatatcctgtctgccagcatttggagttgtcagtgttcaggattttacccaatctaatgtgtgccatgctttatttttaacatttaacaaatagaaaatttgtgctcatggcatttgtttcttccaattactaatgaatagcatcatggttaaatgggatcattaccctgcttctttttccacccaccttagcttcctccagagttcactgttatctcttctctcagcaggtctgtggttggctattcttgtcttaccagtttgctgttattcctgcactcagtttctgttcttgtatgtgcctctctagtgtctagcataaatccctcaggactcaaaaagtggtattaatatgtcagtgagtcctattctgattccatttttcccaaatgagcctcctctttcaggctcctttggtaaagttcttctaattccttgggtctattacctactttttatattgttatagagaatgtcaaacatattcaaatacataaagaatgatatactggactaacgtatacctatcacacagtcccagccaccaacaacccatggccaatagtgctccatcctctcccatttactttttctaaatgttgtattattttgaaacaaatatcagatatcatattattttacatattcatgtgaccaaagatatagagcaatgacttctttttctaacaaacacatagcattattatcacacctaaaataacagcaatcatttattatcatcaaatatctaaataatgatctcattaaagttaagatccaataatgtccatgtgctttgactggttgatgcatattttaagtctcttttaatctatgggctctccctctattgtttgccctgccaacccccacaatttatttattgaataatcaaaattatcctgtaaagtttatcttataatctgatatttttactgattgtatttccgagatgtagtttaacataatctctgtattctgtattgcctgtaaataagtagaacctccatacaggtttgacttattttgatgtgactactataacttaattttttgttttgtattaatgccagttcattactggttctctcctaagctaatcttagagggcataccagtgtatcaattcatgcttattctgaaatctttaataaagttgtaaatgaattatacaataaatttcacagtgtcaggaatctaattaatgaaatagctagattagaaccctggaccccagacttttacatacaatttcctttccctgtaagcactatgttagcctcatgatagtagcatgcctctttgtaacttttaaatatcctgcagcagcaaattgagaaacacatttgcagaacattccctttactgtgtaatgtggttcttagtagagaatttatttatttatttattttgagacagggtttcactcccgtcacccaggctggagtgcagtggtgtgctcttggctcactacaacttccatctcccatgctcaagcgatcctcctgcctcagcctcccaagtaactgggactacaggcacacacgccaccacgcctggctaatttttgtatttttagtagagatggggtttcgccatgttggccaggctggtctcaaactcctgacctcaagtgatctgcctgccttggccttccaaagtgctggcattacaggcatgagccactgtgctcagccattaagtcttacatttgtatacaactttaaattatctacgtaatgtcactgcatagtcatatagcttggtagttaagcatttgaactcttttttttttttttttttttgagacagagttttgctcttgttgcctaggctggagtacaatggcacaatcttggctcaccacaacctccgcctcccaggttcaagtgattctcctgcctcagcctccccagtagctgggattataggcatgcaccaccatgcctggctaattttgtatttttagtagagacggggtttcttcatgttggtcaggctggtcttgatctcctgacctcaggtgatcagcctgcctcagcctcccaaagggctgggattacaggcgtgagctaacactcccggctgcatttgaactctttattctaatgtctaaataggactcactatttagggtactcactgtgtgatcttttttattattattacttcatagagacaaggtcttgctctgttgcccattctggagtgtagtagtgtgattgtaactcattgcaactttcaactcctggcctcaagcgatcctcccaccttagcctcccaaagtgttgagataacaggtgtgacgcactgcacccagcctcactgtgtgatcttgaataagttactgagcctagtttctctgcctgccagatgagacttttactagtaacaaccttatgaatttgctttgattattcagtatggataatgtatggatgatgcttagtacaatgcctgggatataatagcaaatgttcaatatagtttggaactataggcagagagaagtgttattatgagaaaactgaggcagtgatagggttggggcattggcctaatattacatagctgacatgtactttcacataagagcctgtcttttgtgtgagaactgactctgtaagtgtctctactgttatgaaggcaggaacctacttaggtactaggctatgtgaaagaagctggtgattagttgaatctaaagttggtgatgcactcacattgccaactacacacagtcataaaatccattagcctattttagacggcttactgcttaccttggcctcagctaccttactgcttaccttggcctcagctaccttggcctcagctactgcttaccttggcctcaggatatttaaagactaagattgtttcagtttgtttaaaaaattacacacacacacttgcgctcacacacacacacacacacacacacacacagtgggagagtatttttgccaaaacgtatgaaataattttctcctcttcacagatattgaaatggtgatttgttttatacatattccacacaaggtatatatatgtaagggataatttttttgtggtgaaatttaagtaacggaaataacatccactattatttgggtaaaaattacaaaagcacttcatagagacttttttccttagtgtatgaaccacatttatcaggtggtacaatagctgaattaagttgaaattgttctaaaatatgcttgagattttcgtctttcttcaagttgtcctgaataggtagacagatacctgaaaataggaataaaacctaaacctctactttaaaatgaggatattttacctttaaatgtctatttcacttgatgaatatttaacctttttgttagttgacctatctaaaatcttaagttacttgaaaaatatattttcttgtctgtggcttcttaaatggtgcacatgtggttagcaagcaacagctattggcttgccaaagctaaaagttaaaatataagatgataaagttgatgtaatatgtgaccttttataagtcactttcccatttgaaattaaatgtgccagatttgacaaacttaatatattgaataggttaccctaatatttttgttgacttttagcaagaacactataaagcaactataaagtgttatttattttagcttttctaaataaaaatcactgaagcaattttaatttgtacatataactcttccttaaaatttaaatacctgttttacttcatgtgcttccatgccttatttcattaaattttcaaacacgtatagaaagccacatctacaagctatcagatttccctgagattactatattaaaacatacactgaatcagactccatttcttccaacgctgattcagcactttaaaaataatctttgattttatattaaaataacttatcaccctttactgcatgatatcagaatgacactagttatttcactacaaaaaaatgtcagtgatcaaatcttgctggtccacaaataactctccacttgctaatttgcattttagcatcaactgtaaatatgtagataaaagaactgacagttgacagctaggtataacttatatatatttcatacagtaactcaataataccagattaatatttaaaaacattagtaggccgggcatggtggctcatgccggtaatcccggcactttgggaggccgaggtgggtggattacttgaggtcaggagttcgagaccagcctggccaacatggtgaaaccccatctctactaaaaattaaaaaaaaaaaaaaattagcaggacttggtaatgcgtgcctgtaatcccaattactcgggaggctgtggcaggagaatcgcttgaacccgggaggcggagcttgcagtgagctgagatcccgccactgcactccaggctgggtgacagagcgagactccatctaaaaaaaaaaaaaaaaaagaaagaaaacaaacaatgaaagacattaacaggagtatggcagaataaagaaatgtcaaaatatcatcctttaatctttaatgttataatttgtgtttgaattatgaaggatatattgaataataacaaatagaagtatttcaggaagcatagaggtgctgtttaaacacaatatgaaagtaatgagaatcattttccaacacggcattggatccagtctcatgacagtgtaaagaaactgtgggaaaagtgctctgtattttccaggtgaacctggttgcccatctcttgcaaccagctacagaaggtcagccagtagcactggatttccatggtcactcatttctccattctacttgtagtctgtgtagtgagaggaaaacaaatgtgtcccaaaaacttggtttcacatgagaagttcttcaaataattttcacctttagaaaaaaaatttatggagcatgatgatagtcaggagggaagaatggcagtttggaaggtaaggcaagaagaataatcttgagagtttctaatgagaaaaataatggaaaagggtaaaaaaaaaatagagcagctatgttaaagtataatattataattattgaatagaactcaataatatataattctgagcactctttttttcttctgactttatcatacaattttatctttagcctacctttaccttaatttgtatattcttagccttaggttattgaatagatttttataaaccatttgttttagtcagcttttgcttagtaaaaatacaataatatacaatccccaaatatcagtgccttttaacagcattgatttacttctctctcattttacatgtggcagctctctatggttctgtgtatcttcttcattcttgagtccagaataaataaataacttctctctggggcaaggcatagggaaaagagcaatggcagaaacatgcaatagatttttaaaattgtatttgagtataatttgaaaaaataatataatttaccctaccaacaaaatccattctggaataagatgtcatatagtaacataaaatttatattaatgtatgtaaaagaataatattaaggttgaaacttaaagaaccatttagtgtcttagtcaattttgtgttgctataaaggaatccctgagagtggataatttataaagaaaagaggtttatttcgctcatggttctgcaggttgtacaagaagcatggagccagcatctgctcctggttagggcctcaggaagcatccactcatggtagaaggtgcaagggagcaaacataatatggtgagagagaaggaaagagagatgggagggaggtgccagacttttttaaacaaccagatctcacaggaactaggactagaattcactccatcctgggagcattctccaagccatttatgaggaatccactcccatgacccaaacacctctcactaggccacacctctaatattggagatcaattttcaagatgagatttgacggggacaaatacccaaactatatgaaatggttagcatcattttcacttattaaaattttatcaaacatctacgatacagatgataccaggaagaagcaaagatgaataaatacctgtactctacatttaaaattctctggattcagtgaggaatatagcaaaatatataaaaccaatatagatgcatccactgatgagtgctttcttgaggattaaaagaggtgctaataagcagaaactgtgaatgaaactgtcaaccactgatacctagaaaccttaggatagtttctgtgtaagaatctgttaaattatctcagtccattcagactattatagcaaaatactctaaattggatagcttatgaagaaaggcaatttattgctcacagtcctggaggctgagaagtccaagatcaagtcaccatcagattcagtgtgtggtgagggctcgttctctgcttcacagagggcaccatcttgctgagtcctcacatggtggaagggcttcatcagcctcttttataagggcactaattccatcgatgaaggtgtagcctttatgacctaattacctgctaaacaccccatctcttaatactgttacattggtgattaggtttcaacatatgagttttgagaggacacagtcagaccatagcagatgaggataataataaagatattaatagtaataataactatctgtcttatgcatttactatatatcaagtactttagaaacctcattgtactctcacaatgaatttttgacataaattcaattattattctcattgtacagatgagaatataaaggcacagacacatattgaaagactatttataaagcttgtagtacctgagtggattaatggtgtttatattcagtttgtaaaacaaaactattatgagattatatatatatatatatgaatgaaaagtttccatgcctgttttcttgcaatattgattgtgaatgttaccgcagcctaagctcataaagcattttcttaacagaagcaatcacaggctatttgcaaagccatctcaataaaacttacaaacatgagtcctaagggtagaatcaattggtgagatgctacatttctttgtttgaattattggggaaaataaaacagtatgaaccattgatggtgttttgaaaaatatttttacactctattacttttattcttacccttaatatgtagttctatcattattttccatagaattaatctccactcttacatatattctttatgtaaatgagaaataaaatttcaaaggggaaaaatgtaagtagccaaaaatttctacataatgctttattaatgagcaaaattggggcattttatcttctgggtgagaaatgtaatattcaggaaaagtgtggtataattaatcatagtttatgtatttattactctagggttctttttgtaaatgttccatagttctttagcagtgaactcttctctaagttgcaaacagtacacctctattgtcaaaaaaggaccaatttctttgtttgcagcatattgtcaatatcaaatatgcatgctgaaagacagcagactatcaatagctagtaaattcacaaaaccattgggtgatatgctaatatttcacaagacaaacagtgaagggagaatattgtagtaatatttgcaaacaatattttctttagttttgtatttaaaatatgtcatttttttcttactcttgtgtgacttctttttcagtcagaacagaaaccttaaaatagataacctttgatttttatatttattccatttttctctgacagagtatggatgaatagcatgaaactagtcaaaattgctaagggaattaatttatctacaaaccttgttcaatcttattatttaaaaataacttttattaagataaaaattactaaaaatagattagactcttatgatgcacttagaaggacagaagatcatttctctgatagtcttgcctcaagttacaacctgattctaataaggagaatgcattagacaaacccaaattgagttacatgctacaaaatggctgaccagtactctgaaaagtttctaggtcaggaaagagaaagactgtagaactgtcacagtttggaggagactaagaagacatggcaactaatgcaatgtgggaacaactggaccttgaatcagaaaagaaccctagtggacaaactggttttgaaatttgaatacgtactatagatcagttcatcatattgtatcgacgttaatttcctcattttaataattgttctagggtttggaaaatgttaacattatggcaacctacctgaaggatgtgcagtaattattttctattcttgcatgttttctgtaaatctaaaattatttcaagatgttagagaatttttttttttttggagacacagtcttgctcttgctctgttgcccaggctggagtgcagtggcactatcttggctcactgcaacctccacctcccgggttcaagcaattcttgtgcctcagcctcccaagtagctgggattacagatgtgtgccaccacacctgactaatttttgtatttttagtagagacagggtttcaccatgttggccaggctggtctcctgacctcaagtgatctgcctgcctcgacctcccaaagtgctgggattacaggtgagccaccgcgcctggccaaaatgtcaaagaaatatttttaacttcgggagcaaagaagaactccaatctctggaatcagaaaaaataaaatattatttttatttgaggttatttaaacctcccatggagtatattaatatctgcaaactgagtgcctgctacgcaaggctacaaggtgctgtatgagacggaaacatggagacaatttattttttttattattttatgatgacatttattaagcttctaaaattatgtaacaaaatgaaagacatggacaatcacactttttgatatgataagaaaagagattatttgaatctgggacacagtgttccagaatttagaagatccatacaaagtgttgaggagaatctgattctaatttagggtttagggggaacaaagatacagtagttcccccttaaccatagttttgctttctatggtttcagttacctgtggtcagccacagttcaaaaacattaaacagaaaattccagaaccaaacggtgcacgattctgagtagtgtgatgaaatctcgtgcagtctccctctgtcctgtccaggacatgaatcatccctttgtccagcagatccatgttgtatatgctacccacccatttagtcacttagtagcaggctaggttatcagatcaactgtcatggtatcgcatgacagtaatccttattttacttagtaattgttccacagcacaagagtagtgatgatggcatattgttataattgttctattttattattcgttgttaatatcttactgtgcctaatttacaaattaagccttatcacaggtatgtatgtataggagaaaatgtattatagatcaggtttggtgctaaccacaggttcaggcattcactggggatcttggaatgtattcccgtcagataagagggaactacgatatgtcgatacaacagtggttgaactattgagtcatgcttggagctcttgagtatgaatatcaggaaataagcctggaattaatccaattgtggccaatttttaatgccatattagggcacttaaccttcattgtgtagtcagtcttaagtgatcaaataaaccacacaattggttctatggttcacaaagttaatggcgatatcaagtgaaaattggagtgaggcaagatgggtttccaggagaccagagaggcaacaagggctatataccttaagagcaatttacaaaagattaaaggagggcagtggcaatggggatgagaacaaataaaaaatagcaaaaaataatatattgaacttattgtaattatgtcaagctactgttatctttaaaggtaggaaaataaagatcttggctgggtgcggtggctcacacttgtaatcccagcactttgggaggccgaggcaggtggatcacctgaggtcaggagttcgagaccaacctggccgacatggtgaaaccccaactctactaaaaatacagtaattagctgggtgtgatggtgggtgcctgtaatcccagctacttgggaggctgaggcaggagaatcgcttgaacctgagagacagagattgcagtgagccgagatcacaccattgcattccagcctgggcgacaagaatgaaactcagtctcaaaaaaaaaaaaaaaaaaaaaaggaaagatctgaataaataatctcctttccttaatataaattttaatgattacaattacaactaattgatgagactggccagaggagtaaggcatgttgatcttcttttttttttttttgagatggagtcttgctctgttgcccaggctggagtgcagtggttcaatctcagctcacttcaacctccgcctcccgggttcaaggaattctcctgcctcagcctcctgaggagctgggattacaggcgcgcaccaccatgcctggcttatttttttgtatttttagtagagacagggtttcactatgttcaccaggctagtcttgaactcctgacttcaagtgatctgcccgccttgacctcctaaagtgctgggattacaggcatgagccaccatgcccggcctgatcttatttttaaagagtgtaaatgtaatctaattataaatttaaactttagagagaatgttgagagatacggacataataataaaaaaaacctgagccggataattgtgcttgtctgaaatgagctaatgaaataattttgttcatatcctttgggggtatttctgaaaatcagtaaagactatgcacagccattttatgtttttacaatagtgccattaatgatgccttatgagtgaagaaagttggatgattgggtgtaaaagatgtaaggttaatgggaaaacttccctagtccacaaatcatcttattatccagtctgtaattctttgttccatgccaaaaatctatatttcgtcaagtaataatagatgctttcaggcaaacagccttatatgttgaaatgcaaatgattacttttaccccgtctcctatgcttctccttaaacactgaagtgagtcagaagaaagaactcttaccctttctatttacactcactgctttggtggtatcactgaatctcatggctttaaataccatttgtcttctgatgattaccaaatactaatctccagctcagacctttctctccaacacgagacaggccactggactttcaataggtagctcaacctcatcctcacgtggtggaaagctctggattgtcccccaaaactatttatctcatcattcttttcccatctcagttaattgcatcgtcattcttctagttactcggcacaaaaactttaatgtaattcttgactcatatctctctcacccatcatttgattcatcagaaaatcctattgtctgtaccttcaaatcatttccaaaatctgaccacttctcaccagctccaacgctagcatcctggtcagagccacatttcactttgcttattgcaagagcaccctaactgacttccaacttctgccttgcttcccatcaattcactcttaactctgctgctggagtaattctgttaaaacagagattagtatgtgtcacttatttgctcaaaaacctccaaagacctctactttcactgtgagaaaaggccagaatacaaaattacaagggtccgtaaggccccagaaagacttgacctggcctgacctcatctaccgctacctttccctcttgctcactcttgcttattttcagcaacacaaggcttcttcccttttcacaatcactgcaggaacactcctgcctctgagactcagaccttgctctttcctctagctgaactgctcttccaaatgccttttttgttcactccttcaccttcttcaggtcttgacttgaaacaccctataaatagggcatttccaggccactctaaaattgcaaacttacctccattccttgcaccctttccctccttacagctgttatcaccatgtaatttactatagtttttgcttacttgttttttatctcttacgcaaccatcccattagaaagtaaactctattaaggcaagaatttttgttttttcaggactctacactaaatctcataattataagacaatatttggtgactaattttaataggaaatattgcctagagtaagtccagattttcttcttaatttaatcattaggcaaaatattttgagcaccttttatgtacttgattagaacataagggcataatgcattttaggatgtctgagattattggggagtaggcatgaaaacaagtattaatggtccattgttacaagaaaaagagtgaaatctgggctgatgctctctagtttgagcaggaaaatatctcatagcctctaaccttacttaaattctgccagctctggcctgtagaagcagtgaggcaaaatgacccactggaagaagctacttcttttgcagaagcaacctaactctgagaagaaaaaaattaagcctatcatcttcagttctacttgagatcttaattataaaataaactcagatttctatttccagttcagatggtttggtataagatgggccataatccctgaaaagtggcaattccaaggaagtttggcacaagtcttaatatgcttattcaggctgaagttccagcagttccttcccataagcagacctgctagagtgtggaagacacataatgtaaatacgttaggagcaattgttgtttctttcattttcttctgaatcagtccacagcccaaggattctgtgaagtaacaaaattggctgttacagattatagccacattcccatcttaatagcagcagttgaaatttcttgggcatttcaaggtagagatttatgttttatttgcagttcatgattattctgattcaaatatctgtaaatataaagggagggggagaatgctaacacaaaaaatattgtacccagttaaactttatgtctgtattaataaagcagtctttgatttagaattcttagtccctttcttttagaggattgaggttagggtatgtgggtttgtgtatgttttgtcaccaaggttggggtgatattaccacagtgaccagaactataaccaaattcccatttatactagtgatggttgtatcctgtctaccagagaggggaaaaatgctttgacaaattcatcattgttatgttttcttgccacagtttattctcttctgcattctgtggaagttcttttggccctgtggcttcctcaatcataagctaccacatacaaagactattttttcaaagaagccaattagttttttactaatcatacgaacttagaaaaatagatattaaatattactgataaataacacagccttgtcagaaatctctcaaagtgtgtgatcattgtctatagagtagaactttttaggggcaatacagtactgtttttatattcaatgaagataagttagattaaaaatgtaagatatctttttgtgaattgccacatggtagaattttgtaagaggtttttataatgctattcaattacttctccatggaagaattttgctcacagagaaagagagacagtgtgtgtgtatacacaaacatatataaatgtacatatatctgcatgcattatatatgcatatattgtatgtgtatgtaaagtatgtatagacatacaaatacagtcatatatacatacatatatagtctatacataatagctatatgtgatatactctctagatgttataaaagcttttcaaatttcaacttattggatttgttttggtgagtgttcaggtttattggtggaagaattatgagtttataaatcactgattagtcctctattctcacaagagtaaaagaatattttaatgatacatagtcaccaagggattgcacattttcaaatgaactcactgttactgcccctgttgtcaagatggtatctccctctttctcctcggcaaaaacaccatgaatcaatttatttagagtgaaaacaaacgtcaatcattaggtgaagatgctttttctcaatatctaaatggtttaaaattgaatttctcacgtaactgcccatttaaagactcaaacatggttctttgtttttgaggaatattctttataaagtctctgaaaacacttttactctcttagcaagataccttctttacttggcaacaaaaaccacattgaaacaatcgtattcccttttgtcagcctgagccagctgaaatctttggagttatcaacctctgccaacaacttgaagtagcggttgcacaatggataactgagatgtagtttattccaagctaatgattttctgaagctttcgggatggttatatttatactgacagatacagacctaactttcccataaaaagaacagactgtgttcaacgtacccagataataccagcctcttttttgtataatcctttaatttcagatgcttatagctgcttcagtcctgtcaataccagcactctgaagtcttgccctgcttgataatcatttgtctctgtaatttctttatcattgctttacttagggacaacacaaataatctatttagaccagaagagaccaactttctttcttctttatgatcaaaatattttgtagactccctacaaaataattatgataattgtagtagccattgggtaagaaatgcataatgacaaaaatctagttttaattcagtcgtgctaagcatatactctgctttattacatcagctacatatgtttaaaaatactaatatatattatttatctagtctgcatttggacttgcctaatcctttcaactagaatgccctctcaaagatccgtatcttgaagcacgagaaccaatagtttgaaacaactgatataaagtggataacatcaggtgtccaatgacctaccacatttgacactgaaaatattttccaaagaaatacagagtatgaaaataagaaagaactactctatcactcattgtcccatcgtctgatggccctgttgactcattgtacaccaagggccttttgaagtagggaaatacatgtgaccaatagagatagaacaataagacaatttcagatttgaaagaaacctgagcaaccacggagcccaaccctctctttttctccagtaatccaaagaggtcaagtagcttgttaagggcacccaagaagttgatggcaaagccaggcctaaacctggattatacaaacttgaaactatcttgaaatgtagtaagcactatcgcagtgttgggtaatacccttacactcaatcccagaagattgagttcagaagatgaagatgtggaggctgaaattataaccctggggattcgttgattgtgatgtactttatgcaggtttagaggcaaaaacacatggcttggcatcagaagtggaaaggaaagtagagtgttgtagaatgagtgctggatttgaggtcagaagacctcttttaattcccggtactgtcaccgattagatgtgacctatggcataacccttaaatatccttgacctcctctgtttccttttatgttaaaatgggaataataatgcatgctttgaccatcatttagaaaggttgagagaatcaaaatcagtatcagaaaatgcttttttaatctgtgcagagcttgaggtaacaaagcagtatacctcaataaatatcgttgcattcctctatgccaggcttcgtgcaaggcactgggaatagagcactgaataaaatagaaatgatcatagtttaaggaattttcattctagaaaataattacttaaatgtggctctatgtaacttaccaggagctttcttatccgttgttcctcttgagctttgcaacagtactaggcagacaggatagataagtaatgataataacaaaacaacaataatagcagcagcagcagcagctaacatttctattatttcaatgtaaaaaaagaatttcagattgtttaaatacagaaatgtggtggagtagaaagaaggccaagatggggacaaggggaaccatgaccccaaaagcaaataaagcatctgagcattcctttctgtttggttatgaacatctgagggtacataatcataatgagctcctttcagtaaatacaagatgggtgtttccatcttgatattataaattaagaaacaaggctgggcgcggtggctcactcctgtaatcccagcactttgggaggctgaggagggcagatcacgaggtcaggagtttgagaccagcctgaccaacatggtgaaaccccgtctctactaaaaatacaaaacttagctgggcgtgttggtgcatgcctgtaatcccagctactcaggaggccgaggcaggagaatcgcttgaaaccgggaggcggaggttgcagtgagctgagatcgtgccactgcactctagcctgggtgacagagcaagactccatctcaaaaaaaaaaaaaaagaaaaaaaaagaaacaaaagcacaatatgatcgtgtgacctgccctagatgctaaacctaatgagcagagaagcaagcaaagattgattccaggatttcctggctccaaagcctaggttatctccattgtatcaggctccttccaccacatctggatgttgactacatccagaacatgaaacaaaagcttcagtgctaaaaacaaacaaacaaacaagcaaaccaaactatcacattaagaagcaagtcaccaactgatcattttctgattttgctgtttccatggatggttccaaaatcctacctaactcatcaagcttaaatcaaagttgactcatccttacttgtcatcccatgtaaaataagttgccaattcctatctgtttcactttcaaaatgtttttaatcctgctgcttctgtgtagttttgaactggatagttctaataattgttgccaaagttccatactagcatctctggcttggactccttacatgctgaatccaactctcttagtttgcatcccctcactggcagatcctgagacaaggctttaagtgctggtagtttatttggagcatgaccccccaaacacaacagtctgggaatgaagtgagatgggaaaaggaagctgaccaataaaaggtgtgttatcaagaaagttacaactgtacatagctggaacttagtcctaacagagaaccctaggaaacaggatagagcatctgacttggagttattctaactgaggatcaaaagagcatcatttatagactggttcccattggttattggtttaggctacccccaagaactttttggtgttgaactcttcctgcgtgtagtgcaagtgagaagagaatgcttctgcagccagggaaatccctcagatgaaaggacttagatatgaaagttggaagtcagagttcagagaaaagatactggccaggggagtttatctgggtcactgtatttgctctgccagcctatatattatttctaaattaatcttcttagtgtacatctgtattagtccattttcatgctgctatgaagaaatacccaagattggttaatttataaagaaaaagaggtttgatggactcacagttccacatggctggggaggcctcacaatcatggcggaaggcaaaagaggagcaaagtcacgtcttacatggtggcaggcaggagagcatgtgcaggggaactgccctttataaagccaccagatctcatgagacttattcactatcatgagaccaacatgggattaaacccatccccatgattcaactacctcccaccaggcccctcccatgcataacatgggattatggaaactacaattaaagatgagatttgagtggggacacagccaaaccatatcaacatctttgctggagaaagctactctagctattaggctactcagagtatgccttgtgactttcatccttcatgcctttctcatattgtctccttttcttgattattgttttcagtcttaccctactccccgtcccacatagtcaaatgttacctatttatgaagactcacactgtgggcatttgtgattacatattatttttaattacattataacttgatgtaatccactagcacagtgttctaaatataatagaggcctaatggatgtttttggactcattgtctgacaacataacaacttgtgattgtctgaaaatgtaacaacttgtgattgtctgaaaatgtaacagcctgtgaactcttcgttgttcaaagaaaacagaaaaattccaaatatgtaactctttgaaattatgtcaatgtagatttgtttcaaatgttaatatatagtaaccagggaataatagcaatgaatttgttcagttacgatatttggtacttccaaatagcttcccatgatgaggataagataactaataattcttacagtaaaatattctttgattgggttgtttcctattgctgctataataaattaacataaacttagtggcttaaacaacccaaatttattatcttacagttctggaagtcagaattccaaaatggattttactaagctaaagttaaggtgtcatcatggctgcattcttttctggagactctgggagagaatctgttttcttgccttctttggcttctagagactgtctacatttcttatctcttggccctcttccatcgtcaaagctagcagtagccagttgaatctcacagagcatccctttgacattaactcttctgcctccttttctcatatttaatacccttgcgattacactgggctcatctggataaccctggcttatctctgtatcataaagtcagctaactagtagtcctaattatatctgctacgttaactcccctttgccttataaggtaatatattcgcaggttcaggagattaggacacagatgtctttgggaggccattattctgcctaccacaattgatatgtcccactcttccctcctaatttaataagacaatcctatactggtttacccttatctcgtaaaatattcaagatgtagtacagatgttcttgatgctagatgttgaattatgattttaacaaatggaggcttgtgtctcataatgtatatttcgttttgaaatagaaaagttgacttagaaaattagacttccatgtgtacacataatagttctgctacttgagatccagcgattagcctacttctagcattttcaaaataaacttgtcatttgtgtcattatcatagctgattagaaagtaaattatttgtattgaccacattgagaaaattaccatttagcttatggaactctttgtcatagagtgtggatattatatttgtacttgattctaatagtggttagggacattagaaggatatggagctcatcattcaactaagtccttacaaaataattcaatctctgttttagaagtttatcataatattagtacataaactgaacacaagaaggaatttataccatagaaaaattagagagaaaacttagaaaccatctcctacgagctctttgcttttcttgcgaagtggctgctatcaacagaaagagccgttgttaggctttgcatgttctggagtgacatctattagagaaggtttatcatctttgaccactttgcacttcctctcccaacaaagccttacaagcatgtgtttcctagagtggccacttggatcttcatcttccagtaatgttcatgatttgggtattcctagttctctctatccaaaatggccagttggtatcttcttaacccagttgtgcattttaaaatattttgtgggccaggtgcggtggttcactcctgtaatcccagcactttgggaggccgaggcgggtggatcacctgagatcaggagttcgagaccagcctggccaacatggtgaaacctggtctctactaacaataaaaaaattagctgggcatggtggcgcatgcctgtaatcccagttactcaggaggctgaggcaagagaatcacctgaacccaggaggcggaggttgcagtgagccaagatcatgccattgcactccagcctgagtgacagagtgagactgtctcaaaaaaaaaaaaattgtggagtccaaactgttactagttaatctggaaaattaatctataaaaagttcctaataatttatactattttttcttcctgtcacaatataaaaaataaacattacctgttgtaatctgaatatgtgattgtaaaatgattaagcccgatttttcaaccaaagagattatgacttaaagtgtttattatgaagttcgtggtaaatgaagaaccagaatgtataaaggtgattcagctataaataaaatttaattttgtgttaataaaagtaaaattagggaattatgaaaagatattttcaaatacaaagatgcatttaatattcacacaatattgatacttagtacccccatttaactaattaagaaattaagactagtaatgattaagtaactttcccacaattacttagctggctagagtctaacatggtatctttttctttctttctgtcttttttttttttttcttgagacagagtttcgctcttgttgcccaggctggattgcaatggcatgatcttggctcactgcaacctccgcctcctgggctcaagtgattctcctgcctcagcctcccaagtagctgggattacaggcacacgccaccacatgccaccacgcctggctaatttttttagtggagacggggtttcatcatattggtcaggctggtctcaaactcatgacctcaggtaatccacccgcctcagcctcccaaagtgctgggattacgggcatgagccaccatgcctggtgaaacaaacgtggtatctttttcataagaggaactcaaacattctattgagttgaaatacattgaatgaggcatcctttgttttttgcactgaataagctctggtgagagctctattgttgtctttaaataagtctattcttctaggactggctaaaagcccacttaaatgggagccctcaggtacactcattgtcttcattaacttcctttgttagaaacaccattcattcaacaatatatccaccaaaaatattcagaagtggatgacctttcttatgctgatttttgaattgtagaaaattgcggagattcttactaagttttgggatagaactctctctcactggtctttcctttaaatataaaatagaaccttgaatatggtaatttcaaatatgcatgcttttaagtgaattgtaagtttcttgcaaacagggattttgttacagtctacctttattctaacaagataatagtagctaccatttcagggcgtgtatgtcattaactgcttcataacacatgatttgacttttgcttttatatttctaacatttataagcagtacaatgtaatagtcacacataaatactttataatatttatcaataattaaaaataaattaatacaggaatctaataatttatagtatatgaatttagaattcattatttatattataataaatatacatttgtaattcattattacattatttatttattgcatctaccctcttgacactatttcaaagtgtgcataagtattgcactttggctttgagaaatctaaactaagaaaagataagcaaattttccaagggctcttagctagcatttgacaaaggaaaaattctaaccctggtctgtctgactccaaagatggattttattcctttttagtgtgctacattgcttgcaattttccatgagcctagcaaagtgtatcctgttggattgaagcatattttcgagtggagatactgtggtaaatgagatggaaggagaagatggtaactgggacacctactgaggtgtgttcttagaaccaaagacttcgacttaaactctatcatagatcacagttggtattagattcacttagaagaatataaaacacaaatgaacattatgtgtccttcctccttgagaatagtcatcacacaaatctatgtagcagttcccacagccatctgggtagttatctttagcgattcctttcccccatgtctcacatcatggaatacgaatcacattgtgtaggtgtagaaatcacctgggcgtaaaaacctcattccccagtagccagtatctcttatatcaaatctgtagtcacagcccctgaaaacatgctcagttgcaagtcatcacactcagggaagtgcaaagatatgacatccagatcaggcatctatacttcatttatagtttcttctagttcatgtgaaacttaccaatcaggactcatttttatcatagccagtatgaccttgtaacacatttgacataccacgtttatctgtcttcaggggatcagaactaaaaagttaccaaagatccaattttaacacaggtcgaagggttttgatagccttttacccaaaataattacagaatggatttcttgaaaagtagttttgaggattttgttctatttttaaggatgggaggatttggatatgacctcaacagttggtggctgagaaagagtggagaaaaagatccttggagttaaagagataagagaacagagaggctagaatgttagacagagcccctttgtatatgttgaaataagcaaaatgtggacatgtgggtaggtgaatgggacagtgatccaggctctaaaactcttactaaatgagagaaaatgacagggagatctgtagataactatagctttgagggaagatgggtgatggtggctgatggcacaacctcaaatgagttccttttattgaaagaagacaattcatttggaagaagtaattgggagcaagggaaacacctactctatctctaggccctaatttttctcatgataattcattgaagtgctgtaaaatatccaaacaaagtaattcagtaataagggaaaaaacttaaaaatatacacacaaatttataaatgtcatgtgtatatatttgtcctcaatacaatttctcctgatcagttgtgtgtaactaggatgtgtaataaatgaacacaaggacaaacacactgcagatatttaccctaaatatctcagtgtattttaatacatggaatattattgtgctgctttgttagtggggtataatttaggggggatctttcttgatagcatagcagaaattgatctgaatcctaaatactccatttattagctgtatgactttgggcaaattagtttactcagcctcagattcatttctcaagaaattagcccaccagtatgacttacctcttaggattatagttaagattatatgagataaagcacatgaagattttagctcagtgactagtgtagtaaatgcttaataaagctattattgtcattgtaattacattaaatcacattaaaaaatttagttcccctattaaatcatatgaagagtttaaagaaagtcaacggggtaatgtgttcagtttcttttttaaataaaaagtatgcaatattataatgattagagtcccatgtagtagaaggaagagaataaaggactgaaattataagactatttgtgcccttgattttaatttcttaccttgagtccttttgttatttagaatgaccccaagggaatcattccttatttgattagcagtgctacactttaaagagcattacttcccccttatctcactcccattccaaagaccactagggtataaccgttgcaaacatttgtactttgtctaactacaggaaaacataggaaagggtaccttgcattccaaactcaattttaaatcactggtaatggttttgactggctaatgcaatgggaacacctccaatatatgttggccagtattaatcttagcatagaaaatattcacttttaatttgatggtcattttttttctttttttggaggcagagtctcgctctatcccccaggctggagtgcagtggcacgatctccctcactgcaacctctgcctaccgggttcaagtgatactcaagtcttagcctcccctgagtagctgagattgcaggcacctgccaccatgcctggctaaatttttatatttttagtagagatgagattttgccatgttgaacaggctggtctcgaactcctgacctcaggttatctgcccgactcggcctcccaaagtgctgggattacaggcgtgagccaccactgcacctgggctggtgctgatatttagcaatactgccatctgtggtgttcatagaaacaaaaaaaatcctccaaatactgcttaaaggagtctcatcacacttgacacacatcttttaaaaatttgtgtttttctattgctctttcatctcaaagaggcctatagcagagaatgagtagcacgttgcgctgtctttggggtcctggataaacaacctctttcttttcttttttcttttcttttctctctctctctctctctctccccccccctccctccctctccctctctctctctctctctctttcctttctttctttgtttctttccttcctcttctttttttttgagatggagtttccctcttgttgcccaggctggagtgcaatggcgtgatctcggctcactgcaacctctgcctcttcatttcttcatctgtaacaagagaataaaaatgacttcttcacagatttatataaataatattttaactaagtaattcattttgaaatgtttatagaatgccatttacagataaggtagaaatagagtccttcctaaaagtctgttttagataattaatcactaaaattataattggagttgtcataatcaattatgtagcattgtttcaatgatgttaacattgctctttttcactggataaattgttatgtggcatgtcatcattctaatattcagtttacatgacacttcttctttaactctcctctgcagatattcaatctagagtttgtggcacagtatacataatttttggcagatgatagctaagtgcattgtataaaagatacattatttaccagatcaaaggtcaatgtgttcataatttaatatgccgagggtcatacagtccagaaatgtctgtgaatttctgaagtgacacacatttttgatagaaaactgccattttgtaatggatagcacatcaattggatagcccagcattcttttcagatttacatgtcaagttcatcagtgaggccctacataaatctactctaggattaatttccagatttcatctttaactgtatcacaattctttttttttgagacaaagtttcgctcttgttgcccaggctggagtgcaatggcgcgatcctctgcctcccaggttcaagtgattctcctgccttagcctcccgagtagctgggattacaggcaagagccaccacatctggataattttgtatttttaggagagatggggtttctccatgttggtcaggctggtcttgaactcccgacctcaggtgatctgcctacctcagcctcccaaaatgctgggattataggtgtgagccacagcacccagcctcttttcttcttaaataagtctttctcaaggaaattttcacaatattgctcttgggactcaatgtccttatgtggtaggacactacgttttctgaaaaattgcttattaatctggtatatgtgaactatgcaaattatgttttctattttagtctttagatgcagtagttttactattttagttttctcagatatattcacagcaaaagtactatcattgtagagtagtttcacttagcagtgaaagtaactctgctatgatgtggacactgcttctcatttttcttaataaatattatgtttgttatttttataaaatttgttcattagatatggagttttattccaatttaatgatgatagatgggttttatttttatttaattttactgttgtgttctatgaaagtatcttctttaaaatattgtgtaaagatgtcttaattttactaaaacgatagtaataataatatagatgatactactactaataaaactactattttctgaatatgtacaattgccaagcatgatttatgatttacataggatgccaaatttccattatatatcttcaaatttatatgttcattggtttgttcatctatgccacaaatgttaatggagtacctactaagtgccaacaactatgccatcaaccatgaatcagtcacttaacaagatagatataatcccttccttcagaaagcttgtagtctgggagaaaatttaacagttaaacaagacattgaaaaaagtgtgggccgggttgggtggctcatgcctgtcatcccagcactttgggaggccaaggcgggtagatcgcctgaggtcaggagttcgagaccagcctggccaacatggtgaaaccctgtctctactaaaaatacagaaattagccaggcaggcgtggtggtgcatgcctgtaatcccaggtacttgggaggctgaggcaggagaatcgcttgagcccgggaggcggaggttgcagtgagcagagaagattgtaccactgccctccagcctgggtgcaaagcgagactctgtctcaaaaaaaaaaaaaagtgtgataactgttttgatacagcaagtggatggatggaagaagctctatgagtatacagcagggatacatggcctgggaggaaaaagggctgaccatccattgaaaggtttaattaggtcagtgaagttgctcaagtacagctataaaatgaggcaatcaattactggtgatgcaggagagaaagtgatgtatggagaactttctgaactatagtaagaaatgtaatctgtattctaagggcatacttaattactgaaatagtgtattcaaaataggtatcataatcaaggaaacaatcttaaatcatcatgttccaattgcttgatgattattgaagctaacgtattaggaatagatgtattagctaatgtattaggaatagatgtttcctactgctgagttgaaataacgaacccacttgaactttcgcagacacctctaggtttaccttttatttaataagtaaataaaaatgttcatgttttctataatactttgcatcagctttcccttaatcttggaaacatttatttgactgaagaaattaagcactctcacctgcataaaatattcttctgtatgctatagtggagccagttgtaaagatttagttcagttaataaatatctgttgagatgctggcaaggctgtggagaaataacaacgcttttacactgttggtgggagtgtaaattagttcaaccattgtggaagacagtgtggcgattccttaaggatctagaaccagaaataccatttgacacagcaatcccattactgggtatatacccaaaggattataaatcattctactataaagacacatgcacatgtatgtgtattgcagcactattcacaatagcaaagacttggaactaacccaaatatgcatcaatgatagactggataaagaaaatgtggcacatatacactatggaatactatgcagccataaaaaagaatgagttcatgtcctttgcagggaaatggatgaagctggaagccatcatccttagcaaactaacacaggagcagaaaaccaaacaccacatgttctcactcataagtgggagttgaacaatgagaacacatggacacagggaggggaacatcacacacgggggcctgtctggggttaggagacaaggggagggagagcattaggacaaatagctaatgcatgtgggcttaaaacctagatgatgggttgataggtgcagcataccaccatgtcacatgtatacctatgtaacaaacctgcacgttctgcacatgtatcccagaacttcaagtaaaataataaataaataaataaataaatatctgtttaatttctgcagaagaccataaatatacttggtgtgtcaggcagtgatctgtaagtatttttgttcatgcaatcacaccaatcaaaattttgagcaaataccccaatatgtgtatatttttctaataacaaataatacatatattactatattaatatatagtatacattaatacctaaataaaatagagaattgaaataatggaatacaaataaatttttaaacagctgtaaatatttttctcatggctcaatcgaggaaatcttaaatatcgcccagggagtaggagcttattttgcataccatcacaatggggaaaagaaaaatgaatacactgttatgtctaccttcaaggaggcagcaatatggtaatagaaaagttcacaggggccaggcatggtggctcacgcctgtaatcccagcactttgggaggccagggcaggtggatcatgaggtcaggatttcgagaccagcctgaccaacatggtaaaaccccatatctactaaaaatacaaaaaattagccaggcatggtggtgggcgcctgtaatcccagctactcgggaggctgaggcaggagaatcacttgaacctgggaggcggaggttgcagtgagccgagatcacgccactgtactgcagcctgggcgacagagcaagactccgtctcaaaaaaaaaaaaaagaaagaaagaagaaaagttcactaaagctaaatgctgtgccctgtggtattagaagttagagctgttgtggttcaaagtcaggaagatattttcagggcaaatttacttgtaagttggggccaaagaaaggaaggtaatagggaacaaaggctggaaatacagcatgatggttctttagagcaatgcttctcccagtgtaatgtgtctttgaatcagctagaaatctgagctgcggcctgggagtctgcatttctaacaagctcctaggtgctgctaatgttgctggtatacagaccacactttcagtgtcaaggctttaaaggactttctcatctaaaatgaggagtttgtgcttaaattgataggcagtaggcaatttggaaaggtgttccagctcagagcaacatgatcaagttgaactctaggcaaagtaatttagcagtaatttatagattggaggccaagactggaggcagagagataagtctagaggcaattacaggtgagaggtaataagacctctgaagtaggacatggcagtagacacagaaaagggacatggtagaagcagaatcaacctgagaagagagataacaaaggaacacaggtataatatatagaacaaattaaaacgaagactagagaaactaatgagaaatgtgtcctttactgttcatctagtaatttggaaatttgaattttcatatatttaaatacatatgcataaatgatattttcagctaaccaccagaaaatttctggtagaaaatatcacaaaataaaactggctttgaatatgtttgtctttttccttgatccttatttccagaaagaaatacatgtcctggaagtatatgtccatagaggtccaataaatctcaatgattgtaaatagagctttattcatattgagcaaatgtttcctgttcacttgcctctaggtgaaaaacataaatgtctttatacaaatctctgaaatgtttgaagcataaggaaggtgaaagtggcaaggagacatgtattttcattataggctctgaatatccatagctgttttctgctatttagccacttcttcctttgtgacctgactttggacggcacacattatcaatcaggaagaccattatgttccttttacttgtacttgtcaatgtctggctgctcctactgcaagataagctccttgagagccaagactgtgtactattcattttgtatccccagatcccagtgcagatgctgaataattgacttataaataaatgtgtaaatgatcccagaaccaagcacagatatgaacacaaaaaaaattcctttggagtgaacgaatgaattaataagtaggcaagtgaaagaatgaatgttgacttagcccttagaatggccattgacaggttctgtttttttattactagataagcaccaaccttattctactcaaagtatgtgatcaatatttcactcattcatgtccacatactataagaagccttcacattatatagtgactttgaaatcaaagtctaagtctaaattttattataggagaaaaatgtgtgtgttgtgcattgtggtttagtataaatataagtcagattccttgacatcaaatcagttcaccattttttcactcacagactttttcgtcatccttttaagcctcccattttttctttttttaaaaaatgatttcattatactccattattgtgtatgtgtgtgtgtgtatgtgtatctgtgtatgtgtgtctaagtcaaaaactaacctcttctatgggtattttgttactatcctctgtaatataatgtgggaatctttgtccgtgagcataaacagggtgagtgcaggaatctagccatcagttctttctgtactatgcatgcacagcgtctaacttgtgcttgtaatttgtgattacgtcttcaggatacatagttttaaactaggccgagtgcggtggctcacgcttgtaatcccagcactttagggggccgaggcgggtggatcacctgaggtcaggagtttgagaacagcctggccaatgaggtgaaacctcatctctactaaaaatacaaaaattagctgggcgtggtggtgggcacctgtaattccagctacttgggaggctgaggcaggagaatcgcttgaacctaggaggtagaggttgcagtcagcggagatcgcgccattacactccaacctgggcagcaagagcaaaacttcatctcaaaacagaataaagtaaaataaatgaaaaaaataaaattaaactaacagctaactcacagtcttctgctaaaaaagtgtcatacattcagattgtttactctatcaggttagttactcatgctgctatactgtttccaaactcttaggattctagcacattgttttagtttaattttcactgttcctttaaatgtttatttaattcattttctaaaatcacagatatgagcagagccttggagaccatctagtagaatccttccgtggaatagatattaaaataaaaactcatattggttaagttactttacaaaggacatatagctggttattgaaaaaagtggagtaaaaatgaaaatctcccaaatccctaggacagtgatttctcttacgctgtgctatatcactaaaagattttatagtttccctttggccatcagagaagctatgtttaatgtcaagcctgattcatagttaacatcatatcttttgggagcctagatatgataaaagcaaaagagctacaggcattttgaagaagcacttcctacacactactatataccttgaatttgtactggaattgtttgataccctctcagtttattgatactccaaaagaccgaatttctaggtttgttttctaagctttgtcaataagggtagtatttagtcatgcaacactttagctcaaaatattatcattacacattgtctatatgtaaaaataactttgcatatgcatatagattttccagttccattcagcatgaggcatcaactctttgtagtcttttttatataaacacacaaaaattagtttatgacttgtgctatcatgtgttcatgctggaagacggtcagatgtatgtagaatatagcttctgttagtgctcatagtctggtggttcacaggaaaatgaagaataacacaaggaagtgcatgtaattattttaataacttcattcttgcaaataacagaatgaatgaaacaatgttttgcacaacctattttatttgattttcaaaggaagtcatcatgcaatagtccattgactttaattctacctgcttactgtcataaagtaatcttcatggcttgaacaatccagagcctgtgaaatctcccttgaatctctgcatctctccatttccaacaccatcagcctactcgaagtgacaatcttctgaacaattgaaactgcattcactcttgcctggtttgtttactcatcattcaggcctattttttaatgtgtaaaattttaaattttttgtttaaaaatgcaagtatgatcaagctgctctctgacttaaaaccatttggtaacttcctgttggtcttaataacttcccattgctcccaaatccttaatgagaccaacatattttgcttacttttttctctttctcctcctatcttcaccccattcctctcatcttactctctcagcttctctcaccatgaaagtgcatgccttgactttttcatcccagggcctttgcacatgctgcttactccatttgcaaagtattgtctgtcaaatgacttgcaccacttcagccaattatctccttttcatgcgtgaatttccagattcaatgtcacttccttaggaaagctttttcttcaaagactgggttagaattccctgtcacataccttctaacacctaacaccgtgcagtcctgcttcacagcaataatcatagatataatgtggaatttattgattttgttgaatttattgttaaattttatgctaaataaggccgtatgttctttgttcacttcctccatgagaaccttgcatcttgttttgaacacggtgaattctcagtaagtatttcctatcatttcaaattttttgtgcctattttattttttacataatatattggtagaatattacaggtatataatttatatagtgataaatgtagagagagaatatgtactcccttcccattccgcttccccttccccttcccttcccttcttcctttccttccctccctcctttcctcacttcctcctttccttcttatttttttctgtaacctaataatattgtataatcaaaaagtctggagacttctgcttgttttttacttaatacgtattttccttctatttaataaaaggagactggcctgtcttttaaattgcattttatggcctaaatttctactatatgattcaaaaattgctctgccatagtttgtgagaagacactatgttattttacttcctaaagaaagggtagtgaacaaaataataaaagctttatattaaagacaataaagttgatagtgttgtgaaatcatgttactcttattttcggtctgttttctttccagatctctttcctgatctatggtatatatgccagaagccataaatacttaatacagggtgaataaaagacattttaaattaagcatgcccccccaccaacattatcaagagtaaaatgaaatagaccaataaatcggcttacttactggccaacacctaaattgattattagatgtaatggtacaaatttgtataaatatcacacttccctctaatctttttaaatgaaatatgcaggaaggattgtcaaatggaagtactatactaaaaagcgattatcaccatggtaatgttggcttgcttttctgttccttttaatttggttaccctctttattgttaaattttttaaaaagttttctacttttacattttttatttatacttaacacataataatttaaatattggggtacaatatgatgtttcagtgcatgtatacatagtatgaggataaaatcagggtaattatatacaccaatttagacatttatcatttctttttggtgacagcattcaaaatcttcacttctatctgtcttgaaatatatattacattgttatttgctatagtcaccctagtgtgtaatagaatagcaaaacttattctttcctgtctaactaattttgtaccaattgactaataacctttcccaagaaccccctcccacataccctcaccaatgtttgctaactactattctactctctacttatataaaatcaacttttttaggttccacataggagtgagatcatgcagtgtttttctttctgaacctggcttatttcatttaacataatatcctccaggttcatccatgttgttgaaataacaagatttcattctgttttatggctgaatagtattcaattgtatatatatatatatacacacacaattgtatatatatattcatatatacaattgtatatttatattcatatatatacatctattgtatatgtattgtatatgtattgtatatatattgtatatatattcatatgtacaattgtatatatatattcatatgtacaattgtatatatatattcatatgtacaattgtatatatatattcatatgtacaattgtatatatatattcatatgtacaattgtatatatatattcatatgtacaattgtatatgtatattcatatgtacaattgtatatgtatattcatatgtacaattgtatatatatattcatatgtacaattgtatatatattcatatgtacaattgtatatatatattcatatgtacaattgtatatatattcatatgtacaattgtatatatattttcatatatatgaatatatatgataaatgtgatatattaataaatgtgatatatatcacattttcttcatttgtaaatgggcatttatgttgattctatatcttggctactgtgaatagtgctgcaataaacatgggtgtgcatatgtctctttgacatactgatttcatttcctttggatatatatctagtaatgggattgctggatcatatggaagttctatttttatttttttgaggaaactccatactgttttccataatggctattctaatttacattcccaccaacaatatataaggtaaattctttaggcattgccttaacctatacagtcactgcctcactatagaagttattttactctgattttgtggcatcattgtgttttaaacaaaaagtgtcatctattatgataatattatggcagctgtatttattttcctgctttctgtaaattagggtctcaagacttccttaagtacaattatagccaaaatctcatatgaaaaaaatgacagaaacatgcatcagataaaaaaatataaaaatcttcagtgactccaaaaatatatggtcatttagttttaaaagcaatttcaaactacctggtaggatctaatttaatgattcttaccatgatttcttaaagagtattcatcgttgcctccccttaacttttaatgaaaataactaccaaatctctttgttatttggaaactaaataaataaactggatcattaacctgaaaatgttatcagtggtcccaaagtttcactaatggaattttacatatttaaattaagcaataaaggataagaaaatatgtaataaaataattagatttaatatctatatgtggttcatggaaaaatcaaatgttactttgaaactttgtccctataataatatttaattataaaatacacaatagaaattactcttgagaataatttttatgtacctgattgcatttcaatccacatttcccatggaacctgaagcaaataccttacaaaaaagtaaaaattctataaggaatgtactaaatttgtaccccagcattagtgatagaatagatgtctacacagattacaaataagtcaacaagttatttgataatgccaattcttagatgaaactaaaaccttttacattatctatattgttcccttttatatcaacaatgatctttttcctttacctagtcaagttgctagagaattcccctttcaattcatgtagaaatcactttctttataaatctgtgcccatctgaaaacagccaatacttcttggatttttctttattcattcttcacatgactttctttatctgaaggaaaaatagtagatataacctatgaatcttattattcatcaaaaagacagagaatgaacatgtctttagggattactatgaaaatttgacaaaaactatatatgaagatgaaggcgagtatttgagatgacttgcaacctgtttttctgtttctctttcttagtttagaaattcaatataactatgatttcagataatacaaaccttgtcagttttgttttatgaataggttggatgtctcctttactagaaaaatgggaaatatgtttagtgaatattcaacgtatatgtagaagtgattagtatattatttattgcaatttgagaaaccaaattgaaaagtcaccataaattatgaagaaaaatgcataacattccaacccctcgataaaatttctttgaagttaatatgaccatataataacttttggtgttagaaatatatattttatttttacttgaactccgataacttcagcaaaatgctgttaaaagtattctgtgcctccctccattattgtattagatgttttaagaacataacaatgtggtgattattaagagtgaataattatatttaatgaactatgaccatgatttgaattttatatggatggtggtttactttctgttactgaatgttgcacccagtgttgtgggattttgttttgttttgtttttgagatggagtctcactctgtcgcccaagctggagtacagtggcacgatctcggctcactgcaacctccacctcccaggttcaagcaattctcctgcctcagcctcccgagtagctgggattacagatgcccaccaccatgcccggctaatttttgtatctttagtagagacagggtttcaccatattggtcaggctggccttgaactcctgacctcaggtgattcagcctcccaaagtgctgggattacaggcgtgagccactgtgcccggtcataccaattgtttttaagtcatagggtaaaattgaaagggcacagacaccagaattaaaatgcaggtctgtgtgaatgacctgaactactctggtcctcaatttttttcacccataaaatcggtgttagatttcctactttcccaggaagtggtgaggatggtgttgtcattattgaataaattcaaacatgagtcatgtaccacagcatctaactaatataaaacgcttagttgatattaattctattgtctctatgtgagtatgattaaatgtaaaaaagtaacactttataaggcaaaagatatttctcaaaacaggctgaagataaagattatagctatagaattatcaagaattatgaaatatataaatagaagtaaagttagttaacatttgggagatacagtgttcaatcagtaatttattaggcatgcaaaattaaggctgtagacatagaaaaataattatctgagagcaaaactaaatatcatgtctatgtttctaaatgtcagtacaaatagcaaatggagggaaagaaaaaaaaaagggacattttgctttcagcataacactccatgcatttgaatgtttattgtggttttttaatgggtaaaatagggcttcttaactgagagaatgaatttgtgttcaaatagtggttttcaatttgttctaagcttcttaccaaattgaaaataatgacccattttgccaataataacctcaagatgtctttaataacccaaggtattttgaaccattaaactggcttgaccaaattctgcttagtagcacacatgcagtttctttcagcatcaagaaaattactacatttttcttttcaaaaggttaagttagctgtgaactgaagtttttctaatttaaaggttttttaatactctataggtatagctaaatctcagtaattgaatttgttcgtgaaagcaattgtatgatcctagaatacatatgtggttttcagttcattgcttatggcattggttctcaacgtgtggttccttgaacactagtagcatcacccaggaacctagagatgcaaatttctggtccctgttcaagacatagtgaatcagaaactcaggagttggagcccagcaacctatttttttaaatcaattttattgtatatatttgaggcttacaacgtaatgttttgggttacatatagacagttactctagtgaagcaaattaggaaagctattgtcttggtgtagcttgtttatatgtgacaagaaccacaaaaatctacttacttaacaaaaattgctaatacaatacaattaacatgccctccaggtgattctaatgcattctgaaaatctatcaagtccatatctggcatttaataccatacattagtgtttgcagcagggaagcaaaagttttgaggagagagccctcatcagataggtctaatgaagtttaatgagtcttgtgtgattaaacattgacaagccggaagactttggggaatcataataagaatcattcgagtcatgagagtctcattggataactttcttcagcaattcattaaacattggagaatcaggatgggaagaggaggcactgaaagaaaaactggtgaatttggcatgggatcatttatctgaccacaagctgagcagggagactgttgtcttttcatggatgtcatgtctcttacagaacagagaggtcttggacttgctgctaaacccacccaaggcaaccaaattatggttgtttttattccagtaaagtggtggttctcagatcccagtgtacttgataatcccctgcgtaattattttgaatacgtatgcctgagtcacttcctgagagattgtgatttaggaggtccaaggaacatacttacaaaacagtgctaatggattgtaggtaggcggatgattttattcagatgccttgtacaaaatcagtattatttttggattgaaaaacagctaataaaaaaataaacacttaaataaagtattatcaagaaagctgttttaggaatctccacatatgggaaatactttttggtgcaatttctagtatcactgatttaataaactaaaaataatatcagataattgtttatattgttaatgacaatgaatagatagctactctatggtttactagtgttctgcattatgaaaggaacagaaaattcatacctttgtggtccagcagctactctaagtaaagtctcattttgactgttctgtaagtactttccttatcattgctaatggtgattacagggccactctattattgtaagttagctcaagcaacctggaagctgaggctacttcaatgatcatttacaagttataagaggaaattggttgtgaagagatatcccgcaaattcagaattagcatggcatatgctacttccatagagtaagaggaaacctaaaaggtaaaatgtagaagacgcagatagggaaaagcaaaaataaagcataaaagaatatgaaactgtctggatgatatgtgtgaaactttgccaaaagatgactcaaaaatcttcaatataagccgcataatgcttccatatatgtattaaaaggtcaacataagcatatggatttataaaaatgaacaatcaacaagatgcttttttttttttgagacggagtttcactcttgttgcccaggctagagtgcaatggaacgatctcggctcactacaccctccacctcctgggttcaagggattctcctgcctcagcctcccgagtagctgggattacaggcatgagccagccaccatgccctgcgaattttgtatttctggtagagacggggtttctccatgttggtcaggctggtctcgaactcccaacctcaggtgatcagcctgcctcagcctcccaaagtgctgggattacaggtgtgagccaccacgcccgccacagtcaacaagtttaaagtagttgacagtgtattgatatgagatgatttgcatggaagtaggaagatgaatgtgcagaaaaattgctgattttcaagagacataatttcagacaaagatttactaaattgttctggcttggctgatggtaacccatcacttgtgccgtgactcggagccataaaggaaaatatatcaaatagaaaaatgaaatatattaaggtgttattgcaaaatgcatgtgatgtttaggttacattgtcttgcttatgaagacacagctaagtaatagtacatatcaaatgtaaacttcatggagagatgaccagtggttaatagttttatgtaatatttgttatcgcataaaacacagaaaattcagaagtagatttatagtaaaaaccaatggggtttaatgatataggaattgctattccagtaaagtacagaaaaaaaactctcattaaaaagcataaaggttgatttatttaaattgcggtgggtttgtttactaacttcagtggataaagttctatagtaagaaaaaggaggcacaaaaagatccaggagacctggcgtgctggctcacgcctgcaatcccagcaactttgggaggccaaggtgggtggatcacgaggtcaggggatcgacaccatactggctaacacagtgaaaccccgtctctactaaaaatacaaaaaattagccgggcgtggtggcgggcacctgtagtcccagctacttgggaggctgaggcaggggaatggcgtgaacccgggaggcggagcttgcagtgagctgagattgcggcactgcactccagcctgggcaacagtgtgagactccgtctcaaaaaaaaaaaaaaaaaaaaagagaaaaatagaaaaaaagaaaggatccaggagtcttaactttgtataccaagtaaaaacctcacgctcaaaatggatattggttgtcataatgtgtttaaaatactctagcataatctttaaagaaaaatgatggtcatccttttgttatagtgacaagtcactacttatttatgttttgaattgagatttgtttatttttttccactgccttattgcaaagcacttgtcacataaaatatatgctcaagggccttggaaagccaatgaagtgagttatacatgggctgagattaatcagtttattatttcttaagcttagtagctataagtaaaagtaaaatgcaattcagtatttgaaaatgccacatactgccctctggagttttccatgcagaagaagaaatagaaaaatgagaattgcgaggatttagaaacgacatggagtagcttttaaaaataagattccaagctgggtgtggtggctcacacttgtaatctcagcactttgggaggccgaggcgggaggatcatgaggtcaggaatttgagaccagcctggccaacatgacaaaaccccttctctaccaaaaatataaaaaattagccgagtgtggtggcactcacctgtaatcccagctactcgtgaggctgaggcaggagaattgcttgaacccaggaggtagaggttgcattgagccaagatcatgccactgcactccagcctgggcaacagagtgagactctgtctcaaaaaaaaaaaaaaaaaaaaaaaaagattccagtgtatattccatgtagaaatgggaaaatttacatttttcttgaaatagtatactgcccaatatgatgcttttatttactctagcttagtagtgctaaaactttagcctgcatcagaattagctagggagctggttatacacaacttgttaggcctcagccctggagtttctgataccgtaggtctggggtagagtttggtaatttgcttttttttttttttttttttctttttgatacggagtcttgctctgccgcccaggctgaagtgcagtggtgcgatctcggctcactacaagctccacctcccgggttcacgccattctcctgcctcagccgcctgagtagctgggaccacaggcgcccaccaccacgcctggctaatttttttttttttttgtatttttttagtagagacggggtttcaccgtgttagccaggatggtctcaatctcctgacctcatgatccatccacccatgtaggcctcccaaagtgggtacttcgcttttttgacaggtttctaggtgatgttgatgctgctggtctaggaaccacactttgagaacccttgtccgagtttctcataagcaaatttgaaacaaacaaaaaaagcaacttcaaaggaattcctcaactgttttataaatgcacttactatggatggttacctttagaaaatttacaaggaaaaatcttgaaattttatggggattgttgaaagaggaacatttgtttcattcgatttttttcctctctagcaacttaagggatccatacttacgtctgatggtcatttctggacttacaaagacaatacgatacaattctgtttgtggtgaatagactttctgtatgatgaatgggtattagtttgaaaatgtgtcccctttctgctgtattgtgcccccttccccactaaaatcctcaatgccatttaccaatcttttcctgaagatttcttgttattgacaagcagagggagattggaccgtgattcaaatgaggttgacaaaaaccagaaagcatttgatttcaagactctaaatttacccaacgttttgttctggggatttggatattttggttataatggtcgtgatacttcctgactcatcagtcttctcagcattctcatttcccttacaactcaattgaaggctggccccagaggaactggggatctgtcaagtagtgttcatctcccttctcctataaagggagatgactgtatagtcaactgagctgaattctgcttcagtggagaagaaacaaataagggagaagcagttctgcccattagaggacataccataatacattgttgatgatggagcaggggggatgcctttctttttctctgagaaagaacagaccagttttgctttaatcacttgttttattggctcattttgaagatgtattgaatcatctgatcattacattcacaattatactcttaatgaactattttttctcactgtagttacactgaacttctcccaaaaattcgattgctgtctccagctgaatagacctattttattttatgaaaaattggcacaaaatgcttctgttcttttctagggcagagtggttaatttcatttgaaatatacttggttttcttataagaatcactgtgtatacatataagtacatttgcataaaatacaacatttacaataaaagtattgtttaaggtactgtattgtttaaattaattttctattattatactttaagttctagggtacatgtgcacaacgtgcaggtttgttacataggtatacatgtgccatgttggtttgctgcacccatcaactcatcacttacattaggtatttctcctaatgctatccctcccccagcccccgaccccatgacaggcccggtgtgtgatgttcccctccctgtatccaagtgttctcattgttcagttcccacttatgagtgagaatatgtcgtgtttggttttctgtccttgtgatagtttgctcagaatgatggtttccagcttcatctatgtccctgcaaaggacatgaattcatccttttttatggctgcatagtattccatggtgtatatgtgccacattttcttaatccagtctatcattgatggacatttgagttggttccaagtctttgctattgtgaatagtgttgtaataaacgtacgtgtgcatgtgtctttatagtagcatgatttataatcctttgggtatatactcagtaatgggatggctgggtcaaatggtatttctagttctagatccctgaggaatcgccacactgtctttcacaatggttgaactaatttacacacccaccaacagtgtaaaagcattcctttttctccacatcctctccagcatctgttgttttctgacttttgaatgatcaccattctaactggtgtgaaatggtatctcattgtggttttgatttgcatttctgtgatgaccagtgatgatgagcattttgtcatgtgtctattggctgcataaatgtcttcttttgagaagtgtctgttcatatccttcgcccacttttggatggggttgtttgatttttttcttgaaaatttgttcaagttctttatagattctagatattagccctttgtcagataggtagattacaaaagttttctcccattctgtatgttgcctgttcactctgatggtagtttgttttgctgtgcagaagctctttagtttaattagatcccatttgtcaattttgccttttgttgccattgcttttggtgtttcagtcatgaagtccttgcccatgcctatgtcctgaatggtattgcctaggttttcttctagggtttttatggttttaggtctaacatttatgtctttaatccatcttgaattaatttttgtaaaaggtgtaaggaagggatccagtttcagctttctacatatggctagccagttttcccagcaccatttattaaatagggaatcctttccccattgcttgtttttgtcaggtttgtcaaagatcagatggttgtagatgtgtggaattatttctgagggctctgttctgttccattggtctatatctctgttttgataccagtaccatcctgttttggttactgtagccttgtagtatagtttgaagtcaggtagtgtgatgcctccagctttgttcttttggcttaggattgtcttggcaatgctggctcttttttggttccatatgaactttaaagtagttttttccaattctgtgaaggaagtcattggtagcttgatgggaatggcattgaatctataaattaccttgggcagtatggccattttcacgatattgattcttcctacccatgagcatggaatgttcttccatttgtttgtgtccccttttatttcattgagcagtggtttgtagttctccttgaagaggtccttcacatcccttgtaagttggattcctaggtattttattctctttgtagcaattgtgaatgggagttcactcatgatttggcaataaaaaatccttctcaaccagttcaagttttatatttgtgtattctaggatagctagtgtggtagttagaataatgactccccagagatgttcatgtgtttatagctggagctatgttacctagtatggcaaaaaaagaaaagactgtagatgtgattaaattaaatgttaggggatgggatatgatcctggattatctgggtgggcctggtgcagtcacaatggttcttataaagtctgactcagaaaaggaactctaagtaaagctttggtaatcaacattattactgaacgcatgctgagtttgaataggctctgctgtgacttttaatttttttgtacaaccccaaaacataagtgatattctcttattggttttgagtattgagtccttataagagtacatgaaaggacagttcctacctcactgctgactagaacagtggttctcaaattttagtttgcactggaattacctggagggcttgctaaaagacaaaagtatccgattcagaaagttgggtggggcacagaaatttgcatttctaagttttccaggtgtgggtttgtgaatgagtggaatgggtaatctactcgtgagcactactggcccagaagaaggtttcataatctttgaaggaaatgaaaaaaaaatctactttaggcttattgatcaaattaacaacaaatcaatctctctctctctctcaagatttcactaatccttgtatttcaggccctttgttgatcatctcattgaataagccatgttacattggatagcatcacatataaggatggttgtcagtgcaatgagaactactgtcaaaaaaaaaaattgaggaacaatgttttatataaagcacctctgaaaacctgcagatataacgaatatttattattaaatatttttaatcctttttcatccttttgagattagtaagactcaagtacttctctattttcaagaagaaactcattattattattattattattttttgagatggagttttgctgtcgttgcccaggctggagtgcaatggtgctgtcttggctaactgcaacctccacctcccgggttcaagcaattctcctgcctcaacctcccaagtagctgggattacaggcacccaccaccacacctggctgatttttgtatttttagtagagacggggtttcaccgtgttggccaggctggtctcaaactcctgacctcaggtgatctgcccaccttggcctcccgaaatggtgggattacagatgtgagccaccacatctggccagaaactcaattatttttgttttttgaaaaaatagtggaacctccattaggctattcccttaattccaaatcttgtgctctatcagttgatcctcatgacctaatccaaacataattcctttttcatactttgctacattgctaagaatgtaaacattacagtgacgttttagattcctgtatctttatctgtatgtacatgtgtgtgcaatacatgctcaagtatgtctgtgtatatatcaaattgtttctgtgaaacaaagaaacggaggggtggtgagagttgaattgattcttggaaaatgcatccatgcttttgtgtttccttcttttgataaatataattactttaaaataaaaccttctatattgtctttccactgtgtgaactatttaaaattcccaaagaaagagtttaaggaacatgtgatctgactgagttgctaacatgtgacctggaggagtttacctggcctcttttagtctcaattttctcatctgtagtgaaaacaataatagtctcatcctaggtttctgatgaggattatataatatagtacttggaaggtttttagcacaccatgtgttcattaataattacttattagtattctcagctatttaatactatattctcactactcctatttgcaaaatagcactgttaggtctccatggagctctgaataaatcttttgaccataagaacattatgattcagcatctaaacctataattttttacatgctaatagtctaggtattactgtttgaaatacattatgttaagcatctgacctcttccttgtactttgaataccttgatcatttcagctaaagttcactgatggggcaaactttagaaagaattaggtagaagcattcactgactaattcagtcaaggaacaattctagaattcctactatgtaccacatactcttttttagagatacagcagtgaaccaaacataccaaaaattatgcccctgtggtatttatattctagtggagtgattgctctcaaaattgcataaaataaaggatggcaattatatttatataactgctaattcaactttatccatgtttcagattttcaagaaatgctcctttttaaattatcataataaagcagatgcaactgaagaccatttacgttcatttttacaattcatctagactcataagcactaataataaataatctctaagtcattgaaatattgtcatttatagtaagtatgtatttggtctttttctccatttcttggcaaacaactgctaaagcccatggaatctccaaaatagtgtctttgtgtgtaataatgagatgactgatggctctggcctcttagatagctttaagatggagggcggttgccaggggaaccaaccatgttattagagagttggaacttttagccttgcccccccccaccccatgccttccctgacctctggtagaggagaagggctgaaggttgacttgatcactgatagccagtgatttaatcaatcatgcctatgtaatgaagccttcataaaaccccacaattcttatggaaacagaaaaactgaatctggcactctgctttactagactaactcctgggcttttccattctgtagcatccaaaggaaaaaataagttttgtgttggttgatttgcagacaggtgtgtagcactaatgactgcattccagaagtggcagagctaaggtgatttgattttctaaaatggtaaaaaagcctttgtaaaattgcaaagaaaacaaaccaaaatcttcctttggattgcacatagttgaattgctagagaaatcaattacattaaactttgaaaaaagattttacatgtttatattacgtggagttaaattacacgctcatgtacttagttttttttttttttcacctttgtcaatgtctaaagaggcatcccaaagtcacaaaaattgtgaaacattgttttgtcatttggtaacggccagcatatgacaaaacttgtaacatatgtgccctgtggtaggcacaataatggccttcccaaagacattcatatcctgatttttggaacctgtgaatatgttagcatacatggcaaaaggaactttgcagatatgattaaataaagatcttgagatggggagattgccctagattatccaggtggactcagtgtattcacagggtctttataagagggaggcaggagagttagagtcagagaggatgagatagaagcagaatttgaagtgatgcgggaccatgagacaaggaatataggcagcctttagaagctgaaaaaggcaaacagaagggattcttccttagagcctccagaaggaaagcattcctgcttacccattttagacttctcacttccagaaatataataaatttttgtagttttaaggcactaagttttggttacttgtttacagcagcaataggagattaattcatgtcccaagtacttaaggccagtattgtcttccaatgaatgtgacgtcaaaaaaagaaaccaaatatttctatactgtttcctgtggagatgtactactctgattttttccctcttctccatccctgcagatgctgactgagttcgctctgatcatctcccatctgaatcaatatagctttctagaattttcccattcttcaaacttgcatccctccaatccagccccccaccatttgattgttcaaacattttttgtcaaacctaaatcctgttatttctctgcctaagcatccttatggtctcctatgtttctgtggaataaagtgcaagcaggtgactttgactgacaaacccctccatgatctacatcttgattgccttttcagtcatctccctcatcacatactcatctctataccctgtggtacaaactgtcatccccagtacagatgagattattttcttgcctctggctctttgttcaaacttttcctactgaatgagatgccctcctctctcctcttcactcccattccctattttattttattttatttacttattttgaaacagaattttgctcatgttgcccaggccagagtgcaatggcacgatctcagctcactgcaacttctgcctcccgggttcaagcgattctcctgcctcagcctcccaagtagctgggattacaggcatgtgccaccaggcccagctgatttttgtatttttagtagaaatgggttttcaccatgttggtcaggccggtctcgaactcctgacctcagatgatctgcccttctcggccttccaaattggtgggattacaggagtgggccaccgtgtccagcccccctttttttaaaaacaaaacaaaactttttcttgtttttaggacgtttgctcaaagaagctttgtgttattcctctagttagaactgaccatgttcttctttaggaacccatttcaacgtgtatatacttctattataaaatatacacatatttctattataaaatatacaccgtcatcctgacttgtttgcgtttccatttctcatttctagcccatgagtgcctaggtggcaggaatgatgttttattagtctctgtgttcccagcaacgaatatagtatttcagagagtagtagggtgcctaataaaggcttgatgagtgaattaaattaaccagtgctcacctgaggacatatgacatttgatgaaaattatacattgatttcagctgtaagaaatgatatttaaattattatccagccaaggtttgttttcttcaacgcatcacttaacatgcccctgtagaatgccattgagccacttaaattatgtatttttgtatgtttgtttgttttcttttttgagacagagactatctctgtcgcccaggctggagcacagaggcttgatctgggctcactgcaacctctgcctcccggattcaagtgattctcctgcctcggactcctgagtagctgggcctacaggctcatgccaccacacatggctactttttgtatttttagtagagatggggtttcaccatgttggccaggctggtctcgaactcctgacctcaagtcatctgcctgcctcggcttcccaaagtgctaggattgcaagcatgagccaccgcacccacccacattatgtattcttcattgagactgtgttcctattcttttttccccggatttcttgatgagcattttgtgaaagcacaagtaaaataatgttctcaagtcaaaacaaattaaataaatcaattcctattagtacactggacttgtcatagaagacaattttgtgagtctatatgagatgtactgtgttgttcctaaagccatgatgatttctgttattccatagaagtctaataaagcattcacagagtaaattgtacagtgttaaaaacctgccatctttatcactttcagtaacaccttctaaatgatcgtgagtaatttgtgattttaaaaattatatttttaggtatcaaagcaataatgaaagctttttgtcaagtgaatcactaagtaaaagtttgcatttatcattcatgtaattacagaatattcaattgactggaaacattccttaacactttcttcttaaataagcatggtggtaaatttccaatgatgtctatattcttacgttttgttttttcacagaggatcttaatggcatgtattcctaacctgactttatattgctatatgactttggggaaattacttacccatgctaggcctctgcttctctaactctaaaatgagaataataatgttgataatttcaggaggttgttgtgaatatcaaatgaaaatgccagtaaagcacttaccgcaatgcctggctcaaagtaaacgcttgatcaagattagctataaatatcattactagttgtggatacctgtgctttatttgtttatgacataatgctcttcatttaggaggcactctatgagtgctgttgactccatgatactccaagtcataaaacataattaaactacaaacctggatgtcaaggtgatttacaatgtaacagagatatgataaatctacaactaattataaggaagtatatgattaattgcttgagaaggtcaaatgtgtaataggtttataaagaaagcagaaatgacatttttagctgggctcaggtatcatggtgtcacagcagcaaaaaaaaaaggctccatttaagcatttaagaatgggtctaattttgacaaaggaaataaagaggtattctaggcaaggggcagcaaatgactaagaagaaggaggagagtggaaatacttaaataaagcaaatagttttagttttacttcagtcaccctactattagtttgagaatttttattacctttatctctaaataaaactcactgttaataggtgtttacataacagcctgtaataagcttttaatatttgttttcatgttgatgtgtgaaggtttttttattcataaaaattatgacacatacaaaatatagtgttgctataaaaatgaatgatgatcataccaattttttaaacagctagatacatgcagcagagttgaaagcaaataacaaaaattctggtatgaaaaatgatgtaattggcctcataagtcttctttgtgaccaacttggacagttgctctggctgatacaattcgttttgctataatcaactattaggatgccagaaatgagtttgacaccttgagtacaatcctttagtccagttttgaaaaaggctaggaactctgcaatagtaaaaatattaaaaagtcagtttaggttgagaaacccttgatttaaaagacttttatttgcaacaatggcctagtagaaaggaaagaaagatagaatataagaaaaaggaggaggaaagacaagtatatttgtaatcttgttcccatagttgtggcattaagttaccacggttgcaggaaaaagaaaattcatctctaaactgatctaaggtaggactggagtgtcatatctttaatacatatttctgttattactaataattataatgataataataggtatttacttattgactagtatatgacagatattctatgtggtgtttgtgtacataatttataatgcaagagaaatttttaaaaaggtatgtacatttcataggtaaggaagtcaaggtttaatgaataagtgacaaaatcagcatttgaaattttttctgcagaaaagtaaataccacatattctcacttataagtgggagctgaattatgagaacacatgaacacatggaggggaacaccacacactcgagcctgttggagttgggggggagggagagcatcaggaagaatagctaatagatgttggtcttaatacctaggtgatgggatgatctgtgcagcaaaccaccatctacctatgtaacaaacctgcacatcctgcatatgtatccctgaacttaaaagttggaaatccaaaataaaaataaagaaacttgttctgtataacaacaaagtatttagccattcctctgttctagacttggtctagaagggtcttgcatgatgtttggcttataaattgaggagcaaatgaatattttatgaaaacatttactaatcctcagaatcttctgccaagaattatgacatgtgtaagacttgactctacttgaaagctaacaaggtagcttgccacaggttcatgaatactggcacaaaagacacagagtattgggacagaggcaaatggccttattactcatggcaataaaaactccccaaaccccaattctgagggtgtggcatgaaaaaggtcagatgacgcctgtttgtactgtgagttgcattataggataggaaccctgagtatagggaaggtaaatctttatactggacagtaagcatgcatgcccattgctctgaaaggagacactgtcttcatcttccaaggccgttcacaatgcaaacatcttttaaaacatcatctgcaccaaagtacctctacttgcaagacttaaaaaaatgtgagcaattcaagaagaattttctcctaacacctttcatttacacaaatgtattcttaggcacatggaaccaatctatcccgttttcaccccttactcccctatcctcatactcttctgctttaactgttatttagattccaccatgctgccataggagagactctagctgtaatacattcaaactgacattgaccagcctgaaactggaaggaaaccatatacttatttggcacaagggaacttggctaactctgaaaagctggtctaaactgccctctagagctctactctaccaattagtgccaaatctaaccaattacatgcagttcccatgcatattcctctctttgtaaatgaaaagtaagagctaagtaagcagtgggtcacccagcttctggctaaactagaatagcttgcttccccaggagcctgcaatacttacagcctcaaccatgtggttaaaatcattctccttccacagactactcctctgtgtctttacaatgaacttccatccctttaagcaatctctgcatgtctcttcctttgtgactctgagaaatttgactggcaggataggactatatttatcttcctaattttaaaagcatttaattaccaataattaccaccaatgtgattttttcccctagtgcacattaaaaattttgaatcccattttctgtaataatttaagttgatctggagggacagagagtaattaattatctataatttctcaaactgtaaatgccgaatttattgaagtgaaacaaatccagggtagaataaggctgaaataaataggattgcatgagaaagaaggatgcagcaaaattaaatattttttcaaaattgaaagagcttaaagctcttaagtactgtagttgggttaaaacatacactttttttttttttttttttgagatggagtcttgctctgttgcccagactagagtgcagtggcacaatctgggctcactgcaacctccgcctcctgggttcaagcgattctcctgcctcggcctcccaagtagctaggattgcaggtgcccgccaccatgcctggctaatttttttatttttagtagagatagggtttcactgtcttggccaggctggtctcgaactcctaacctcgtgatctaccagcttcggcctcaatgtgctgggattacaggtgtgagccaccacgcccgcccactattttaatcagtatgtcaggtcatgtctcctaaagccctttttaaacaaaaattgagtgtttattgcttgcaaaatgtttttactgtaatgagtttaatatacaactgtgagccataagaagggaacaattgagaattgtgttgtttttgttttttgtttttccactgtggttctttaataattggtatagtttagatagtacgtgttttttatttgccaaatatgtaaacgttcttatgagcttctttacagaacgtcttcagtgtgaataagaataaagcagaatataagatgtgtctgtgcattttgcaacgtattgccatttaaagggcatggattttggactcaatcacacttaagtgttataagctctgaatgtattaatgatatgattttggacaagatatttaacctctctgatactattttcattatctctaagctggtgataatatttatgttgcaaatctcttgtgagggcattatggaataaattataaagatatctaaatcagtgtctagaactctttaaatgttatcttcatttccccctctttttcctagtttttcttgttcccttatgttccctaattatcttaatatctaattcttcctgttatataagttctcagaagaattatatattcatataaagtaagtgttcacctgttttcagtaatttcattatctcccatttgagaaattagaattatttcattactgctggtaaatatgaaaagaacaagaagaagagggaaaatattatatattttcctacccaactttttcctaaagcttagcactaaaagctcaatttttatatatacgttcataaattacttgaatcattcaaaagttgtctgggataatgtgtgattcatattttatatctctactctggcactatcagatctgtatatcaggaaatgtactttgaaaactctagatctttataccacaaacacaaggcattactattgataataatataatccagttatgggccacacattgtatgaggcattagaagaagtatgacgtgaatggcatgttgggtcatggtttaagagataagtggtttagagcatggaccttgaagttaggcagatcttgtttcaatcctgactatcactcactgtttgaacttagacatatcatctaaactctccaagcctcagtttcctcatctctaagatgtgactaatacttactaccttacagtatcattgtaggatacgataatgtatgcaaagtgtgatgtatactgactagtacttaatgcaaatttaataaatggtaattattagtactattgctaataagacaagacatctgtccttatggactgtcagtgtagttgagaatagaggatcatacgctatttggtatcatatgaagccagatgtcctatttccaataatagaggttttttaaaaagtactaaatgggtataagaaagattaagtttcattggttgactctccaaatcgatttcagtagcaaccatattccttgcacggactatcaaactgtggtacctgctgcagagggattctactgatattaacttatgttggtgttaaggattagtcaaagttgttgtgaacatgacaaaatactaaaagcacttagcacagttgatgggatacaccagtaattttatagatgttgcccatttgtatattcttgtcaagaaccaattttgtaaggcagagcttacaaaagactgttccttgctgagaaggctgacagattcctggtaattgatgccgatgtgtgttgaaccataattatgaactataattagtactatcctccatagattagaatggtctttatggaaatccttttttcaattaagtactgtttatggcttatgccaatacattcagtattaagtcagaactcttccctgatgaaagcatgatgaatcttgcaatgacctttataaacttaataaaataacattaattttaaaatcttgtatccaactcaattatatactggtgtattgaggatctgttctctataactgaggtgaataatacgagaaaatcaaataatattgaccagttgacatgaaaaaatacttattttggaattggctgtattgatattatattctctgaaatgcgcatatatttcaccatgtctcaaataatagattgtatatagttaagaaacatttgtcattcaagcaaaaaatgagtttcatgtatttgcaatctaatatatataggtatatgtatatatttgtgtttgcactgatcaaacaaggttaaatgtggctttcttgcctatttatataactaattgtgatgtacattaattgaggtaatgatttaataattataaaaattaaataaataagcactacgtatataatgtaataaacagaaatcaaccttatcacttacttttcttttaagtgtattgggctattgttcctcatgttccatgaaacctagtccgcattttataaccctcggagtcactttcaggagaaaaaagaaaagccctcctctcagtgattaatgtggcctgtaataatcaaaactctgtacttattttaaagcagtggtttccttcttcatttccccccacctccccatcagtctggcccagcagcaagctaaaagcccagtcagaaaaggagatattatttgatttcttctttctttccctgccatgtactttgacaccttttgctgtatctttcaaaccaggttttggattccttatgattagagtgtggggagggaaaagaaataaagggggcagcagagtgttaacttaactggcattgtggtaatagtccacagggcgcttcagaggtagcaccgacctcccccatggagaaaccttctgcctgtggtttctttcactggataaaagtacctccatttcagcttactacagtctccgccctcatccccaggcatttagaagctcttttcacatccttctgctgaggcatgtggcccttacagagatttatcttggtcagggtctaagatgcgactaccccagctccttgtcgcacgtggcccacctctgttccattcatgctccaacaaaatttgagaccaactccaatgcaagagcaaactctcctttgctatggaactccccagctagccagtctactcagctatgtatcaggcagcagtctattctttcgttctccacaaaccgaagggtgaaggttttctcttgactcagagtgaaggggaaagtattccccacccctccaaaggggacacgactcgcaggcatatggacagttgactccaaaagctgtttcaacttcttacccctttatgcccttgtgtgtgggtagtcaagagccatggcagatagaaggtgtcttgttcttcaactgaaacttaaattttaaattgcattacataatttttcagtatttctctattatctttacaaaagaacatatacttactgaaaacaaggtatctggcatccctagtgtgcattttggtggccccaaaatttctttgcagtgaacacatttaatagatggagtgattatttaacagggaagcatttatttgaactcttaactgtttaatataaccaactagtttatttcttttacattgtaatgcactaaaagtaactataaactagaaaaccaaatctatatcattgaggaacaattctattctcaacattgaatgccattttaagattaatggttttggcttataataagaactaaatataattttaaaaagctattttcctatttatccatttatgatatcttccaaataaaatgtgattccactaaaattattgatgatattaccataaattcctaatataaaacagacaaaaaatatatgtagcaatctattttctttgactgttgtcataaaaactattggatatgtggcgtgtgtgaatatattatggttatgttcagaacttattatctaactttttctcatgaggaaaaatgattaggaagtatgttagtactaaccattaactagaacagttaatatgttaaatgttcataatattaacaatagcgttttaagcacataccttaaagaacagtttagatattagccaaagaatagtattattattattattggttgagtgttctatatttacattataggatttttattagatagcatgcttataaacattcttcatataaaatatagctaaaagttgagtgattgaagataactttattgttttttagtttataatttactttgctataataatctttcccatatgaatatcatattgattatcagattttccactttgaattttgtatttgttttttcaaattgtcagtgttgttaatattgacaagtagaaataggtaaattgaacaaccaagctacattagtatttcctactaattttttaaattgctagtgattaaattaaatgtcttatataacacaaattctcagaattcccatattaccatcttctaaaataaagttttctgttttttaatttataatattcatcaatagaaactgcatcagaaaatagcccatatattaactcttgcatttaagattttggcagaataaaagataaatagccttttaggaaaaaatgtaccctatttctcccccaatacatcgtagatctagggtaaaactactcttttatagaaaggcaaatcaattgaaatatagaattattctatagatatagtgtagtaaaagattagggcaggttggaggcgggtgtcatgataaaaatgtagaacaagggagtaattttatgatgatgaaatgaaacagcctatatcttggttgtcatagtggttccacaaaatgatacatataataaaattgtaaagaattaatacacacataggcaaataaattccaataaaaactggcaaaatctaaaatactatatgtagattgtaccaatgtcaatttcctagttttgatattgtactagggttacatgttacttatggagtaaactggataaagaggacaggagacttctctgtattatttttgcaacttcttgatctatatttatttcaagttaaacgttgaggaaagataacctcttgaatgttttagagtttcttccatttaaccaaagttgtgaattgtttttcctcaagagacctgtttttcacagtaaggttgcttaaaattagagaatggcctaggaaattaggtatatcattaatatcaaatatacttaagtaaattaaaagagcatttaaaaatcattggactgaaatactttgaatcaaattctgaaagagaaacattaccatatataaattaggcaaagattattatgattatttaacaaataaatttagccatgtaaatgctttgtttttttctcatgaacatcatttatattcatggcattgttagtaaaagctagtacctctgtttttatagattttcatttttttaaaacattaacacaaaaatgatttatacagtgtattaaaagatcagtcctctattgcactgttagcaagggctatctaaagcaaataggaccttgagatctaaatgtattgctgcattcatgtgtagatatctaatgtgtacccaccatgtgctagacactattacagaagctgtggtgtagcatttggggagaaaaagaaaacaaaccccttttcctcaaagacttttctttctgttctggggagatggaaaaacaaatacatgtgtttcaggtaaaaatatttaaaacgagatttggtctataaaaagttgtttaaaagacactggtatttaataaagacgaaggaattacttgggtatgaaatggtaattatatttattaatagagcccacaaatgtagtattagcatcatactcagcatttagagaattctcaggagtggagtcgatgcatatcttttttctcacatgccccacagttcctttaccagaggaaatgttccctatatataatttgaatgcattgtcattactttttttttttaacactgctccccttgaagtgggtcttccagtattggagatcaagttccacagtcacctcagtttataggtgagaaaacctatttgaagttaactcgccccaacccatttaatcagcaaatggcaaagatgaatttcagttctggtcctctgactccaagtccagaacactttcagggtaggaagaattatctcagaatatcttttcaaatagatctagcacaacactctcaacttcattttcccagagtcttatatattgatatgcttttcacagatatttactgagtactctgtatgtacatggtttctaggtgctgggggtgagaagagatatagtgaagaatgagacctaggttctgacgtcagtcctaaactgtgaagtagaaattctgtgtgtgcacaaatgattacagtattaatacaagggagaaagtggatcatgccatgagggaggcatagataaagtgctatggaagaccacagaaagatcaactgcttctatttccagacacccaggaaggtttcccaaaggaagtggcttttgttttaggctttgaattgggaggattgtggcaatggaactgaggctgtacttgggataagtacttttatctctccaatatagtaaattcaccaatatcgtccaaaagtttgttcatttatctaactaattactttttttttttttttttttggagacagagtctcactctgtcacccaggctggagtgcagtggcgccatctgggctcactgcaacctccgcctcccgggttcaagcgattctcctccctcagcctcccaagtagctgggattacagacatgcgctaccacgactggctaatttttgtatttttctgtagagacggggttttgccatgttggccaggctggtctcgagctcctgacctcaggtgatccacccgcctcggccttccaaagtgctgggattacaggcatgagccactgcacccggcctatctaacttcttaacctaaatccctgaaccttccaatttctgtagaaatttacactctgaagcagttaggtggattcctaaatttcctagatagtaatatgtctaaacaaattttcttcggtaatacttgacaatactaccccattatcaaaataacttgaagttagctgccaaaaagtccagatttatgccaggctgtcaccatgatgattttaaatttctgcattagtagatattaaacatttccaaaagtgcttaaatttccatccactaatttttttgtcataaaatagagattgcagatgtattttgtactttgaagaatattaagggctgaataaggtggaagcacttacaactaatgagcctgcacatcttgagtgagctacctagagaatgtttctccttagcaataaagaacgacaactgctttgttctagctcagtaataacaataatatcgtagtatgtcctttgggaaactaactgaaatataagttcagataagttcacatccttgtaaagcaatgatattttgctatgttgctttcctacttaaagctgccatggataatgcacaattaagtcaacacatctaggcttaccaaaaataaattcctagattgtatttggtcttatccatacaaatgcttttggtttatgggcctgacaatggaggagattggaggtcagaataatctcataacagttactggttgaaggcctcttgttaacccatcattattgctttgttcctatgacctggcatcagacttacccttctaatcagcagtgcagacctcccccaccacccctcctcccattttaactagaactctgcagggaacctcacacttgcttgactgagccataactcattgtttaggtctggccagttttttctcttgggggcagtaagttcctatatcttaactgccaactcctgtaaagggtaattctccatgatgctgcatggtattacactatactatataatataatactatactattatattaatataatgggaagcaataatattgcatcctgccttaccttctatctagtgtatattttcctaatcataggagctggcttttggatagcgatgccagtcctgctcaaacccaacttcatctttttcttttagatacgattttaggattcttagaggttagagccacatactttccttattctgtgtcccttcagtcttgttggccctttaggttacatctataaagcctaaatatatgcgttttaagttttaattattcactgtgagtttttgtttaactgaattatttaatttacttatatacaagttgaacaaaaaattaagtagaatctgaaagttatcattcttgctttctacttagaaatatagaaatcatttccaaagaaacaactgctttattgtaaccaaggcttgatttagaaaaaaacaatccatgatttttaaatgtctgatgtctgtttggagaattatctcaggctctctggggggaaaaaagaattagtgtatttgattcatactgcccatctctaaacccaattgacagccccactttaatgaaaatgcagcctgactttcctgagtgaatcactatctgattatacaaatggcccacaaatttctctgcattctctatgcctatacttccttcattcttggcagtaaattttagaaaggttgctgattttttatatacatcctatattatagggcatgtgagtgacattctaattttttaaagtaggcaatttagactgttatttaaattataagtttactgggtatcagcattatattttcttagttctttaaggaggtatttcagtgagaattttttttttttttttttgagatggagttttgctcatgttgcctaggctggagtgcagtggtgcaatctcgcctcaccgcaacctccgcctccctggttcaagcgattctcctgcctcagcctcccgagtagctgggaatacaggcatgcaccaccacaccaagctaatttttgtatttttagtagagacagggtttctctgtgttggttaggctggtcttgaactcctgacctcaggtgatccaccggtctcggcctcccaaagtgctgagattacaggcgtgagccaccgtgcccggcctcttctacccattttattttggccatcattgtacaatattttgatccttgagttggataaaaatagaagacatgcttttcaaatatatggattatgcaaattaaagtaacagaatagagatttatgaaccactctcaggctagaaggaagtgacaatttaataagagaacatttaataaggatacacacagaatcctgttcttggtcacagtagtgcactgcagaaataaagaacaaggaagatgccgctagatttggcaaaaaagattttaggttttttttttctttttttctttttctttttttgagatggagtcttactctgtcacccagactggaatgcagtggcatgatctcggctcactgcagtcaccgcctcccaggttcaagcaattctctgcctcaggctcccgagtagctgggattacaggtgtccgccacgacacccacctaatgtttgtatttttagtagacacggagtttcaccatgttggccaggctggtctcgaactcctgacctcatgatccacccacctctgcctcccaaagtgctgggattacagatgtaagccactgcgcccagccagattttagagttttcatgcattggtaagctcagcataagttgacagtttgatgtgactattaagcaggcaatggcaattgttggccactttaatataaatatattccctgggtcagtatttctcagagtggcttattgcatcaaaattacctggagaaattgtaaagtatagaatgcaagacccaacaagttatccactgaaacgaaatctcttggtgtgggatctgtatttttaaaaaaactttcaggcagtttttatgcaaattaaactttaataaccattaaaatggactaagggcaattttgatgctattctgttttatcctgttttatcactgcaggatagttgcgttttactctcttgcttatactttaagaagggtgtgaaattttggctgcattcgggaaaaaagcaactttacaaaaatggggaactaattcatgtccatgagtaatgcatggagaaaatggaacttttacatatttaggatataattgaacaattaaataaattatggtggttaatttgactgttattcatgaatatctgataaatatccactaccataaagagattgttgtgaatatcagatagtaacatgagaaaatgtttgtataaataacgttacacaaatattttgattacaagtgtctaaaaagaagatgcacattaaataacaccagaaaaaatacacccaaatgataagtggttttctttgaatgatactataatcacttttttttttgcaaaatagtctctgtttatgaatatgctcttatatacttaaattaattttcaaagttaataaaaactatgatattgttaattacctcaaataataaagtatactgtagatgagcagttcccagtctttttggcaccggggactggtttcatggaagacagtttttgcgcagattagggggcggtgcagctgatttcggggtgaaactgttccacctcagatcatcaggcattactaagattctcataaggagcacataacctagatccctcgcatgcgcagttcacaataggtttgctctcctatgagaatctaatgctgctgctgatgtgacaggaggcggagctcaggtggtaattcttgctagcctcctgctgtgcggcctggttactaacaggccacggactggccctggtctgcggccttggggttggggacctctgttctagatgataaaacattatttttttctaatacaggcaaatataaagaataatggtatgaaacgaatggaagtaaattctgactggatttaggaaaaaattttttctgggtctcaataggatgtgataaaattcacttatttaatcatatgtaccaagttctactttttaaattttgttgaagcaaatgcaatttatactttttttacaccatattcattaagtacctactgtttgttcaggatatacccatggctgttttgctatactgatggaagtttataaggctatgtattaaataaataatgttctggtttttaagttgtgtatttagaacataggcctgaaagcaaatgcttgtgtaaaaagaaaaaaaaaatccaacagtcaaaaagtcaggtctatgttataagaaatacagcattcctggaaaattgcagtgctttacattgcccagatgttatcatcgctgttgggttccttggcagagtcattcagaggctctgcatagctaatactatcatggttctctgtggcacagcccccccttgattgcatttagtatcttcttcctccagcttggggcttagcagtttctactcaaaaaagtgacacagcaataaaatttgaaaccatagaatgatcactcatcctagtgatgtgttatttggcatctttgaatatatgactattgcaaatagttcatttcaaattttagcagattgttttttctcaattcaaaatcacattgaaagggggagagaaaactgccacagtggaacgtttgcaggtactccattttttcccaataaaataatgttttatcataaattcagcatgtgttaagattgacatatttatagcatatctgggcaggatatagcaactagagctgtaatgattgctttctctactataaaaactatgacgctcatattaatacttaagacatatttatattattaagctcacattaatattaccataaaatatgacagtttacaggccatgtattactacacgggatttttcttttcttttttttcttaacttttattttaagttcaggggtatatgtacaggtttgttacatgggtaaacttgtgtcatgggggtgtgttgtacagattatttcattacccaggtattaagcccagtacccagtagttatttttcctgatcctctctctcctgccaccctccaccctctgataggctccagtgtgtgttgttcccctccatgtgttacatgggaatttttcattcactcttttactcacttcatgatttttggtatttgattaggagcaagaaaaacaaggaaaaatagatacagtgtctctttccatctgacattttccaatgcctagagtctataattctatctttcatcctattagatatcataatccagaatattatttaccaattttatgtcttattaactacaagtatatttagccaaatatttgcatagttatttcaagtacatttatatttattattttatatttttcattgcctattttgaaattatattttttaaatttctaaaataaaattaattttgataactgtaatttttacattggtaacttttgtgcattttgtcagtttttatagtcattgtaacacatttaaaaaaaaatatgacgttgtctctgttttttaactaaaggcaatttacattaccattaacaaggatttgtatatttttaagtcataatataaagagtcccttccagagagtcctccattccagtaacatacttaggaaataaataatgcatatgcaaaagacatagaaccattgtcaagatagcactttccgttttctttctttattgggcagacctatacacagttcaatttgcattaaactattttgactttagtataatcattattgatttttttttttttttgagatggagtttcactcttgttgcctgggctagagtgcaatggcacgctctcggctcgcggcaacctccgcctcgcaggttcaagcgattctcctgcctcagcctcccgagtagctgggattaacaggcatgcgccaccacgcctggctaatttttttgtatttttagtagagacgggatttctccatgttggtcaggctggttgcgaactcctgacctcaggtgatccaccagcctcggcctcccaaagtgctgggattacaggcgtgagccaccaagcccgacctattgatttctttttaatgaagtttctaggtttaaatatgattaagtttccctaccactgtaaaagaaaagttttgcatcagacacttgatacaattggcaagacatatgcaaactatgcaaccgacaaaggtctaatatccagcatctatagggaactaaaacaagtttacaagaattgaacaatcctataaaaaagtgggcaaaggacatgaacagaaacttttcaatagaagacagacatacagccaacaatcatgaaaaaaagctcaacatcactgatcattaggggaatgcaaatcaaaatcacaatgagataccatctcacatcagtcagaatggctattatcaaaaatttaaaaataacagattctggcaaggttatggaggaaagggaatgcttatccactgctactgggaatgtaaattacttaagccattctggaaagtagtttggctgtttctcaaagaactcaaagcagaattatcatttacctagcagtcccattactgagtatatacccagaggaatataaatcattctatcataaagaaacacacatgcgtatgttcaccacagcattattcataatagcaaagtcatggaatcaacctacatgcccatcaatggtagactggataaagaaactgtggtacatatacaccatggaatattatgctgccataaaaaagaatgaaatcatgtcctttccagcaacatggatggagctggaggccattatcctaagtgaactaacacaggaacagaaaaccaaatactatgtgttctgacctataagtgggaaccaaacattcagtacatgtggaaagaaagaaggggacaacggatgccaaggcctacttgaaggtggagggtgggagtaggatgaaggttgaaaaactaccttattgggtattgtgcctatctgggtggtgaaataatctgtacatcaaacccccatgacatgcaatttacctatataacaaacctgcacatccacccctgaagctagaataaaagataaaacaaaaaattgtcaagacagactactacaacaggggagaaagattttagtacagaactgagatctgtactaggtgagaggatttttaaatgctgaagtatagtaacagaaaagtaccgaatggcactggggaaggagggaaatttgtccaatgtgattggaccatctatatgtggtcattgccccatttcaaagttaggctactaccatctcacagagactggaagatagggcccctatctttatttgtttttattgatacacaatagttgtacacatatgtggggtacatgtgatattttgatacatgtttacaatgtgtaataaccaaatcagggcagttgggataaccatcacctcaaatgtttatcttttttttgtgttgtgaacacttcaattctttcaagctgttttgaaatatacaaaaaaattatttttggcagggcccagtgcctcatgcctgaggccaaggctggtggatcacctgatgttgggagttcgagaccagcctgaccaacatggagaaaccccgtctctactaaaaatacaaattagttgggcgtagtggcgcatgcctgtaataccagctactcaggaggctgaggcaggagaatcgcttgaacccgggaggcagaggttgcagtgagctgagatcgtaccattgcactccggcctgggcaacaagagcaaaactccgtctcaaaatatatatatatatatatatatatatatatatatatatagttaactatagtcagtccactgtactgtcaaacactggaatttattttttaactgtatttttgtacccattagtcaacttcatttcctccccctctctctaccaccctcccaagtctctggcagcaaacattctactctacctccatgagatccaaatttaagctcccacatatgagtaagaacatgtgaaattgtttgtcattttgcatcttcctgtttcatttaacataatgacctccaaatatccatgttgatgcaaatgacaatattttatgacttttatgactgaatagcattccattgtgtatatacaccacattttcttcacccattcacacatcatttagtcaactgcccgttgatagacacttaggtagattccatatcttggctattgggaatagtgctgcaagaaacaggagtgagaatatctcttcaatatactaatcgcctttcttttggatacattctcagcagtggaattgctggatcatatggtagttctatttttagtttttctgaataaatttcttacagttctccacagtggctgtactactttacattcccaccaacagtgtacaagagttcccctttccgcacatccttgccaccatccactgtttttgtctttttgatgatagccattttaactgggctgagatgacatctcatgtgcttttgatttgcatttccctgataattagtgatgctgagcattttttccatatacctgttggccatttgtatgtcttcttttaagaaatgtctattcatctattcaggtcttttgcttatttttaataggattatgtgttcctatacgctctttgtcaagtgatgttatgtattcatttaatactcaactataatgattaataatagttgtagtaattatatttttcctataagtaaaataaaattagacggatatattgtattcctatacataatcctgttatgagttccctatacattgtgcttattaatccctttgtcttttgcaaatatttactcccattttgcagcctttctcttcactttgttgattgtttccttcttgatgattacacttcaaagggatggttcctaggcccttgagaaattcattcttgggttgtagaagattcatctcaaacagtcagaggatttataattgcaaggttcctaaactaaatgctctaagaaacggaggtttgggttggaacaaagattaaaattttttggtagcattgaactttttcaggaagaaatttaagggaactggtgtcagcatcctagggacttggccctgagttgttagaaactatgctattatttgttcaagtctcttattatggggggtagacaaaattgtttgtactgaaaattgcagttcccatagaccaaggttgaggcctagccgaggagagagttcagaggagactgacaaaagttggtcaaggaaagagtctttttcactgacccttcaccttaggaaaattgcctgcaagtaatggcttatattagtgaatgtaaattttgtaaatattttacttttctatacttatagttgcaattcaaacattcgaattaaagaaacaagttgtgaatttaggccataatatttgattttatacattctgtgagattctcccaaaacgcatgccatcccagtgtaagcctggtcatatatatattgatgttatatagcatgttatcagctacattttgcataatcagtgtggtagattctggattcagagttcatgacctcaaaaattgactccacctcttatcaactgtataacattatcaaattgattaaactgtccaagcttcagtttcctcatctgcaaaatgggcattatagtaataggtattgcataaagtaactgtgaggattaaatgatccaagtgctttgcagaattcctggccagcagtaatgactcaatagatattagtttctttttattttattttattttttttattattattattttttttgagatggagtctcactctgtcgcccaggctggagtgcagtggtgtgacgtcggctcactgcaacctctgccacccgggttcaagcgattctcctgcctcagcctcctgagtagctgggactacaggagcatgccacaacacccagctaatttttttttttgtatttttagtagagacagagtttcaccatcttggccaggctggtcttgaattcctgacctcgtgatctacccacctcagcctcccaaaatgcatgctgggattataggcgtgagccactgcgcctggccgatattagtttctataatttgtattagatattattagtactgaataagtactagtggagaaagtaattacctgatctatatcattaacttatttgaaaactcttgaaaataagagatttcagtttttatttgaattttcttctgtcatttgctctgtatacttgctgttcttagcccattttcctttatttattttgtgtatgtataggataattaatttaaaatgtgtcatatttaaaagaaaataattttatcagttaaatgttaattctgttttttttcaagaacaaagacatcttttcttctgattcataactcgcctgagagggagtagacctttgagtatgtataacctatatatagtctggcttatttattaatagaggtttattttaaattataattgaacacagagtttaggaagacaattacatttgagattgctaatcttggggtcagagaaacttgattgcatacaattccaaactctttgtcaagtgatgttacgtattcatttaatactcaactataatgattaataatagttgtagtaattatacttttcctataagtaaaataaaattagacggatgtttacatggattatctcattgcatttttacataaattacataaaacacattttccccctgaaggaaacagtaatatatacatatgtatacaagtatttgtaccattttaataccaaatagatctagtttttaaaagatatatgtactgaaaagataaaaaaatgtaaaaattggaagggataattattgaaaaataaggtgaagatagtggtaagttaatacacaaaatacatgccatacagttctggaaactttgctgtagttggcctataagtgtttaacctaatagtcacatacattttattgatggatcagagactattttatttaaaacgctttcccaaattcagatgtcatgaattcacatgccttccagtcctcaccccaagggctagaaatgtgcttttatgaagtctttcttgcctttttttgtggagtgggggcaggggggaggattgaaagagggaatggtactgcacggctaaatttcaaaattttgttctgtaagtggaattttaatgtattcttcattttctaaaatccaagaaacaagagaggccataaactatttcctcaaataaacttagaaacacagagacagttttgaagtcatcaaagataaagtaaaataacataaatgattgaggttgaattatctgcgaaaagaacaaacatactttacattttgccatatcctgggtcatgaagtcaaaatgaaatagtcattcaagatctaaactctttgaaaactctgtcagccaaaatttcgaattttgaccatgtttgctaagcatattgccttctaactcaaaaagcagaaagagcaatgcttatttttaattttcttgcactatgtagtatttcattacatttggccagtgttgtgttgagaatgctcctgaacagttcaatggataactatatcaccttaatttctttcttacgagttttagtgtggtttctcaagagaaccattatacccatgctgacctagcatgggatatactagaggagtatgtgtgcttggttatctgagacagtattcttttatcatatttgcctgtatttcactgctttgacttcattatagatatcttatatagactgaaaaatcatggacttatgaaggcaacaattcataccaaaaataaagagtgaactactaaattatgttacaaatgaaggaagacgttaatatcaaagcaaaacttcctgtcaacacgtgagcagtataattctaataagcagttaaaatagcttaagaacgtaaaacttgggttttataaatacatatatatttgtaaatattgatctggatagttattttaagctgctttgaaatcacatttgttccctttggaaatatgcaagagagacaattacttgcctctcagtggactattaaggtttgcctttgcttatacctggtacaaaataactatatatctgatgtaagcaacagagatatgttatgcaagagtagatacggtatgagcagaatcatgcaaataagattcatattagaaatcttgtgtcccaactctggtttgtcagtggtgaaaacagagttaacaggtaatgcataggttcccaaattcctgatgaagtaacatctctctaaactacagatcaaacctccaacagactcagtcaacaaaagccataagtctaaaaacccaaaatgaatttggcaatgagaaatagagcagcgagaaacagtactgggcctaaagagccagaatccattgacttagaatcatttttagttggttggatttaaaagtcttaggtaggggccgggcacggtggctcacgcctgtaatcccagcactttgggaggccgaggtgggcggatcacgaggtcaggagatcgagaccatcctggctaacacggtgaaactccatctctactaaaactacaaaaaattagccgggcgtggtggtgggcgcctgtagtcccagctactctggaggctgagccaggagaatggcgtgaacccaggaggtggagattgcagtgatccgagatcccaccactgcactccagcctgggtgacagagcaagattccaaaaataataataataataataataataataaataaataaataaataaaagtcttagctaatctttcttcattagtacttctcagagtataggaagaatacattaaaaactccaagcaaggggtgggaggtctaagatggagagtaaagtgttggcagtagacatcacacagtatacagccaagcatttttggccaacttcctgctttaggataaagaaggcatcatttttcccatttgacaattgagaatgttgagacccagaaatgatagataacttacaaaggttatacagcaagaaagaaatgaaaatagtagtagagcctgattctcttaccttctatttagcactctttcccagatgccatgttgatagcactgcctaaaatgtgtctagtttcgtacttttgtcattgttttgatataaggtgcagtgggtcaagagaaccatgatattcaattcgtgacatttaatctatttttattttgtttctatgtgtgactgcatgtgtatgttcttttttctgcatactgcatttcatttccactctcctccccagtacaaacattgtgttttaagtataaatttttttatttgaatggtgtcctttcaaagtatgaattgctttctgtttgtgaattataatttatgtaaaatacattctgttagatatttcatttttcatcttgttttctcactaaggtttattatttgttaggatccttccacattgctatacacctactctatgacttctcacttcatggtgtgtatatattgaatctccatgaaaattgggaatagcgaattccaagctatttatttccttgccaggcagccccttggctaggtgcgcttatacaggcacaagctatgcatctgtacatatctgcaatgaagcccatggttgtgtatccagcaaattttgcctctttggccttgatggaaactcaggttacttctagctctcaccattaccaatagcactgtaatgaatagccttgtatatgtgtcttatgcacctgcgtgaaaattttcctgggataaatgccaattgtagaattgctatgtcaaagggtatgtatatacttaatttgactaagtagtaacagatggataggcagattgctgctgctgtctaccctaccaccagtagagcaccaaggctcctatgtcaccatatacatgtggttggttccttttgtatttcatatattcttgccttgtttctctagctgcagtgaaggaagggaccattttaaatggctcagattataaatcctaggaattattaaactaccagtgaatatacttggcaggtgaaagtcaaccaactttcaaagtggttcaaattaatcatgtgttttgtgaggtataactgttgtttaatttgtgtttttagagctaaacaatgttctcaatcagacccaacttagagttgttttgcttttatctctgatttgtttctttctttcacccaattaaatatgatttaattttacccattatttgctttttaaactaagacagaatgaaaatgtcaaaaataatatgacgcttctaaacctgtcaagtatgaatgtcatggatcacgaggatttactgttatattttgggaagttggcataatataaatcgtgacgctcttctgatagaatgtgtcatcactttaaacccagatgtctgaattttacagcaaaggactctgaataaggaaattcttcccattgatctgataatgttcaaatatatcttaaggaagggatagtcaaatgtgcatcatttaaatgtgatcttagatattttaatctattcatttaatttattctttactcatttgcttctctaataaaatgaatgacaataatctaacttcagccagcttcagaaatgtattcagtcatattatcatgaaatatgtaattctcatgagtgacactgcctggcccactcactgtgtcattgggattgccctttctctaagctcgcatgataaaatgtcattccaggtgcaacttaagagtcacgctccccttgtcctttacaataatgctaggtaaatagcaggaactcagtaaatatgcaccaactaactgataggtaacttttaaaatatgaaatcttctattctttgactctgtagagaaagtgtttttcttcagctctatatgaataccagatatttactgaatgttttgccacgtctcagtcttgcatttgcacgtccgcacactacttttatgccatctgttgtctttcgtcattcaactgcttatataggtgaagaataaaaacggagagtgacagattagctgtattctatcttctaacagtttattataacagtttagttagctttcatcccttcttaaacacacacacacagagtgagagagagagagggaaagagaaagggagagagagagagagagagagaaccgaaacaaagtattctctcactttcttctcttttaaatataattaattttagtaaccattgtgggatagaggtggggccggtctgagatgaaaacaaaaattgagcaaaacagccataaattgtttgtatagagtgagcatctcattcccaattatttgttcaatgctattgacataaagtttcctgtgttctaaagaattaatggcatcacatcctcttgactgtgctgttgcttacttggccatgggtgtcctgaagtaggtgaccataaaatgtattattgaaattggggcaggcttttagctttgttaataattctgttgacaacaggggtgaaacaagacatatgcttatcctgccctcaggaagcatcagaatgagtagcttttaaattcgctgccaccatgatgacttgaaggatcagaaagcctcttatacttgacgcagaaacattgtagaacacctgtaaagtggccaaggtagtggaaaaaacattcaattgggagtagttaaacctgtatgatactgaaccaaggagcaaaatgatgagtctaaggcaaggagaagtcagacgtagaattcctaatccgtacgagactgtacctcgtcaagcaaaacttgggagttttaaaatgaaattttggaagaaatgaattattacaatagcaataaccatttttgttaccatcctggttttcctgatctctacatattggcatgccctggattcagtccttggtgtcttggatcttccctttctatacttacagtcttatagtctcagaaaatcaccttatatatcaatgccctcaaatttacatctgtggctcaaagccttctactcatatccaaacttggatatacaacttgctactcaacatctctaacagtaagtcagtggacatcttcacatgtcctaacctgaactcctgtccccccgcaaagcctgtgactttcaatttttaattgataacaacttcatctgtgtttgctcaggctaaatggtttggtgttgccccgacttctctcctcatttcacatcccatccctaataaatcagctttaacactaaaatacagctgaccctcgaataacatggaggttcaggggtctggcagctccccacgaccatgcagttgaaaattcatgtaaaacttaggagtccccccaatttttttttcaaaatggagtctcaccctgtcacccaagctggagtgcagtggcacgatctcagctcactgcaacctctgcctcccaggttcaagcaattctcgtgcctcagcctcctgagtagccagaattacaggcgcccaccaccatgcccagctaatttttgtattttaagtagagacggggtttctgcatgttggcaaggctggtctcaaactcctgacctcaggtgatccacccacctcggcctcccaaagtgctgggattacaggcgtgagccaccacgcccagcctgagtcccccagaatttaactactaatagcctactcttgaccagaagccttactgataacataaacagtctattaacacatattttgtgtattatatgtatcgcatactgtattcttgcaataaagtatgttagagaaaaaaatgttaagaaaatcataaggaagtacaaatatatttactgttcattaactgaaagaggatcatgatataagtcttcattatcttcattgtcatcttcaagttgagtaggctgaggagaaggaacaggaggagttggccttactgtttcacagatggcagaggcagaagaaaattcatgtgtaaatggacccgtgcagttcaaacctgtgttgtccgagagtcaactgtatattcagaattagacaacttttttttttctttttttgacatggagttttgctgttgtcttccaggctggagtgcgatggcacaatctcggctcaccgcaacctctgcctcccaggttcaaatgattctcctgcctcagcctcccgagtagctgggattacaggcatccaccaccacgcctggctaattttgtatttttagtagagacggagtttctccatgttggtcaggctagtctcaaacttccgacctcaggtgatctgcccgcctcagcctcccaaagtgctgggattacaggcgtgagccaccgcgcctggccagaattagacaacttctaatctctattcccgatcttcatcactgttatgatctcttgtctcaattactgctagagtttctcaagtggtctgaaaatcagcactttctacccatgcctcaaactgcctagtctttgtatagtaaccggaatgttcctctttaagcaaagagcagaatgtgtaattgctctgtgcccactcttgcaattgcttccattgcattccaaagaaaagctagagtttttacaagagctagtaaggctttttataatgtggcctcctgtgtcctctctaaccttattcattattctcatctgcagtcaattcacttgagccacagatgcttcccacatacatgtctgtgcatgccttggggcatggacactgcttgttctttctcctttcttctggaggctgtccttccagatatgccagaattaactttttcatcttagtctttacttcgatatattcttctcaatgaggccaatttaaaattcaagcgtaacttcccccacctccagcacctacctatttcccctacaattttctttgatccataacatttatcatcctcaaatatactctgtacttgatttatttttaatgtttatattacgttcctccaacaggaatagaagctccataagggcagagatctttgtcaattttgctcatagataattcccaagtacctaggacagtatctactagatgcttataaatatttgcagaatgaatagataaagtaagaagcccagtgatgtcaagaaaatgaattaccctctgtgcacctcaagttgtgcaaactaaaaagattaaataaaatggtttctatatgtcaaccaagcgcacatgtgtacattttgtgtcttgtggggatcctgattcagaaatcaaatgcaaaaaaaaagaaaaaagagagtgagatactaagaggtatttgaccatggcttgttattccattattttaaaaaattattcttatgtcaatacatgtgataatcataagccctttggttaagggcttatgtgtttgggatgcaaaatgaagtatttagaaataaactgatatgaaattgaggatgtggttttaaatattccaggaaaaaaaataagtgaaaggaataaatcaaacaaaattggcaaatactgctaattgttgatgaggggtgataggtgcataggagtatattgtagtgttctcattacttttgtgcatgtttgaaatatcccataataaaagaattaaaattggtaacctctgaagtccctcactactcaaaaaatcttttattagagccatcattttataagtagatcatttgtatcagatattaagaggatcattgggatccccgagataattccacagtataacgaaaacataaaggaagataaagagagaaaatccaatagaatgtcatttataaactaaaccttcaactgtaaatgatagttgttctaaactgtggctctgtctaaagaattttacccaaatttccattcattgtgaataactaatgcaagtaaatgggtaaattatgtctgtatatttaatcattgtacaaattatatcccataattccattagcagaatggagtacaaacttttttctaaataagtccttactaaatagatttaacagcaataactatgcaatttgactaagcaacaaactgccatttaaactatatattactatataatataatatgtcattaaaatataaatactaaaggctgtcaagatttttttttaaaggattgggccaggtgcggtggctcatgcctgtaatcccagcacttcgggaggccgaggtgggtggatcacctgaggtcaggagtttgagaccagcctggccaacatggcgaaaccccgtctctactaaaaatacaaaaaaaattagctgggtgtggtggtgtaatcccagctacttgggaggctgaggcaggagaattgcttgaacctgggaggcggaggttgcagtgagccgagatggcaccgttgcattccagcctgggccacagagcaagactctgtctcaaaaaaaaaaaaaaagattgtttatcttctatgtgtatgcatattcatagattggtatagatataaattgtgtaatgtggatatacaagtaatgagacactgttacatgaataagttctgaatcgtgagtcattttgatgataaaacatagaggagaaacagatgagatcatggatataacttgtttgaaaatggtctcatcccataaagtatagagaggcagaacattataaataggacagttaggtgaagaaaaaaatatatatgggatttgacacaagggcaaaatattcttattaattgttgaaaatctaggaaaaataataatgaaaaactttaataattgagtaatttaaccatgatttcttgaggctatgtctttttttatgacaaaacatgctgatatagaggatcaaaattagatcatagaaatcatagagacagcaaacagcatttttgttttctttgctgtcattttgttatcttggcttcagacttttttatcattgttttgtttattacttatatgttataaactgtctcccctggcccccaatctcctgaaagttttagaagcttgatctggtccattctctgcttgaaccacagtaacaagtatctcctggcccctccttccatccgcaaagttggattaaatcctacattctcaattgaactcaaatgaaaatgatcacttcttccttaaacattaactctctcaacaaatagcttcagatttatggtcttaatgagcctttcaagcatgttttgttagtcaacgaaattggactttaggcttatttgtttctttgtttttttgttgttattgttgttgttgttttgttttttgttttttgtttttgttgagacagggtctcactctgtctcccaggctggagtgcagtggtgcgatcacaattcgctgtagcctcaacctaccaggctcaagtgatcctcccacctcagcctccttagtagctgggactacaggcacgtgccaccacgcctggctaatttttttaatttttgttttgtagacatggagttttgccatgttgcctaggctggtctcaaattcctggactcgagcgatccatttgccttggcctccaaaagtgctggaattacaggcatgagacactctgcctggcctgtttcttgtattttctacagcagtgattttcaaacttttttgatgtattgacacatatacaatactgtaacactcgtgacacctcctggagttttgcagcactttgcctacaaacacctgcaactcaaacaaaagttcgctgagctaacacttattttcactatattctcaggtaagaatccaaccttatggagggtggcaaaggttaagatttcaaaggagatggctaagcaagcaaaatgttggcctgtcacaactccataggtgctcaaagtagacaatgagattcaatgggttagagcatgagtctttaatattcacaatatagcaaatagcaggaacagtagcatggtagtaccagttcctctgcctcaagtattacgaggtgacacaagaggccaaaacggtgactatgcacacagtgggttgtgctgcagctggggaatacagggccaaggtctcaccatgtagtaaacaactaacaagacagtctcctttccctggagagaaaagccttatggtagtcatgctgtggtcacttttacctaattaattgcctacgtgactagctacagaaactgctcagtaccatggtatcaagggatgataaagccttagaatttgtcacacttaaaaaggacaggcagggttgtttatcgcccatgatggactgcccttttcaacaaacctgtgatacatgattgaattgtttattttactccactttgataaaatgctagtctagaccaaatcaattgacttcatgacccaataatagatacaactcacagtttgaaaatcactgccttagattcctagtaaatgccttgcagattctaattcaaaaagccattgttaaacaccaaatatttgccaggtagtgtgttccatgctcagaagacaatgttatagctgttacagcagaagaatcatggtctttgtaacaactgtagtttaacttcccattttgctatttatttagtcattgtttagtattttggtctttattatcttattttgttcttgcgaagttaaaacatgataatcttggtgaggcaccttgtgcattgccaggtagctgccaggtatttatcttaaataatctgccttccatggatttctttgcagtgaaatattacacataagttaaagaaaaaatattgaagtggcactttaagaaactgcatgaaaattgaaattactgattgaactcttgaacttagaaaacacaaatcatctatattaaaatttatacattttttctctctctctctctctctctcacacacacacacacacacacacacacacacacacacacacttacttgtattatacaaaagccagttaatgagatgtaaaataaacttgaagcccgatgtggcaaagaccaaaggaaacagaagaaagaaaaatctgagattaaaaaaataaatttgtttttccttatatcctataggtagctttgaaactttgtgtaattgatattacttactattcattaattttctggttataattctttaaagacaaagtcaatcaaaatgttatgtttgctgttttttgtacagaaaaaaatctcatttgtttcctctaccaataaaatgccatgacaatgtagaataaatatataatttacttcatagtgcaggattatgctgaagtatacatgaaactattgtccaatgaaactgctttggtatgataagtttttatataaatatcaacctggacacatccggtataatttttattttgtaatgtttggcttaaccagtgcactctctttgttaccatttacaaatgaccatgctagctatttcttcagtctatggagaaacatggaagcctaaaatatttttttaaatagctatttcctcatatctcctaggtaagacatatccaaagcacgacaaaagaaagctaccctgtctttatattaaatcttgttgaggaatatttatagcatcccagagttataactattttagggtgacaatgcaactgatgttgagcaattatgttctgctgctatatcctatgtctatggtcttaattattaaaaaccaagaaatataaacctaaaattgttgactgctacctaaagataaagatcattattaaaatactgatgacaagaagtttcattattaaaacaataatgtacaactatggattcactttaaaaacttggtttattcatctgtattcaagaaacagagttaatatcaaagaaggcaaagaatattgaagcatattaaggaatgctgtgatttagcatttgtagtcatgttaatggcatcagactataaaattataatattccctcaatttagccacgtaaaaataaatcacttaatgacaaaagtacatattttagcaatctgggatttcatgtggaagaaatattgatttgccactgcatctgcatgtcaactcacatacttgagtaaaaactagtatttctgagaagacacgaaatcactttgaacctattaaaatggacaaaagtgacaatcagttgatgatatgaaatgcggtcttttgagccaaactttgacaatttataattttctgttgtgtgataaattttaaatggaaacagttgcataactcactagagtcagaacatacattataaataatttagtccataccctttgattaatcgataattgggaaataagtgaaatgtcagaagtctgccaagtagttattgggtgagccaagactcaaatctagataaagtatttattctactatacaaattaatgtcattaaaattattgctttatttatgtattcacgtgaatattctctaagtgtttttaaacacttacaatgtaccaggccctgtgctaggacctggggataaaaatggaaaagatatgggtctgtcatctagagatactgtggtttagcaagggagtgagctactaatatgaagaaggagaaggagaaggataaattattatagtacagtatgataattgtgctaaaagtcatcacagagttctaggattgtgcccagtaccctttgactagtagagaggggagaggtctcacttgaattacatcccttcttatctggactgttgcatcttgaaagatctcgccacttccagtttgaccttcctccaaatatttcctccaaattgctgctggggtggtctttctaaaatctgaaatttaatcagagcactcacctgtataagaaccatcagagtttctccatttcttcaaaatgaagttcaaattcattatcttatcatgagacctttcatgatctggctttagtcaatcactccagccttacttcctgctactctttcagaaacattctccaattcaaaagcatagatctacttatagtcacctctaggtctgggtcaaagagcttgagagcattgtagctcgaaggccaccattaactcaatgaaatcagcagtaatctttaaagaaaaaaaaaaaagaaaaattggcaataggagtcctgtgggagaagttaaagtttgtaatagtgactaagatgatagggagagaggaattctgggccgttaataaatcaatgataaggtacagttagggctaagcgtgcttttgtttccctaataatttatgtgtaatttaacaactaaattaattgaaaaccatgtttgaatctcaccttaccaactgcccacctggttgaaaattaaatactattgaatcttaaagacaggtattttttagaccaatttatatattttgctgttcatgttatagatttcaatttgacataataattcaccacaattaaaaatgttcttgaagtaaaagatatttacatgtctaacatatctaaatagcttgaaaaattacatgaaacattagtacatttttggagactcttatcttgcccttattttccaaaggataagttcttgaaattgagtaaacgacagaaatagcatagctagattataattttgaataatgctgaatactttctgatctggaacctgtaaaacgtggctgtagtgagggagctactcttggttgcacaagggaattgggaactgattgtggttacgtgaaaatcgtaaatgtcggatctcagtttaattgtggtagaaatatgtggtagatgattctgagtattaaacagctgtgtaaatattggaagagcagaaaatctaacataatacaacaaatacatagatcttctgatgttcttctttttaaaaagctgtaaattaaaatcctgtgtaggaaaaataaaggtaagatgcagtgtacaaatcagggtttctcaactctggctacacattgcagtcactcagggagatttcaaaataaactcatatctgggtcccactgctagacattctgcatcagttggtctgaggtaatggctaggcattagtattgcttttcttttccttttttctttttaagatgtagtctcactttgtcacccaggctagagtgcagtggtgcaatcttggctccctggctcaatgcaacctccacctaccgggttcaagcgattctactgcctcggcctcctgagtagctgggactacaggcacccgccaccacgcccagctaatatttgtatttttagtagagatggggccaccacacccggccttagtgtatatctgtttctgctgtgcaacctgagttgagaactactggttaacatagatgaaaataaggttcatatatttcagttataaaaaataaggcagaaaacttatccaatgttattagaatttttccttgcatagctatcatgcaatgatgtagttaacaaaaattaaattgcttacctgcaattttatgatgaaactgaccaaacacaccttccaaagatcaatggaatgaaggcaaaatcagatagaagtgtatttcactgtcttttgtgatttcacctctacctgactaaaactactaatgctcaggagaacgaatcaactgacagtgcatttttatataccccgtgaaggtctcataaataagacatggctgaaattaggtaggaggaacatttatcttgaaaatccaaaattcctaaagcaagggatcatatactgcatatgttaccgtcattatgccaaaggagcaatgtatacacacacatacacacacacacacacacacacacacacacacacacacacacacacacacacatatgacagacttctccagctctctgaactacaagatgctttataaaaccttcacatgggccaggcgcagtggctcacgcccgtaatgccagcactttgggaggccgaggcgggcggatcacgaggtcaggagtttgaaaccaacctgaccaacatggtgaaatcccatctctactaaaagtacaaaaataagccaggcgtggtggcatgcgcctgtaatcccagctactcaggaggctgaggcaggagaatcgcttgacccaggaggcggaggttgcagtgagccaagatcttgccattgcactccaacctgggcgacagagtgagagagcgagattccgtcaaaaaaaaaaaaaaaaaaacctgcacatgtatatatttcaccaaacaaatataagcacaaacaaaggaatgcagctgtcttaaatagtccccatctatttggtgtagatgtattgcaccatttttccccggtgcaagaagactagacatgtttccaatagaggattcacctcaaagcgttcagctttgccaccatcaagaatatttgaaagaatgtgccacacaaacacaaaaattaacacttattgtgaggccacaaacgttagctgaaacctcatttctgcctaacttctataaatattggcaatttcattgataaaattttgatacttttccagcttcctaggattcttgttaggattaaaaactaagctccctgaagggagagggttttgattattttattacctgctcccaagcctctggaacaatgtttagaacttaatgctaggtcaatatttgttcaatgaattattggaacataaggacatatgactgactaccttgcacttaggagttgttcagaaaattgtagttagtattatttctcttttattttattcatttcaagagatgcttgcctaacttgagttgccaaaaaaatgagatgggatactaagacagcggaaatgggtccttcaaaaagattgtctgtttctatattgcaatgatatctgaaatctgatgctgtgataagaaccaaaaacttatcaggggtggaaggattttgccctgaatgagaggaggccccggtgaagatggtgtcttataatatttggtcatcatatgcagggctggcatcttttaaagtgtagcagttttagacctagactgaaaatccattatatgtgtcgtattccaacctcttcccaaacaagactcggattgtctcctatggtttctggtcacaaaacagataaaataaaaccatccctcctgttaccctattcagaaactctgatagcattcttcatatctctcattctcaatataaatcactctccaccaaaatttgtttattctccttgtctctactcagacacctgcccaaccctactcaatgtaatattttctatatgttatagccagaatgatctttcataaaggtaaagttgataagtatcctgaagttttaaaaaaaaatggtacattctctttgcccttgaggtaatgtcagcatactttaaaagacttacaaggtttttcatcattttgcccctttggactctataggaaaaatacgtgtatgcacacacatacacatatgtgtgtctattttcatttatgtctaactgaaatttagtatttgcttcatttggaaatactagccacactaattagtggctattgaaagaaactgttactttatcacttgaagttacaaatattttcttattatattatggtttttgtaggtttctcagatattatttgcattcattgtcactccaaaattaggcctgccactatctcctgtcatgtaagtgtcaataaagaattacatgttactatattgcaaattcattttattactttttttttttttttgagatggagtctcactctgtcacccaggctggagtgcaatggtgcgatctcggctcactgcaacttccgcctccccggttcaagagattttcctgccttagcctcctgagtaggtggggttacaggtgcatgccaccgcacccggctaatttttgtatttttagtagagatggggtttcatcatgttggtcaggctggtctcgatctcctgacctcatgatccacccgcctcgtcctcccaaagcgctgggattacaagtgtgagccactgcacccagcctattatgttttgattattgcctttcaatataactggttttcatcataattcaatgaagttttattttgtgcatatataaacattccagaaaggcatccataatcaccaaatgccaaaggagtccatctctctctcctgtacgcacacacaatgttaagatcctcaggactatattgtaataccttgcatattattgttcacttgttttccatgtaaaatgtttacaccattagaacaggttttgtttcagaatgataacctcccagactgattcagtagggactaaattaatatgcatctaattaaattgaaatgaaacaaagccccgagatacggacagaatttcagatggtaattttgagaacacctttagcatttagtaaggtggtactctttaaactcatgctatgttgtcagtattaacatttccaaagtcactaggtttaaattttagagacttactttctgactaccggctccaagcatttattttagcctatgtgtacaaacattcagactggctatgtgatggaaaagtaaaaaaaaaaagatgacttttgtcctggccctcaaaatcttatagcttaagatctaattctccaaaagtagacaaaagttgcttgagtattgggttgcacttgtttgtatagtttttattcagataagaataatgaagactcttgttctctctttctatctattcctttataataatagtaatcatcatcatcatctcaggcaacagcatcctcaatgcggtaaattttgcctatcatataaaaaatacatttgaatatatagttgtatcatgtttactttcacttttttgtaacatttcaaaaagtattattctgctatgacattttttgggcttagtcatagaacaaatgtgagctgttagggaactttaaatgtcttagttttattgtttatttataactaaagagcatttttagtctactgtaaaggcaagttatcatatgctaaacaacataaaaatgactgaatattaaagttaaaacttttttatgagaaaatgagagacccctatgtgatttattttaaaataatcattgcatatgccctcacacagaaaatcagaatggtgtgattgttgcctgcatgaccaaaatcgattctgcctcctttgtggttagccaacacagtgacttcagcacctagtagacacaggttgtgtagttgtagtggtgcatccttagtgttatgctctccattgctggcaggacagattctttcatgcttgtcttctttaaagcattgacttaatttttcaactgaaaacagtaagtgacaaatggagcacagagtattttagaacatacccagaaagagcacttaaagacaataagaaatactcaaataattgaaataggaatatttttattattatgtcattaaactagctggtgcttatctgacatttccatgttagacatccgtgcttatctaacattgtaatgttccacgttccaagtctgttttatcttgacctgtgcactattaagtaccagcagagagtgatcaatattattgtccaaagcagtgcatcacaacctttactgggcactggaaacacctgaggatcttgttaaactgcaaattcggattcagacatgaggctgagagtcttgtaaaagaaaaattgaacagatcggttaaacaggtaaagtagactttattgaggactgttgtaataggagagagtttcatctcaactcttccactgaagcaaaaggtgaaaggatttttaaatgctggggtgagctaatggaaaagtactggaggacataggcaggatggagaatgtgattgggctggttaatatgattaggccacctgtgtttgctaatggtaccttatcaaagttaggctcctacactcctatagagactgggaagtagggccctatctttcttgatgattacatttcaaaggattggcgcccaggtccttgagaaagaatttcctaggttgtagaaggtttacatctgaaaggggcagagaaggaatttacaattgcaaattttccaaagtaatcgctctacaaaaaaggaggtaataggcctatctatagtcagaaagaagcttgtctaaagttgggagggggggaccattaaggccattgtggtcagtcagtatttctacaaactcccaggtggtgtcaatgccattggtctgcaaaccacaggtctgcactgttacactgataggaaagattccatattgatgattcatgttaacgcattttctagcttatacagtgtactgtatatagaagtgtgtatttgaaatggtcaataccattgtctgtctagatggataataaaagttgttgtgtacaatatttatagaatgatatcttttcatacttctagaggcctactcagaacatctgagtctctcctgatgagatgaaatttggaataagttatgtcccagaattcaggacacatttgatgtttaacttatttcactatgagaaaagtagtgttataatgatgttccacagttgtattttgttttaattattctcattaagcccctagcaaacaggttgcttcatcatttttttctttctttctttttttttttttttttgaaatggtgttttgctcttggaatgcagtggcacaatctcggctcactgcaacctccgcctcctgggttcaagcaattttccttccttagcctcccgagtagctgggattacagtgcccgccaccacatctggctaattttttttgtatttttagtagagacggggtttcatcacgttggccaggctggtcttgaactcctgacctcagacgatccacatgcctcggcctcccaaagtgcagggattacaggcgtgagccactgtactggctgattcgtccatttttaacagatgaaaaaaaaactgtaatcaattttggtcagtgacagtgcaaaaaatgcaatttaatactacaaatacttattacctgataaagttctcaaataatgagctaaaatagaatggatatgccaaaactgtagcaaatcattaaagacaaaataataacattccagggacttaaaacaaattgaattctccaaagaacattattataaactaatattcctaattgcataggaatggaagatttttttttttttaatgttagtcataggagtttcaagacatttgaatcacctgcgtggacactggcttttatcctattaaatttaatgtggtaatttagagtgtttttattagaataatcaacattctaaaatgcaatcattagcatatttggcatagaaaatagatctgaaatgaacccaaaaaatgagctttaaaaattgctaaaactagcagtgtataatggtaacacaatccaaaggtcaaaaaacacaatgattaattaaaactaaagaataataattaattagtagtattaagaaagctttgcctccttttcaaaaaaaaaaagctaaaaaggaaagttgttgaatgttattgtttttaaagaccagcttttcatgaatgaagtttttaatcctttcaaagcctaatctaaatttaagaattcaaacaaaaaatccctaatattttaatttgcaatcaggagaggttcaatcagactaagactttttaatttgacagtctcctttttaacacatagagctacttctttgatctgccttggttaatgaaatggatgagttccaataaatttggatgcaaagtaataatcaacagaattccatttcccattgattttcattgtaaacttgtatcacttttttgacataaaataagcactctctggaatgaataatttaatttgaaatatgaataaaaaataaattatggtgcagaatattgctaagtccttcatacatttgcagcactttgcatctaccactgcttacttcctagacagagaaccatttcctataataatagctaaaacccatgaaggatttcctatctggaaatagtttctataacctttacatctattcatcttcatgattacattgtttaatgggtactatagagatcgtcagcatccccattttacataaattgtaagtgccagagttttggtttaaaccaggttgtctgactccaaactcttcacttaaaaaatatattttatttttatagataataatacaaatactgaaaatatttacaaaacaaatttacaggtaatgaacactcttattactaatgaaggcaaatgcctttattactatccttgatgtcagaagctagaaccttgcgagccattccagaaactttccacgtgccttcttataaccatctccggacacacgcgtgcacacacacacacacacacacacacacacacacacacacacacacaactgtgaccattatgatgattttattttttggaatggcatccttacttttcttcatagttttgtcactcaaatatgcatccctaaacactgtagtttagttttgcctagtgtgtgtgtgtgtgtgtgtgtgtgtgtgtgtgtgtgtgtgagacagagtctcaccctgttacccaggctggagtgcagtgatgcgatctctgctcactgcaacctccgccttctgggttcaaacgattctcctccctcagcctcccgagtagctgggattacagatgcgtgccaccacacctggctaatttttgtatttttagtagagatgcggtttcaccatgttagccaggctggtctcaaactcctgacctcctgatccacccgcctcgtcctcccaaagtgctgggattacaggcgtgagccaccgcacctggccagttttgcctaatttttaaaatctattaagtttcttttaatctataggtttcttcctttatctttttcttttatttaaacagtatatgtgttgaggaagctaaatagtttgttctgtagtcttccgtggactggcttttgctgcctgtgtttttgtgatgcaatttgttttgtttcactatcatccgtattccctatctgccttgttgccttgcctgaagatcaccaaatttcaaggacttctttcctgctctgctccaaggcacttctcagcccactctggatgtgcgtgggtggtggccagtagaggtgggctgcaattactggcttctttagtaagagctgtgaggttacatatattcaactctgggtttctaaaggcccatccaaggacaagttccagggaagatagggcatgcatgagtttgaggcagaatgagaaaaataagcaacatacaatacattttttcataaaattaaatttctccttttaaagaagtgttctttattatatttcagttagcctactgtttcattggcatcgtttccctttcattgtttgtatttttgttttggtgaaacaaaaaattagaaacccaatgtcagtctttgttctcttcttatgatgctaatttccaaaattgaaaagtgttggaaactctgctttagccttaaattttctgcagaaaattacattttgaattttcataaaagaaattattggtcttaacccattctgtatgataatttttaaaaaaaaaaaactctctaaagtgtaccttgaaaaatagtacctgtgatttgtctaagcttttgaataattcattctatctcaaatgtatttctaccactaaagttgctataccactttatggaaagaagaaaagcaactttccttttttgtacaggaaacttgaaagttcatctcatggaaggtgtggagagaaaggtggctatgtaattctcctttggatatttctggatctgtttctcaatcagattggttccgttcacactgcctgctgtcatgaaagtttatgcctcgcatgcaatgccagcataaatttctcagcacaaaacagctctgcttgttaaggaagatgttctgaattatcaaatatatattttttaattagccaccctttcttatgctttcagaatatatattaaagtgatctggggtatttcatgttaatgtaagaaaaacaatccaaactccctttgtttcttgacttagcttattatatcttcagtacttgcaaactgtgtgatacatgatcagtcacagcacactgctatttactgagcatccatggccactggctgacgtggcattgaatataacattgtattgttgctctaagccttttagccttcgtgctaaatgactcaacccatcacaagaaatttataatggacatataactcacctagttagtctgcatgagattgatttgttgtgaagttattggctataatgtctttgagaggataggccttcatttcaaataaagacagcctcatttatggatttcaaagcatgtctatacactgtaagtctgtattaaagaaatgggatgaagccagctgttaaaaacaagaaaatatgtgcaaaaggatttggagttgactgtattatatagaagtattaaattaggagctttagggcatactgaagcttcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctatcattatggtccctttaccaaaaaaaaaaaaaaaaaaaaaaaaaaaaaaaccttgttgtctctcaggcaaccagcgctttttgtcagcctatttcatctccccatcccttcctacaatcgtttatactactgaaaacttgaaagcccacatcccattctctcctggatctctaggcctaccaaagtttctttctaaaaccatgaaatgaccacaagttaatttgatgaagtgattcataataaattgttaataagaagtgacctacaactaggtcaggtcattcttcaaccacctattttattagtgatcccccacaggcaatacatgtgactgaagctggaatttgaactttctgtgatgagggccctgtagcgtatatgtgagacctctggtagcaggagtctctgagagcctctaactcatggtagtctgaaatagacataggcaaagccccagggacatttttaagagagctgttgtaagtaatccagtattataagttaagtctgtcctgtattcatcagaaaaaaacagaatctgctgctacaagatattaggatttctggtcttaagcaacagacttgaatttcactacctggattcttctctttggcttcatgtttgcagataggatggttgaggaggatggagctattgagagggtggctgctctgtgcagttgcttttgtttatattcttactgacctggcacagtgtaggtggaggtgatgcatgttttctgacattgggccagtgatgtatggcctgaccttcaaaatgagaaacatcatctctgtgggtgagactatagccgtgcaaatgcttttatcccatattgctcagcagtttgcaaccggttctgataaaaagcacccaccccgctgagttcgctgaagcttgtatattggttttaggttgaacattttggcaaattaacgactgagtgaaaccataaaattggttttatttacaacaaagccttgtggtgtctgttggttgttcttacatctctttcctttaatctttgaggttgtttctgtaggtggcttatctaactttacattgaaatttgcattcatttcaggataatacttcccctgggtttcttcttaattgacattggacatggtctgcattctcaaactttgtgcataaagttggtaactatacagagtcctagtttacgcctaccccaggtgattctgattcgggagatgtgagatggaaacccaaactacacattgttagtcagtaggtgactcccccagtgtgaatctactgatctcatgtttagaaatactgctgtataccatgcaaagctgtcattttctaactctgctaaacaataaaggttcacaagccatacttctgatttgccataaagttcgagtttttctccatttggttcaatggtgttgctatggatggcattcatagcaaatgataagattgggcatagtatactttgagtgaattcttagttttccttagaacaacaagataatgagttagaattataagagagccatctagtggataaggatataggcctgttgcatcttgtcttaatgtcggctttatggttttatcagattacagatttaaatataaatgaaattaagtgtagatatatactctgaatatattacattaaatatatattaaatgttagtgaattttgtttttgttctttttgttttaaaaaaataatttcttattttataaatgagtctgtacttttaagtagttctactcctttaaatgaaacatggatacagagatgataagacatgattttaccgtaaaataaaacacacattatatttttagggacataaatataggctagtaactaaaacatattttttaatgcctactatatgttccttggatttgaatgtaaaagagatttcaggacttaaatagtagtttatgcaattagagaatgcagaaatagcgtgaaagaattatagtctagatacattactattttttatatactctggaagtttttaacagttcgtaacaaatgccttgggcagattagggcattgccaaaaatcaacatcatgctacttacatttacaatcatctgacagtcatctctcagacgagcatcctcctgattgcctaacatgtttcttttataatgtaataaaggtgagttacacatttgagcaacagtgtttgtctgttatacctagagagaagaaaaaagattgtaggagagcaagatacccaagatactaacttttccaggcccacattttaagtgtattgtcaaaagaagcattttatttttatttttttttacttttttattttttttgaggcaagtgtcttgctctgtcgcccaggctggaatgcagtggcccaatcttggctcactgcaacctccacctcctgggttcaagtgattctcctgtctcggcctcccttggagctggggttacaggcacccgccaccgcacccagctaatttttatatttttaacagagacagggtttcaccatgttggccaggctggtcttgaactcctgacctcaagtgatccactggccttggcctcccaaagtgctgaaattacaggtgtgagccaccgtgcctggccgaaagaagcattttaaaagtttgatattttaaattaaattgaagatactctatcacaacttaacattcttatgctgggtcatccctccttcccctgtactcaagctcctagaaatctcatctatttatacctgactctgctattcaagtaacttccaggttttcttcccccagcgctacatcttttcttctcttctccaggatcctgctggacatcacttcctgatattcttctggcacctcaacatggcccaaatcaaattagttatctttgcactgtttttgtattgtgtatttcagttaaaggggcttacctttaattttcttaagaataaaagattatagtcttatttaatctttctttttttcttatctccttcccccagtttcctgttggttctacctctaaaacctatctggcatcattcatcaggatactttgcaaaatgaggattatgaggtcaggtcctgtggtaagcagggagccaaaaataagaccctcagagtttcttgcctccctgttgtacacacccagtaaaatccccttcccttgagtgtgtatgagactatgaataggatggataccacacccccgactaggttacgttatacagcaaaatggaagataattttgtgtatataatttaggctgcaaatcagttgattttgagctaatcaaaggaagattattctgggtgggcctgactttatcaggtgaaagcccctaaactaggaactgggctcttcctgaagagataaattctcctgctaggaatgaagtactccttgacaaagtaagcagccatgttgtaagcgggcccatgagagggccatgtggccatgaatttcaagtggcctctaggagcaaagagtggctcttgtctgacaactagcaggaacagagatctataaccacaaggaaatgaatgctgccaacaaccacatgagcttggaagagcacccaagctccataaataaatgcagcgtggctggcacctcaatactgcttcgtgagactcggagcaggggacccagttaaaccgcacttggactcctgacccacaaaaactgtgaaataataaattcaggttgttttaagcactattttttaatttttaatttttatggatatataatggttgcacatatttataaagtaagccactaaatttgtggttatttgttatgcagcaataaataacaataaatgtcctcattatcttttgctttggatcagtgcagtaaccttcaaatgaagctctcttagctcatccgtctccatgaaatcctacataacacagccaaagtcatcttccttatcctacataagacagccaaagtaatctcccttataaacagactataatgtaacctccatgagatagggttatagatagagttttgttcaaagctgtatctctagaagaacgctaacatttatgcatgctataaatattgactgatggactcaatgaataaatatcatctgtcctcctacacatacatcaaaacctttgctggtcccttgcctacagagacatcctccagatacaagaagagggaaggtatataataaaatgcttcagcatacaggttctagagtaaaaccttgggtttagatttcagctctaatatttcctagctttgtgatctcttggaagatgtatgactttactaagcttcggttttccaatttataaaacatgaataacttttaccactcaagactgtattgaatattaaataagacaatgcatttaacatattttcacagtgcctggcctatgcaatagatcaacaagtattatttatgattataacatttaaggccctttactatatacctttccttcctgtcctccagccttatgaagctggcacccttgtgtttcctgcctttgcagcatgatggagagtgagatgcatggatacttttaaagtgtccacttctacgcatcccctgctaaatgaccttgagcaagtttcttcccggtctcagtttggttatctgagtaatggggctaatttgaatacatagttctcgagtttgtattgagtcgatccctgcattagtcagtcacattgaacaataaccaaatattggccactgaggtcacttactgcaggaacaatataatggacgtctttcataacattatgaagacccatggaaaacttttcttaatattagaaatagttgtgttggtactgaacaatcaacggttgttattgtttttatctgaccaggcttttctctttgaattagcttctagttgagacaatctgtactgactctagttcagaccttgttccctgtctctgtgtatttccttttttctcgttacaaatttctaatttatgttttcctgctatatttaggtaagttaccttaaattcattctttaaaaaaaaggtagaagtaagtatataaaaaccttccatggttgttacatatgtaacaagcactattcctgtgtcatttgtgtgagggtatgtgtgtgttttaatggtgagagttaacaaattatgtaagaaacactgacattggaaaactgattttaaaaaaacaacttgcaaaatttcatcaaatgagtcttgtttcttgcattgaacagatcataaaagcaattcataaaaaggcaaatatagtgattcttacatcacccatttagttaaagtatcccaaatgctatagcataaggaagtacatgtgctaggcagcctttgagttaatgaactgatgttgatgttaaaactggtgcactcttttctcccggaggtatggctgaatctgtgccacagccagccactttttcatcagattccatttgaaagtcaattgatgaatcagccctgatgcctcattgaacataatgtcgagaagcaagatttctgtactctattgatgtgtttaagcagcatcaaacaagcacacacatcaatggaaatatcggtcaaatcatttgtcaacaattttatagagaatacagttgacttcctaatttctccactgtttgggttgctatagtctaataaatcatgcttctgcatggagacatactaatacttcgtggaaaagtaatcagaagtcttaattgaaataaaattatatttgtccctgtttaaagatattcaaacactacttcagttcacagacttaaaagtgaataacttctttatgaccttattgaatgaggatgtgattaatgttactaaagtcacacttacgttggattgggggactgaccgaccatgctgtgagatctttagcgagaaaattgagctctcttctggttagcgttgactggctatactttgtgctagccatcactgacttccacctaaaaagataaactgtaggtgtaagcagcaaatatcaagccgtcttaggctgtattcttctattccttctctttttttttttttcctttctttttctttttttttctttttttttttttttttttttttttgagatggagtcttgctctgtcacccaggctggagtacagtggtgcgatctctgctcactgcaagctccgcctcctgggttcacaccattctcctgcattctcctgcctcagcctccccagtagctgggactacaggcgcccaccacgcctggctaatttttttttttttttgtatttttagtagagacgggggtttcaccgtgttagccaggatggtctcgatctcctgacctcatgatctgcccaccttggcctcccaaagtgctgggattacaggcatgagccaccgcacctggccccattccttcttcttcttaatatttttccatttcaaggtcacaactgcaataccttatatatcccatattagtaatgaggacatctgtgttgcactggtattgttaaattggccttcagtaaaatcaaaccattccttgcagtaatgggtgagaacttgcctttcacctagagccaagttcattacaaattcatgctcacagcccagagaaaaacagggtttttatgaggtttcaacaagtaatatatctgcatgatgggttgttccaagaaactaagcaaatggaaatgtcagtttgcagaaactgtcaaaacgaacataacctaattagaattgctgcttatttaataagccatcagtagccctaccagatagagtcctgccaatcttgcaagtactcattcatcttgcatttaagtttgtagatactctaggctctgctaatgggaaaacaacgttaattagataccgcacccaatcattaaacagctgcaagcatagttagtgcccttagctatgaaatgctgtaagccttcatgtgaatataccttgatatgtcaacatgggaccccagtgtgtattgcagttataaaacagtgtgcatcactgtatgctttgcacatggcagatcctcgcaatgtacacatcgataagtagtttttattaatgtatattccatgtgtttgaattgcatgtcacccacttaaggtaggttcttatttgatgcccgtagtgtttgcatattaagggccctgaatactactactttgcttagtaacgtgtctttacagacattacctctgacttcatgttttatggttgttagtaattgtgaaacaaatgtgtctgactgccactgggcaatgctgcttcaatagagtacacacattaagtgtatgacattcaaaactagcagaggaggaactctgaaggaggtagggcaggggatgacaagagtgtgggaggaggagaggtgtaaggagaggtattatgaaagaaaaaataatcatgcttttttaattgcataaaataatttgattgcaagtttcaaagacaaactaaaaaagaatgtaatcaattatctgcgtgttggcacaatagaaatttatggggagactgtggaggaaacgaaatgagaacagctgaatgaagtcaatcgctgtgatgtggcgccttccctattgttgagaatggaaaagagtgcaaatgcacagtgcaccggatttgtcagcaagctgtgttttctcggtatggtagatctctattgctcatgactattgagaaagacctacacacctgcttctgttattctcaagctgaatgatgaggacagagtttataaatagcctttctttcctctctgttaagtgtttcctcatatgtgggagaaggtagattatctggctatctaaatatcacctggaattgttacaccatgcagtgaatgtttaagaaatgagagtggacgattttggttgatggttttagttagctacaatgttttcaacatctttaatcatattatccagacttcttatttgttcttcctgtattacctattgattattataattctggctccatatacctgttacctagagtcacattgatacatttttgtcatcatgtgacattgctttccctcaatctcatatgccatttctaatctcattcttgctttactgtttactcgattacatctgaatctgggaatcactctctcatccaacataacagcagcccctcacatggctcctttgcttctaacttgcctcaatttctttctagccagtagagatcaccaagacccaatttggtcatccattatgtttgggaggacagaaatattattttagttatatattcagtgacttacaattgtttatcacaaacctaaagttacctgtagtaagcactggatctgtttcaggtacactgtcaattgtagaaggtagttgtggacatgaataaaatgttagagatgtcagaggccgatgtggctgtctttagaggtagagttttattggaatatggcctagaactttattttcaaaacaaaacaaagaaatggataatcacctcttttccttatcaatgatctcttaatctctactgaattagttttgcaaattatcactgaaagaggatttcaagaaatatgattttaaattatctttttcatatttctctagattttaaaaagctttctttaaaaagatgacaacctttaaaaataacttttagataccatatatgccttccaatctaaaaaaaatgaaaatattgataataaaacatttttctccatggtctgtgttaaaatttatagtctgactcactcaatactaatctatgtggaatttatcttgggtagtctaatctttgttgcaaaaagtgcaatacatgtcttccttgctttaagtactgctttcttatgtgatagaaaactgttacaactaaattacattatttttaaaaatatgatattttttaaatggagatctttttgaatatcataccacattcaatttccagttaatcaaatggcaagttaaaaataagtagtgtgcattagatttttattgctgcagttgtaaattaccaaaggcttagtggcttaaaacaacataatgttattatcatactgacacaggtcatactgatcaaggtctcagcaggactgtatttcattctggaggctctaggagagaatcagtttcctttgccttttccaacttctagagcaagtttgtccaacacgtggcctgcgggctgcatgcagcccaggatggctttgaatgaggctcaacacaaatttgtaaactttcttaaaacattgtgagatttttttttttttgcaattttttttagctcatcagctatcattagtgttagtgtattttatgtgtggcccaagacaattcttcttcttctaatgtggccaggggaagccaaaagattggacacccatgttctagaggcttaccacattcccatgacttatggcacctttcttcaatctttaaagtcagtaacattgcatttttctcatccttcttcagtagccatatctacctctctgactcttctgcttccttcttccacttaaggatggttattattaaattggatccacctggataatctaggctagtcttcctttaaggtcagttgattaacaacagtaattccatctgcaagcttattgccccctttactatgtagcctaaaatattcacaggttctggggattaggacatggatctttttgttgggggaggcattcttctgcctaccacatagtagtatataggtacacacacacacatatatatatatatatatatatatatatattttttttttttttttttttttttttttgaggcagagtctcactcagtcgtccaggctggagtgcagcggcatgatctccgctcactgcaacctctgtctcccaggttcaagcgattttcctgcctcagcctccctagtagctgggattataggcgcacgccacctcacccggctaatttttgtatttttagtagagacggggtttcatcatgttggccaggctggtcttgaactcctggcctcaggtgatccgcccttctcggcctcccaaagtgctgggattacaggcgtgagccacctcgcccggccttataaatatatttatacctaggtttgcacatggaagcaagcatcactattttagattatggacatcttaattttcaactttggcagtaggtttttacctgtaaaatgaaaggaaatcaacctgattatatactgtgtactttgaatccatttgaggcctacaaattgtttgtaaaaacaattgtttttgtccaactgctttttttccaactgcatatatgatttatggaatttgatgataagatcatggaatttttctcaaccaaaagtaatggtttgtgacactaatacatgaagcacattccagaatgatactccagattttaaaaagagtaaaggcaaaaaattgctaacgtctccaaacattttcctgtgagccactaaccattgctaatgtttccttgacaagtgaagaaaacaattattttttaaatattctgtcaaatggtactattttcttcaggtcaattctaaattccaaaatttcagggattatgagcaagctctcgatcgctctcatccagaatttatagtgtccgtgaaactttatgtgcagtacaggaacattttacattttggggttaagagttgcaatagtttggatgattcctctgcaaactgaaactaatagagtcatacaatacaggaccatgttcttaaggcaaatatactatatagtgaatgaaagaaatggattttggtaactccctttcgggctgaactgagtaagcagttcttcacacaaaggcaccatgatacagtgataaaaatggtgagttgggataccagaaacttggtttctggtcctggctctgtctctaattattgcatccttttaaacaagttaaaggatagctttttgcctcatttctctcatttaaaaatgagtttaagaggaattatcgctgaagtcctggatcatgcacagcttctgtgatgttataatcccagttttacatggccaccacatgcctaacatcatctgtggtggctcctggaaaaaagaggggatgtgagcaaaaaaaaggaaatacagcagggagatgtgatatgacaaaaatcttgctaccacaattgttggaaacagaaagcttactcaatcgctgagagctaaaaagggcttttatgcacatctccttgctactttactgttttctgagttcaattccaatggaaatggtaaatatgaaggggccttaaaaagaaatagcatcaggatgttttactatagttctgccttattgtatatggaatagacttgatactagaaaattgacagcaaagtgtagttctctatataacattttttttccccaactgcttttgtagaactgaaactgcactcccaggggaagataaacgatcccacaaggtgcagtaaaagtcagagaatgctattgcagtagggacaagatggcccagagacacagtctacccaacacccacatttaactgatgcagacctgcaaacagagagtcttcatgattcactcaaggtcaagaagccggttagttacagagtcagagctgaggctgtatttactctttcccacaagcaaggttcaactgttcctacttgaattgcatatgattacatacagtatgaaaaaggatttttttctgttaactgttgacaatattaacatcagtcactaattttaataatagtacttaattgatgctttgtatgtgctaaacagtcttgtaggtgttttactcaatatagttttattaactcatctaatcatcccaagaattctgtgaaataattctacgtacactcctactttacaggaggggcgcccatgccccatttaaagatgacatttgaacttagacactttggctgtaaatccagtgttcccaattgtgctataatgcctctgaacttaaatgctacaagaaaaatcaaactaccaggttggacctcaattatgattacagtcatatgagatgagccacttaattgtatggatctttagatatataacattttataacttgaggctcattcattcaacatgtagtgattaagcatctattatatgtacagggatttaccaggtgttataaaggctaccaaggataatgtaattgataatgctagtatgcgtgataaaatggtataattcaaagtataacgaatagcattaataacaacagttcttagatagtacgtatttaatatgggccagcctttttgctaggcaccttgcatatattatctcataattttcaccccagtcattaagccaagtcatatttttccattttagaaatgatgaaacagacgtgaataggtaagcaacttacccatacttacaaaggaagtgacagagttggtattcaaatctaggtctgtgtgaataacaacctcattttatttcaactactctgctttaaattagaaaacccaatcctatcaaaagaacacgtgaggcccctctccaggcccagctgggaggcttattgctgaatgcatggccagaatccattgtggcttctttttgcacagatcttacatgttccccggggggtttattatctccccatatatggtaaagaggagaaatcctggagttcatctccagtctttctgtttaggctttgcccaccagtgaaatttaagagcagagtattgcaaagcgtatttggaatatgttaagaacccttcattttgcgttcatgctttgatgcttcaacatccttctcattgtcctaattttgagtccacattcaaaaccagctgaaaccccttgaaaataaacccaaccgctggcatctggctccgcagccacccaccttgcttggtttgctttcaaattgcccggtgaaattcactggcaccaatcacaagtcctcatgctctctctgctcatcacctattaggtcaagcactcatgggttgtgccgtgttgtggccctgcatggcatactgtcaccctctctctgggacctgtgagaataagaaatgtcatcctctcaaatcactttctcttgttctcctgtggcgggaccaactttcccataccttaaccaacacctacattcttagaacagatggaatgaatggaaacgaagctacacaactttctaaacttgtgattctaacttcaaaagtaatgattactttttctctttcctgctgcttttctattttatctctcatttttctaacatcttttctctcatctacctctgaagatccactctacctaggatctggagccttccttaattcagtcactcatttagggactgtactgagtttcaccaggggtttcaccaaataatgatataatttcagctctttatgccttttgagtgacactcataggaagagaaggattgcatctctacctctaaagggtcttgaattgtgaaagagtttccctcccctcttctcttgtgctctacttcctctgctttcctcccctccttttccctctcccccacacatgtaaacattgtgtaattccatgtgtgtccctgttatctatttgtttctagtgttaaggtgacttacagcttaggggtacaactgtatatgtattatattcagatgcagacttgtcaagacaaatacagtcttcctgacactgatgcatgcagtcaacactggaacagaaagttgatagctgcattaaaatttttgcaatggctgccatagaaacccacgcaagagtgactttgcgctgaaatatgacatctcagggatctgtctggtgaatctttgacacagaaagagaaataaattagaaaacagttttccacagagccttttagatccttaaaacttgagtctcaaagcacttgaacaaagtaactatttggaaaaagaaaaggtattcgttcttggcatttttaaattcattgaatagattctccttaaatgttaatagcattttgatgggagaattactctattcagagcattcggctcacctcagaaatgatttaaaaattttatgttatgccttttaaatattaagcttctcattttccatcccatatcaaaactggcataacatttcagaagtcaaggtttaacagtcagcaaataaacatatttgcaaaactgttaaatgatgattatttttgcatttgatacgcaattgtatctacaatatatgtcttgaggaatatgtgttttattcactgcatgtatgcaagcaataaaatttcactaagcagactccatggcaaattagttacctgagtattccaattactgaggttcctcaaaccactagaactttcatcttttttttcagtcctttttttttaatcatactctaagtctgggatacatgtgcagaacgtgcaggtttgctgcacccatccacccgtcatctatgttaggtatttctcttaatgctatctctcccctagccccccaccccccgacaggccctggtgtgtgatgttcccctccctgtgtccatgtgttcttatacttcacctcccacttatgagtgagaacatgcggtgtttggttttctgttcctgtgttagtttgctgaaaatgatggtttccagtttcatccatgtccctgcgaaggacatgatctcatcctttcttatggctgcatagtattccatggtgtatgtgtgccacattttctttatctggtctatcattgatgggcatttgggctggttccaagtctttgctattgtgtacagtgctgcaataaacatacatgtgcatgtgtctttatagtagaatgatttataatcctctgggtatatacccagtaatgggattactgggtcaaatgatatttctggttctagatccttgaggaatcaccacactgtcttccacaatggttgaactaatttacactcccaccaacagtgtaaaagcattcctatttctccacatcctctccagcatctgttgtttcctgactttttaatgatcaccattctaactggcatgagatggtatctcattgtggttttgatttgcatttgtctaatgaccagtgatgatgagctttttttcatatgtttgttggctacataaatgtcttcttttgagaagtatctgttcatatcctttgcccactttttgatggggttgtttgtttttctcttgtaaatttgtttaagttctttgtagattgtggatattagccatttgtcagatggatagattgcaaaaattttctcccattctgtaggttgcctttcacttcgatgattgtttcttttgctgtgcagaagctttttagtttaattagctcccgtttgccacttttggcttttgttgccatcgcttttggtgttttaatcatgaagtctttgcccatgcctatgtcctgaatggtattgcctaggttagggaactttcatctttactagatgaatcaaacctggcaatcctcagataccaaaacaaaaacaccttcatatacatgttagccctcatagaattcttcaaaggcatactttctgtcttaaagtataaaataattcaaatataaattttcttttctcttgatgattctgcaccgtagtacttttgggtgttagtgtaatctactggtgcttttgtgtagatacaagatgcaagtcaagaatcagatttgttgtcatctctcatcgctctttttttttttttttttttttttttacaaatgtaaccttgtgcaagatgcctttagcaatcaatgcctcaagaaaaaaagagatgattgccaagtggttaattagccttctgccaggtcttccccacctcagcaacctatttaccaacatgcaaacttgatgcccactaacagtggaaaagtcttaggcctttaggggtcacagtgatgaggtacaggtgactctttacccaccccacccctgatagctgatctacctctcatcatccttctagtcatgacttcaaattaccaccatgctgcctggacagctgatgaggggattttcataacagccagtatggctgctttgaatgattgccatggaattttttccctcttctttcggtttccctcccttttactttcttctatctcctgttgctactacaaattttctgtgaaaagctggtttatatatagattaccaacccatcagagaatacttttgctttcaagtaggaaatcaaataatcatagcatactgggtactattttttatgggttctctcttctatgttgtttattacttggattcatggggatgcttcattcttcccaatgaggtaaggtttccagccctctttttgtaaccataattgttttgaagtctagagctgttcccaaagattgagagttctgaaagtttggcctcaggagtgggtggggtgggggagagtagtaggtaagctgttgtgtgtatatttatgcttattgtttgctcagcaagcagtagacatatacttgaattaatctggcaaagtgtttagttttaatgtaaggtgaaacacaggaaaatactcctatcccaaagatgtgaaaaaatagtttgttaggggaaacaggaaagagcagctctacaaccaatgatatattcatatctaagttgaagtcatatattctgttttatgtggagcacacaaattagctttgcaagttggtcggctatgcctagatatttactgtaacatatatttttctaaaagcatatatgggtgccttaaaattaaaatctgtaccacaaggaatattggatattagaaattatgaaacaatagggcttatacaaaagaggtatgtttattcatttacttactgttttttattggatacatgtgattaaaagaaaaatttttatataatcctattgtctcaaggacaaatgattctgtgctcatctgggcatgggacatgtcacacagatattaaagacactacagagccatactgaaataacacggacagagaaataaaaaaaaaaaattaaaaacagggtcaatagtggcaaaaagtgagcttgttaaaaaacagaattggccaggtgcggtggctcatgcttgtaatcccagcactttgggaggctgaagcaggcagatcatgaggtcaggagttcaagaccagcctggccaacagtgaaaccctgtctctactaaaattacaaaaattagctgggtgtggtggcgggcgcctataatcccagctactcaggaggctgaggcaggagaatcgcttgaacccagaaggcagaggttgcagtgagccaagatcatgccactgcaatccagcctggttgacagagctagactctgtctcaaaaataaataattaataaattaattaaagtgaaggcatgcaaaatatcctctttggagtctaatttagacatcatggaaggataattatttggtggtggggatgacatggagattaaaaacaggagaaggaaagccctgtgtgttttggcattttagacatttagtggaacacactagggttcttgacactttctctgtaacttggagaggatacttttatattgtagataaccttgtggagaggtagaagaactatggtggagtctgaagaagtaatacagttcaaggtgtttccaatttgctctaagttagcaaaagaaaaagacaaacacaaacaaatagaaagtattggctgggcatggtggctcacactagtaatcccagcactttgggaggctgaagcagacgggtcgcttgaggtcagtagtttgagaccagcctggccaacatagcgaaaccccctccctactaaaaatataaaaaattagctgagtgtggtggcacacgcctgtagtcccagctacttgggaggctgaggcacgagaattgcttgaacgtgggaggcggaggcagaggctgcagtgaaccgagatcatgccactgcactacagcctgggcgacagagcgagacaccatttcaaaaacaagaaaaaagaaagtgttatacaagttatatcacgaacaagataatataaaaagctattgcacatcaataagaaaagttcaactcaatgcaaaaatgcacatatgatatgaatagacaactcataggaaaggaaattcaattgactttgaaatatatgaaaatatattcaacctcatttgtaataaaataaacataaattaacattaaacattttacccatcggattaacaaagttaaaaaatggtatagagaattaggtgttcgtacactgctgatgggagtttaattgttacagcctaaattcaggcaagtcagcaatacctatcaagaacaaaatgatgcatattctttaggcaattctcaaatgtatcttgcaaatatggtcattcatgccatctcatgctcattcatacacattcatgccgttgtgtgtctgtgtgtttgcagccattgtgtgttgaattgcataagattggaaattactgacatatacatcaatggaggactagtcaagaaagttataggtcattcacaaaaagagactattctatatctattagtatggaaagaagttgaaaaggtatcattaaatgaaaaagtaggggattcgaaacaacggttatagtacggtatttcttgggggaaagaatacacatattgtgataatggaatatctctggcctgtttatacttgggtttggctaagggattgtctctagggaggggaactcggctggggagattggagtgggacaaaaatttacttttcaatttacacagttttatagcttttacattttatatcttattgtatggtcaactcagaaagaatagttaaaactaaagggattagaggaaattatgaattctaagaacttactttgtctgggaatttaactgtgcattgagctagaattatttttgttgtattaggaatctggtaatagtgaacatgaaacaggagagaaaaatttttcacagatattttgacatcaaactgagatcatttgatagtttttgcctgattaatattcttaaatgattatggagaaggtgttgtgacccagaaatgcaataacccattatagtatcttgtttacaccccattaacactgatagcactctatgttactttattttcaatttttttccttcagagtctcagttatttaaccattttccaattactaagcgatatatgaatctgactcacattctatattcagaacaatgaagatcaaaatatgtatttcttatagcagttatagattacaatagtggaaaatgggcttcagagtatgaaaaagtggagagcaagtcaaaatcttatatgaatatgagagaacattttagttataattacaaagccccaatggcctaattttcctcattaatgctgagtgatatttttgaaaagtatgtagaatttaaggtaccaattgccaaaacagtgaaataaaggaaaggcgtgagaaagaaagataaatgaaattcccaggtattacacaatttacatcaaagtattttctaattggtaatgtaaaatgttatataggaaattttacacatcattttatatatctctttacttgaagtgttaaagtgatttcccatataataattcagaaaattatgtataagctaacaaaacttagacctgtagactctagttgtatgtagaaactgccaatagctgctaattcaattctctcttcaatgtaccccaactgatatcttgtttactgggaatatcacattcttctctctcattggactttatttcactggaaaaataagtcctaaagggaataacaaagaaaactacaattgagaaatagaaacaacaacaacaaaaagtttagctaaataattaaagatatttgatgagcatcctggggatatccaagttaatgaacttgagtgagtaggatgggcattcatctctgattcccacctttcagaagagtgaagaaagcattaaaccatgaaactatggcttgtgaagatttccgagggccagtttactgagtgctgagaatgccagttttttaaggcttctcattaccttttagcatttggaacccaaagtggagaatgattgcttctgaaataacaagaggtcatttcctcttccttcaggtctcttcctaaatgttctcttgttccttatgctgcatgatatgtaagataaaatttatttttttcattgtatcattaaaaataagaatctttctgcaaggaaaaagaagggtatttagataaaaccaggagtttactttgatacttccatgtaaactcctgtttgtatcagcagtggtaccttggctgttgtccagcggtttaattggctcttgtttgcctaatctcctgtaacagataatgttattacagaatcgtaggactccaaaatttcccatcagacaaaacaagccttttaatgagaatcactttgttttacctggcatttggcttggtttgagccacctcaatcccatctcacttgtgagaaatgcattatttttcctaacaaccatgctaattctaagccaggaaacatttttttggatcacttcttttctggaatgattcaaagttcaggaaagtaaaagtgggaaggaatttaaattaagctgagatgggaaggagacataattaaattggactttattacccctgttttgcaactaggttgatgttaattggtatctcaaaagacatagcactataacatttgctgtttttgaatttacattaatttcttctataatagtacgtcagtgtatataatttgtctaaattctgtatcttttatttatccatttagtaattcttacattcaaccaatatttggtgagtgtatttcgtgtttaaggcactgttctagggaccactaatagagtaaagcaaaacaaaccgacaaacacaaaataaagtcctaactgtaatggagctttttgttcaggtagtgaaaattgttttaagaaaaataatatatggggataacagtagaccgtgtatgcaggagtaggacagttatatttatacatctatacacacacacaaatacatgtatgtattcacatccatatacatctgtctacatagatatagattataatgttatattataggatgtcaaaaagaatctctttttgataggctggcttttgagagaattaaaaggaagtgaaggggcaagacatgtagccatatggacaaaaggaaattacagacaggacacagaaagttgcaaaaacctgaagtaaaagaatgttttgtgtttaaggggcaacaaacagtgatgtgagttgggggaatatgctagaagaggagatgagagagacaaggtgggaatggaaaaagtccagtaggacttccgtgacaaatatttaggaatggattttgttaaacaacatgtatacgatattgtggttaaagtagaaaatcaatgatagactggattaagaaaatgtggcacatatacaccatggaatactatgcagccataaaaactgatgagttcatgtcctttgtagggacatggatgaaattggaaatcatcattctcagtaaactatcgcaagaacaaaaaaccaaacaccgcgtgttctcactcataagtgggaattgaacaatgagaacacgtggacacaggaaggggaacatcacactctggggactgttgtggggtaaggggaggggggagggatagctttaggagatatacctaatgctagatgacgagttagtgggtgcagcacaccagcatggcacatgtatacatatgtaactaacctgcacattgtgcacatgtaccctaaaacttaaagtacaataatagtaaaagaaaaaagaaaaaaaaaaagaaaatcagggccatagagaaaagatggaagcaaatatagtgtagagaaagctaatatgtttctgtagttgatcactagatttctctatcagtttcctagtggccagggcatacagggaaataaaaatgttgtatgtctggttaaatacatttttttaaagcaagcaagtataccaattatttagggaaattgaaacaaaattacaaaacaattgttgctcttgtttgtcttctttgttagccaaaaaatgcctcccctttatttttatttgttgttgttttggttcttcagtttctattaaataaatttccacacttgagacgctgtgtaatttcatctagttttgtacaaggttgtgggtgatacaatcttatgtcatttttaaattgtccactaccatactgaaattttcatgacttgccttcatatatgagtatgtttttatttcaatcccaagattcaagtatacaaacgcagtgcttttttaataggaagaacatattaaaagtcttcatataccaagagaaaacttacttctcttagaatactgattgtctctttataaccactcttttataagtaattgtataaactcttacattgggattatggtagtttcttattgatctggtaaatgttttctcgtgtctataacaattcaaggtaaaatacactacaatcaccagaaataaactatgttttctggtactaaaatcattattttagtaatttttaaaaataatgttcattattatccattatctgagagatacctctcattacctctctcaaaaatgacaagaaagtgaaataacatgtctaagattattgttacctaatgtttataaaaatagataaacccaagaaaaatatcgaaaagtattaattgtatgaaaagatggagaagaggaaaatatcccttataatgaaaatcagtcatgctagatgataaagtggtgagatttaaacaattttctgggcattgtattctcaaatggatagtgagttgagcaaatagattaaaaatagtgtaaagtaatgcaatagtaaaataaacatgctgagtaggaagagttaagtcttagataacaaaaggcagaagacaaattaaatcaaaataatgtagaggcatgacaatgaaagctaagtagtctatggaaaactgttaagagacctgaattaattaatgatgataatggtcgtaactaacatatatatgtagtgacaggaatcaatccaagtattttacacaaactcctcatttaattggccccacaactcctttaggttggtattattatcatttccatttacacatgacgaaactgagagcacctagaggattaactggatcctaacactcaaaggctttgtgatatgaagtgttcagtgattaatgtgtttgataaggttgaagatttggggtgcatcatttcatatcaactatagtaggtggaccctgtcaggagaccagggaagagatgattagaaaacccagatgaaagaaactaggacctttatcaggaactaaaggtgaaactatacatttagatggtgtaaatgccttaggggacctgaaaaatggcaagcatttaaggtgaaaggtaaataggtgagtagccccaattgaatgtataatattaatgaaagtcacatttaaagatgtttagacataaagcaaatggtcttgttatttagcgggacttaaaaggtaaatcagtaagtggagaaaatctcatctacaatgggaaaatataattgagcttagactggatataaaagggcagaagtggagagctagatctatgtgtatttatccagggtttgttatgagcccagagaaaatgtaggaaaagaaattcaacaactgaaaaagcaaaaaattaaatgaatctgaacaaagaaagctgcttatattagatatattttctggaaaaagatataggtgtcctgtcttagcaaaataggaactagaacaaatgccaccatctttcaaaatttaatattttcttgctacaatttatgtttatgatttatacttatggatatgatactctattaagaggcatcttgtgtgaaacaattatcatatacattgcaaaatagaatatgtataaatgtttccgtgtatatgtgtagatgggtttgtgtgtatgtgagagagagcaaagagggggagggagagagagggaggagaggagaagggagagagagaggcagcaatttctaagtatttctaaacataggagggttataagattatattcatggaaaaaagacatgttccagttcaagctgtatgcatttatacagtggactactagtatgatgaagctggagaacaagtcaaaacactggagtggaagcagaataatcacacacaagacaggtgaaatattccagagtcaccttgaaataaatataaaattgatgttggcagcctgacagtgacaggagtcaagaaatgatgctgctgtgaaatcacaaaagatgcaattgatattttaatctcaaataccacgtctgaggagaaagcctgaaactaggaattgtttgtaaaagtgtatctgttgatagatttctgattttgctgcttttcatttttatcctcttatggagaataataataaaagtagtcacatttttagtttatattgctctttaatttttttcttaaaatgaatttgaatttttttaagacaagaacataatatgctctgaaatcgtgtcattagatttaaaaaacattattggagatatttttcttgttagaccactgcttttcttaagtgaagttgaccttttgagtttttagtaactaaggtatttgtgtgtgtgtgtgtgtgcgtgtgtgtgtgtgtgtgtgtgtgaaattcattatatttgttcttctaaaactattttcttcagttctaggtttcctagtttggagcagaattctatatttttcttgttttatgccctaggaagggcataaaattattttgaatatttttttccctcttcttcctgacccatgtaatcgcctagctgaatcaggcctccccagaaactgattcatggtcgttgaagtatctcatatgacccccatcccacctagtccgatattaaccctataaaatgtctcaaataaactcttattttcgtggcctctaatctccttaattttttaattttagattcagggtgtacatgtacaggtttgttacatgggcatattgcatgatactgaagtttgggcttctaatgatcctgttgccgaagtcctgaacatagtacacaaataggcagttttctaacttttgcttcactcctgtctttcccccttttggaatccccagtgcttattgttcccctctttgtattcatgcgtacccagtgcttagctcccacttttaagtgagaacatgtggtaattggttttctattcctgcattaattcgcttaggtgatggcccccagctgcatccgtgttgctgcaaaggacatgattttgttatttttttatggcaatgtagtattccatggtgtatatgtaccacagtttctttatccagtccactgttgatgggcacctgggttgattccatatctgctatcacgaacagtgctgcaataaacatatgagtgcaggtgtatttttgctagaagaatttattttcctttgggtatatacccagtaatgagattgctgggttgaatagtagttttgtttttggttaactgagaaatctccaaaatgttttcacatcagctaaactaatttccattcccaccaacagcgtataagcattcccttttctctgaaacctcgccaacatttgttattttttgactttttaataatagacattctgactggtgtgagatggtatcttgttgtggttttgatttgcatctgtctgattatctaatctcctttaaaagcttcctacatcttcctgaaaatatatattgcttgattaattaatttatttatttttcccttccctttttcacaaaggattgctggctgcttatactaaaaccacatattattaaataaacaacaacaatgtaaaggacacaaatgatgcaaattaatcatataaaagggacaacaattttgctgtgactatttttcttactgtcatttgagcttcctagcagggaatataaaaggcaagacacagtctccaatgcaggactcaacataagataggaagatatgttaattgctgatttcattaaattttatccagccggttcattctaatgcctctgttttttcaactgtgcaatgaagatcatgcctaccttgtagagctactataagtagtctgatagttcagtgacacatatttcagtgtgctcatcacatttatccaagggtagcttccgagatcaccgtcagtttcacaggaccttatctatataaatgatgatgatgatggtggtgatgataattatggtgattacagttagcacttattggtaacttgtaactgggaagtatggtaagtattttcttggcttacctcatttaatcctgaaaacagctctatacagtgggtacttttaaaatgtgcattttgcattgaggagaccttaggctgagtgacttgatgtccacacatataatatgaatctgctatatgtttatatatatagcatttgaatttgtgtatttgaatttgtaatgataaatatgggagaattaccctgttttcttacctcctctcactactgcaacttattaattggacgaaatatgaaagtaataaattcagaagagacagagagcatttttcaatgttcattatttcagtaaaatataaacagctcacagagatatttgaaaaatagtgagccaaacacattcatttcatttttccttgttcttcttttagaataacaagcctagtatgtctctgaaactttttgcaatctatccggttataatgttagcaccaatgtagccataagtaatttttttttgccaagtttgccctaatgcattatatcatttgagtgcatgggaagatattagcgccattaaaaatattagtaaaactgatttcagttcaacaacctgtacattgaagttgttgcatttatctatttacatctctctgttctgtacaaaagcagcaacttaaacgatgtagataaataatagtgacattttatctccctttctaaagttgaattccagaaggtaggaaagatcctttcatgcttacattaccatgacaaactgaaagagataaatccctaacggatgggatgagatgtgggagttagaggattaatgcttagatgcttcctccaatttatttctcctattatatgtgttaaaaatatataccatatgtcatgcagcatgttttaatcccatcaaaatgtctcacacaattccttaggggatatgctttttgctgccaagttttcaccgctggaatgctgacttactattcctttgcagagagcttcatggtttattttatgataacatgttgttataacttctctggctgtaatttttataaggagaattagtcccgggggaatttattttgagagtcatatgcttaatggtgacagaaaaggagagaaatatttccaaaaagcaatgtatccttcagttgttttaatagaacagaaattcctttgacaacatttgtgaaagcctttattatacccagcatttaaattcagtccttgaaatggggttttcccggatcatttgaaggtcaattttggaatagttcttgtgtcctatgacacctttcaatgatagcactttacagagaggaacaaatttaaggcaaaaagtctcttttagtgatactaagtatacatgacttatagcaggtgacaaaaaagctgcatataattgccctagggagaattttctttgtgccacgttgtcgctttaaaaaaaaatgcatgtagcaaaatttcacatgtaccccataaatatatacaaatataacatatcgaacaatttaaaaaatattgaataacaatgtgagcgattaggtaaagaggacaacttgaactaattttcacgtcacaaaaaaacaaggttaaaactttacaccaggaattaacaacatgttaccttcgggttcctctgtgtgatgttttagtttgaaatctcagtatccttaaagttaccatttgttttatacgacattgttcagctaactcatgtaggctagggcccactctggcccccaggtatatgattttcaccaatcagggatcactacaagatttacttaagtactcaaatataataaagccaaagttattatttagttttttttttttagaaattaagttgctccgaaatgtatgcaccctgtttccaatcaagccttctaattgtaataacattcccccacagaggctctgttagcatttatgggctatattaagaagaaaaaatacacacacatgagcacaattccagagatgccctttgggttttgctttccttattggaagatataacctaaatggatgtcaggtgtgcaaatagactatattttttttgttccataaaatctgctgggcatggttcaaatgctgtcttttaagccctttgatggtacttaataaatgcagggatgcaaactgaggagttacttgacacatcatcatgccattggcagtatattgatggtaaatatgaaataatttgtttctcccctccccaactctaacctcataagtttcacacatatcagaccttagcttctctttgtcagactcaaattggatttccttttctatcatctctaggctcagacttcgatgaccctaatttggcagctcttcaaggggtttatggtgtaagccttttctatttctaacaaaaaacacagctcaaatcctcttcacattagtgaatactgtttgaagtttcattttccaaaagataccatactttcttaactcaatttttaaaattatttttactttttctgtactgaatagttagtacattttaattttgagtgaaaaaaagttggtttgaatagaaagtatgcattaaaattctccataactggatttcgtagtcaaatctaggacagaaataatataaactattttatatactattaaataaatgggatatttatttaagcaactgttatttataatttaggtgctacttctacatttagggatttagtatatactcctgttggccagattttaacagagttcaaatttcttaaatggtgttctctttagcttaaataactatatgtcacaaaaatctgaaaaaaacatataagattaatcatgattttaaaatttaattgatgctggataaatgtaattagaaacaaaatttcaaagttgtattactactagaaattctcatctgatctatatattaaaatatagtcaaatatttaaggttgcctacattacagtgggaaaaggtaaattgaagttgcagcttcttatgacatataacctatacatggtatcatgggtcattttgcttgtttcatttcccattagaggaattttaatgaaggaggccagtaaaatgttgattaataagtgttgatgtgaaatacacttactgggccatataaaagtggcaagcttatgtagactaccccccaccattattatattttttaattctatgagtatggaactccagaagactggaaaccatagcttttatctttttcccatgagagttatttatccagcattttcttcaataattctacaagatataactagagacatagatcctattagtttggtaaacagttataattattacagtagccttccttatttttcacctctttgtcccaattcattcttattaagatttaaatgttggggataatttattttaccaaatgttatagaagacagagaaattaaaagcaaatggctaaagccgacataaggtttcaagagctaactgaggataaaactctaatcgtgcagactttagttgctgtattagtctgttctcatggtgctaataaagacatacccaagacagagtaatttataaaggaaagaagtttaacggactcgcagttccacatggctagggaggcctcacaatcatggcagaaggcaaatgaggagcaaagtcatgtcttacatggcagcacacaaaacagcttgtgctgggaaacgcccatttataaaaccatcagatctcctgagacttattcactaccatgaaaacagtatgagggaaaccgcccctatgattcaattatctccacctggccccgcccttgacacatggggattattacaattcaaggtgagatttgagtggggacacagtcaaaccacaccaatcacgtcggtaagggtgagtcaaatggctagtgttccctcaaaagtgagtgtgctgcaagagggtatatgtgatatatgtatgtgtgcataagcacaatcacaagattaatggattttaataaaagatgaaaaagtattacccagaatactctatcaccccagtttgcttgattgatcaattggcttccggtatcataacttgcattctcatcccacttatatagttaatttttatatttgtaataaaatgtatagacagtaaaaataatatagtaaatatatatattatatataataaatatagtataactgaacgaataaaataataaaatgtatagacagtaaaaataatatagtcaatatatattatatataataaatatagtataactgaataaataaaataatatttttatttccttgcttttatagatattatctccaagaaaatcataggggaaaactttaaactgttattgttggtcagtcacttaatcattaaagtaccctaaactttttttccaacttgaagtcgactttcctaggtatgattttaatggctgcaacacatgccactgcatgattctccattgttgcctttcagattgctgtgattttttttaaaactacaaccaggtacatgcagataatgtcttcaatgttatctgataaataagataatttgtaggcaaaaaataataataacccttcaggctctttataaatgtttttaatctaagtttccaagagacctggaatcaattccatgccttaggctaaattcttaatcttccttggagacatgttcttcctccagacctcctcaatttagtgagtggtaccaaaacccaccctcttgctcaactcaaaaacctggctgcctctttctccctctcccttacccctgctttttgccgttatacgctatcatgtttctttccttctacttccttgcagtggtttccatcacatttagaataaaatccacctttttaaaaaaatataatctacatgctgcccacccctctaacagatcactaactcccaggcacacggagcagacagactctcctgtacatgctgttcatctgtttggaatgttcttctcgcacttgccatgtctggtttctttttgttcttcaggggtcaattttaatgttccatttgcacagaggccttcctagatgacctcaatctgaagtggctatccttcgcttgcataatacctttcctttctttggtgcctttttgcaatgtataatattatttaatatgtttgttggcttacttgtttaaatatctctctttacaactagatatactcatgaaggttgctaccatgtctgttttgtttaccagcatatatgccatgctaatcatgttgcctgacacattgggttatagtggattggactgcttgggtttttgtcctggctctgaaatgtattaactgctgtccttgagtacaaatgtaagatgggcataatgataatacctaccgtgaataaaccaaattattcatatacagttattagcatagtgcttggcacaatatacattctcaatacattgtagttactattattttgttctagtaggcattcttgaaatattttttgaaagagtgaaataatgagtttattttgtgatataaataagtaagtaattacctctttggtatatgagtatgccatttttatcccaatctttattgctttgagtatcatcctttaagttactaataggtagctgggcatggtgactcaccatggtgacccagcattttgggaggccgaggtcggcagatgacctgaggtcgggagtttgagaccagcctgaccaacatggagaaaccaagtctctactaaaaatacaaaattagccaggcatagtggtgcatgccagtaatcctagctactcgggaggctgaagcaggagaatctcttgaacccaagagacggaggttgcagtgagctgagatcgcgccactgaactccagccttggcaacaagagcgaaactccatctcaaaaaaaaaaaaaaagttgctaatatgctaaaaataagaataatgctcatgtttttacttccatacaattgattgttagaggtgaaaccttttcccatctgcacaaatttctggaagacaataaatgtttcttcttctttcattaatattttaactgtggaggtatctgtttcaaaatgtaaaatccaataggtaatcagtgaggaatataacctagattaacttttttttttcaaaataaccaaagcacactcagtttaagtttcatgttaaagtgagccaaatgccagttaccaaaatattggatggctatgtatataatcctttgctgatgagtaatttagcatcaatttagagatgttattttttttctaccagatgctcgaaagcattaaggcaagattagaagtcattgtcccttcttctgttatcagtggtcccacaatatttgtttatatcaccattagaaacaaattgtactgtattatagttatttttttgtttgtccctcctattagagagtgagttcactaagggcagacattatgttttatactttattgatgtggaaagcaggcagtaaagaaagaatgaaggactgattattggacatttgttattaatgatcttagcttattattttcctccaaatgaaaatgttttagtgaacataaactgggaaaacagcaggagcaattcagttaatactcagttaccttgaagaggttgaagcagaaagtgtttgtgtcagttgttttaacataattgccagtaaagatactgaaagtattccctcatgataatgagaaaaatccagaacacaaggcttgattactcctacaatatttgcctgctttgactctgactgtgcttaagtatatccaggcatgctgtgcaaagtacagaactgaaataaaataatccctagtccaatcataggcttacgttactaggataagtcaagtttgtggtttcacctgaagtaagaaagcattaagtcttcttatcacacccaatcatccatattaggcttgggatagaaaaggcactagagacagtagggataagatttagtccagggagtaagtacttggtttcattaaaactaccctagaattggctcaccagtattaattaagtcctttttatttgtaatctcattcatcattctctctctctctctttctctctctctctcccccccccccgctctcatagagcaatgttaaacaatgtacacttctttttttaaagttatagatttctaaatttaaaatgttctgatatagtctagctctccaattagggagaagtagaaacatatgctgctcagcttttctaaaatcttttaaagtaatcaattagcatatgggctaagttcactttagatggatacacacatgcactatatatatatattttctttagacatgttaaggcagtggataaaatttccttttgcaatcctttgctcatggtatattaatgctgatagtattttatgctattttgtgttgatgctctcagcacaaattggccccaaaatattctgtattcaaaagcatgtatttttttcctaagcgtactatgattttaatagaagcagaaatgagtgtttccttcttttgtgaatttttgggagggcatgcttccctgcagtctctggagtgtgtgttgacattttttgtgccatgatttcccataagtaacacactcttttgatagtgaagcagtgagggaaagttgctaagttccatctgtaagaaagcattatcagaagtggaagaagggaaatttactaagttccatctgtaagaaagcattatcagaagtggaagaagggaagtgacaagaaaagattcaaagttgttttgttttagctccagtagatgctttataacacactcctaaaaagagtgtgaatataatatagttaatataaaatttattttatataaataatttataatcttcaaatataaatttgtttttactatataagcaatgtaacattgacctaaaaattgaattgaaaaaatataaactttcttctcagaaactgggttctcaattactctctatgtacctgtttataaaatacaaaccatctagataatcattgcaccacaatttgtatcaaactctgtttcttagccatcctagagtacaatcaatatcattgatcttttcgaaaaaccagcttttggtttcattaattttctttattgtagagttctgtttctttaatttttttattattatttttgagaccgagttttcctcttattgcccaggctggagtgcagtggcgctatctgggctcactgcaacctccgcctcccgggttcaagcgattctcgtgccccagcttcccgagtagctgggattgcaggcatacgccacgacacccagctaattttttgtattttagaagagtcggaatttcaccatgttggtcaggctggtctcgaactcctggcctcaggtgatccgcccacctcggcctcccaaagtgctgggattacaggcatgagccaccacgcctggccctgtttctttaatttttagataaggatctacctttaacttatgaatataatatataatatgaattatgaatattatgaatataatatgaattatgaatattatgaatataatatgaatggcattgttgtagggtgataactattttaattcaccttcttgaaatagataacatttggcttttggttagattttagatttatctgttaatgttcagaaaaagataaaagataaatcatggaatctttttttttatttttttattttattattattatactttaagttttatggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccagtttcatccatgtccccacaaaggacatgaactcatcattttttatggctgcacagtattccatggtgtatatgtgccaccatccatggtgtaaaaatgctcaccatcactggccatcagagaaatgcaaatcaaaaccacaatgagatactatctcacaccagttagaatggcagtcattaaaaagtcaggaaacaacaggtgctggagaggatgtggagaaataggaacacttttacactgttggtgggactgtaaactagttcaacccttgtggaggtcagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaacccaaatgtccaacaatgatagactggattaagaaaatatggtgcaaatcatggaatctttaaaaaagaaattttattcctgtgttaatgtgtagttttaaagatttgtttaacagtgtgtactaatgaagcataatagataccaaaatgttttcattaggaacaaaggtcaattgtgcgagaaggagtcaccatttatgacctgacaggttgaggtaatgcaggcagggtaagacaatacatgagtaagcaagcccccctcccaacagtagtcatcattaataggaactcactgcatttagggttaacagatatatgatgggtttgaaaattaccaaagtggaacccagatggatatgtagatttcagtatcattatatacttggaaattgaggaaatagtgtagaaaaatacataaactggaaaaaatcttatcagtcaagaattaagttctagggacttgctttgacctctcattcattcctttatggcctcttaatttctctactttttctaagcttctctctgcatatatcttcactcttatctccctaagactagctttctctacttattcataggttcctccttatcactttagattacatgtggtcatcacaacttctttggccctaagtctaccttaagccttttgtttatactcagaaaggaggactctgattgggctagctcatcttttctaatgaaaccaagagataggttacttgcctgcataggacttggctgcccttggttaaggggccatcatagcaccaatcagtcatgtctggtctggccatggggatgcataaataaacaaatggtcttacctttccaacctcttcctcaatcactacctaccctaggaccacaaactctatgttctatccaaaccactcttttccacagatacctaatcatttcactattcacagtgttaacctgccttttctcacttcttgaaatttccatcacagaatgcatgattaatctcaaagcctcatcccttgcatgtccccatgaagtactcttttactttcctaggaaaagttaacactctgatagtgctttgtttatgattgaataaggtcacttctggtattgtatttccactatgagagtgatgtacatgaactattgaatataaaaacatacctttgataccattttgttgtatagtttataaaagaaagctatgacaccatagggttattaacattatattacttaaagtagtggtaaaaacaacacacatatacacacacaaacacatacacatacatagcacagccagacttggcattctaacatccccacacatgagaactatcaaagtatcatttctgagctgcgttgtttttctacttgtgccctatttctaatagtggaagaatttttttttaaagcaaagctgttatcttttaaacactggaataaaaaaaaaattccattttctgcatgagtcagttttttcagtgaatattttcagcaaatgaacaagctctgcattaaatccatgctttgttttagtagtttccttgggtggactagtttcaccgaatgccatgtgtaaattggtcacatagaacaagaatttatatttccacaattttatttggaactttgaaacttccattatctcacagaacccagaaattgaattgaggctttgttactaagccaggttgtagcaacagacttaggagtcagtagctcaattttctacttctttgcatcaaattttctcctgagaatgatgcatgcaatacagaggaatggcagggaggagcctctgtgaagtgttaaatgtttggttcactgggtcctatcagcaggtagggcctgtggggagcttgtttatccagcagaacaatctcattatgaggacagtgatgtacaatagtttgcttcataccccaaaaccattcaaggaaacgactgagtgaatgatatttttccgggccctgtattatgctattatgacttgcaataactggcagcatattaaaacagaagtcagggactacagttactctgttgaatgaagttctgaaatttcaaaggtgttgattattcagtattttccaatttacagaataaaagagtatgtgattgactatttcatggcgcagtaatggaaataaagaaagagaatgaacaggcttgattaatttcagagtaaatgcttatttttcataattgcataattctcaagtgggtctctgtgtagaccggggtggccttttctgtcaaatacaaagataagaacttggcattgaaaattaaggaacaataaaaaataaatatgtgtgcatgtgtatatatgtgtgcgtgcacatacccttgtcatcactaagggcaagccaccacacagccttggttagctttgaaaatatctatgaatactacattgaaaaaataaagtaagatttgggacaaacatccatcttcctcatgacaatatgctgggaacagctgtaagcttagaataaagtggggaaccctgcttaatgcgctatgcagtaagcttatcaaatctcagcccagctagaacagtgccctaggatacaacaggcaccttgtaaatatctgttgaaataaaggatgaatcagtgaacgaatcaatgaatgcttctgtccagaagtgacacagactaaatgctgtaaaatcattcatcctctaaaatttcaaatattgttggttgtctgaaacatattaaaggaaagggacatggtatgaccactaagtgtctgaagtcttaacttttgaaggatgcatcaagaaacccagctacatcttttcggtagaaagtagctaaagaaaggattctgaattggatgaaccatgaagtcctaagttcctctttaaagctatttattaaccatacaaaaacatactttcactcactgagaatttaaacttttatttaaatattagtgatttactgcattaagtgttatcatgagatagcatctgctaggccagaaaattcatctagttttgagtttaatcgttgttaatatgcagactgtaaagataatctcactggtaaaccagtgataaaccagcacttgatgatcttttaattgctaagtagcactgaggcagcttacatttggctttggatttagtagatatttatattaacaactggccagtacagcttttcacgtaagtacttcacctcaaatttatcaatcctttaaaatatacatgaatttaccccacacccataagctgcactctcaaagataggggaaaataaaaccaaaagcaacaaagattgaatcaatgtaattttctgctgtttaaacataggtttctacttaccttgattatttaaagaatgcctgaaatcatgccaatgaaaactctggaaagtagagtttaaggttcaaggcaaccttctttttttttttttttctgtgctgccatcatctctcacctgaactattgcagtgatcttctaataggtcttctttttgatgtctgtcacctacattctattgtcaaccaagcaggcagagagcctattcttaacagctttattgaggtataattgatatacaattaatcacatatatttaaagtgagcgatttggtatgttttgacatatatataaactcatgaaactatcatcaccacaatcaagactgtgaacatacccatcacactaaaagtttcctcatggccttttgtaatgctctctccctttcgtcactatcccagacaatcactgactcgctttctgccactatagtttgcattttctagagttttatataaatggaatcaaaacagtatgtactctgttttgtctgacttttttcacttggtgtaattattttgagattcatccatgacatgtataaataattcattcatttttaactagtatttaattatatgactacattcatcatttgcttattcacctgttggtaaaatttacattgtttacaatttggagctactctgaataaggcttctatgaacagttgtgtgcacgtgtatagacgtagagttttcttgtcttagtcaaatacctaggaatggagcagctagatgacgtgaagttagtccatttgttcttttatgagttatgcttttggtgtcttatctaagaaacctttgcctaatccaaagtcacaaagattctctcctgtcttttctaaaagttttatggttttatgctttacatttggatccatgatcctttttaggaaaatttttgtttacagtagaatgtatgaatcaaagtttagattttgtcatatgggtacccaaatactccagcaccatttgtctaaaagagtatcttgtctgcactgaattgcctttttgctttgttgaaaatcagtggcaaatatatgtgtggatctatttctggactctaattttgttacatttatctatttttctatcttgatgacaagactttgattatgtttgattagtttgattatggtaactgtgataaatcttgaaatcaggtagcataagacttcacgctttgttctttgaaaaagttattttgaatatagcaggtacttaacattttcatgtgaattttagaattagtatgcccatttgattgtcattgtattaaatctatataacattttggagataattgactaattttttttaaacttctgttttacattcagggttacatgtgcagctttgttatataggtaaattgcgtgtcatgggagtttgctatacaggttatttcatcaccaaagtaataagcatagtagctgataggtagtttttcaatgttcacactcctcccaccctccaccctcaagtagaccttgttatctgttgttctattctttgtatccatgtatacttcatgtttagctcccactttataagtgagaacaggcagtatttggttttctgttcctgcattagtttgcttaggatgatgacctccagcttcattgatgttgctgcaaaggacatgatctcactcttctttacggctgtgtagtattccatgatgtatatgtaccacattttctttatccagtctaccattggtgggcatgtaggttgattctatgtctttgttattgtgaatagtgctgcgatgaacatatgcatacatgtgtctttatgacagaacgatttatattcctttggatatatacccgataatgggattgctggatcaaatgatagttctgctttaaattctttgagaaatcaccacactgctttccacagtagctgaactaatttaccttcccaccagatgtgtataagcattcccttttctccacaactttgccagcatcttttgttttttaacttttaaataataaccattctgactggtgtgaaataatatctcattgtggttttgatttgtatttctctaaggattagtaatgttgagcattttttcatgtgcttgttggctgtgtgtatgtcttcttttgaagagtgtctgttcatgtcctttgcccagttttgaatgctgttgtttgttttttgcttgttaatttgtttaggttctatatagattctggatattacacctttgttggatgcacagtttgcaaatactttctcccattctgtgtgttgtatgtttactctcttgatagtttggtttttgctttttgttttttatttttatttatttatatatttttgccgtgcagaagctctttagtttaattaggtcccatttgtttacttttgcttttgttgcatttgcttttggtgtccttattatgtaatctttgctagggcctatttccagaatggaatgtcctagattatcttccagagtttttatacttttaggcgttacatttaagtctttaattcagcttgagttaatttttgtacatggtgtaaggaaggggtccggttcaatattctgcatattgaaaccagttatttcagtaccatttattgaatagggagtcttttccccattgcttggttttgtcaactttctcaaagatcggatggttgtaggtgtgtggcattatttctagactctattctgttccattggtctgtgtgtctgtttttgtaccagtgccatgctgttttggttactgtagccttgtagtcaggctttattactggttcaatttcagaactcactatggttctgttctgttattgttctgttcaaaaatatggtttctccctggttcaatcacttataaaggcttggtttggctggatatgagattctttgttagaattttttttttaacaattctgaatataggcccccaatctcttctggcttgtagggtttttgctgaaaggtctactgttagcctcacggggttcctttgtaggtgacctgccccttctctctagctgcctttaacattctttcttttatttcaaccttggagaatctgataactatgtgttttggggatggtcgttttgtacagtattgttgcagaggttctctgcatttcctgagcttgaatgctggcctattagcaaggttagggaaactttcatggatgatgtcctcaaatatgatttttctttctgtctttcggggatgccagtgagtcatagatttggtctctttacataattccatatttcttggaggttttgttcattcttctttattcttttttctttatttttgtctgattgacttaattcagataaccagtcttcaagctctttgctcagcttggtctattctgctgttaatacttgtgattgtattatgaaattcttgaagtgaattttttcagctctatctgatcagtttggttctttcttaacatgtctattttgccttccagctcctgtgtctttttattgtattccttagatcccttggtttgggtttcaactttctcctgaatctccataattttcattcctatttatattctgaattacatgtctgtcatttcagccatttcagcctagttaaaaaccattgctggggaactagcacagttgtttggaggtaagaaaacagtctggctctttcagttgccagagatcttgccctggttctttctcatctgtgtgggttgacgttccttcagtctttgaagttgcgtcctttgaatggcactttttgcttttatcttctgtgatgccagtgggggtttgtttgtggtataaggtgggtttcaactggcctcttttctggaagattttagggggccacggctcaacacagcactcctggactgtgtgttctaactctgagggacttttaccgggcccctgcctttgctctcgagccccttgaagttaagatcttgctgtactggagggacctaagtgttcttggtccactggccacaacacgctgttggagagtgccagccaaagcgctttgtccagtggtagcagtgggatctgtgctcactcgggtgtgccagcagccacagcatgtgtggtagggtgcacatttttcagctgaggaggggcaccagtgggggcagggttgctgtcatctgtgctagcatttgcacctgcagtggtgggagtagggcacttgcagaggcagggtttcctgtgcccatacacagattcacaccggtggtggcagaagcagggttggtagcatccatgcgtgtattcgcactggcaggagtgggggcatggtgggggtggggttgccagtgcccatcaaggcaatcttctatacttgaatttgttaatcatttcacaatacatatatatgtatcttaaaacaaaacatcacattgtatgccttaaacatatacaatttttatttgtaaattatgcctcaatacagctggaaaaaaaacacatgcaaagttacataaatatccccatgattttttcctcaagttatcaccccttttttcttacttgagtctgagagtgtttatgaaaatgctatgaaaatgaagaagtactaaaccgataacatggatggatattattatatgtatgacaaaaatgagaaggaaaggtcctgaaggaggtacacagatacatttttgtaataccctgaacaaaatgcagtatgtcaacagataccaatcataatagatatatgattacacatatgaatgtagattaatgcccaaaacagttgtatgtgaagctaatctgtttacaatatattatatatttcatgagacttctctgataaaaatagacttggcatcacttaaaaaatggttctaacctttttaaaagttctcacttagaaattcacttggcggagcagtacacaagctgtgtgtgtctaattttcctctacaatctctgtaagaagttaatcaaataggcaattaatctgtatgatattattcatgtgaaagcatatgcatattaaaatacacaacagacttcattcttattttccttaaatttttctctaatgccaggggcttgaatgtccagcagagctcacaatatgaaaaggatacatggcagtgcttttgttgcacataccagaaagtacaagcaataacgttctgctgtataaacacctgtaatgaaggcagaaaatgtgtagtaagctaacaaacaagactttgaccccaacaacacttatctctcgccttgaatctgcttttgctcctcatttccattaatagtgccacaatcttctctggaatcctgatttgaaatctcagagtcatcctagactccttctcctccttcatctcgcccttctgatcaatttcagcatcctgttgattctgactacaattcttcccacatttccttgtcatatcctttgctacttcttttttttttttgtaacctctattttaagaactttctgagttgtctccttactcctagctatccccttccaatccatccttgatattgtcctgaaagtgatatttctaaaatgtgaatcagataataacacttcgtttgcagacatttaccactgtcaacattggttttagcagtgggtttcaaagtgtcatccctggaccagcagcatcacctgctttgtagtaactactttgtagtaacgcagatccttaggtcccaatccagaccttctgaatctgaaactctgagaggggagcacaaaactctgtgttttaaaaagtcctccaggtgattctgatgcacacgaaaacttgaaaactacggggctacagaattaagttcaagttttttggcatggtgtcttgccaaacctgtcttttctgcacttattttcacctccttacactcttctgtactcctcaccactccactatttcagaaccttaccatatactgtcctattaactgggataaaccattggcttgcaattttctcttccaaattatcaggttttgaacgaagcacatttttaatttcatctctttcttaaatcctttttgatcttcctagacatatttcctgctccattatttcatctgtgaaatggaaaacagttctgggttgagaggtaaaacaaacttcttgctttgtgtttcctcagtaatgttatctttgctctcagaatttattcgtttttcttgtgctatacatggtttttgacaagtctgttcccacttatagatgatatcttcaagggtgatgcaagtctcagtaatctttgtcatagaagagtgagttgcacatcatatgcggtctataacatgttgtctcacaccaatatatgacttgaactttaatgcatgattattttatatgttcattgctgaaaacaatccattagtccatttgggattgttataaaatttaaagaccttttgtaacttactatcttgaaaagtgtaattctgttcttttgtctgctctaaaacaaaaacaaaataaaagtaaatctgtgccttgaaccctgttactttctctttaaaggatcaatttgctggctgggtgtcctgccatctaacaggccttccctgtgaggctcctctaaattgggaaaaggattaaattttatcagtgtttgtttggtctgttgctcatcatgttgatatttaatccagtgtccaacaagtgtcccaaaggaataaaatgcctgaagctggcaatactttttgacctatctgtctgaacatattcctatcagtttttacccaaatagagggttttccaggagacatacatgagctaaataaacaatataatagtaagcttaattcagtaaactatgtttaatatatcaacaaggatttattgagttctgaagtacactcaattttgtgaaatcaaattattctgagttagaaaattgtatcactttgcaatattataaaggaaaaatgcatactgctattttttaattatcagggttaaaaatatctacaaacaatagttataagcgattgtgttaacaccaaagatatacattttcaatactcatttaagtgaacagttatttagttaatcactaatttattcaacacacatttattgattgcctattgtgccccaaatatatatagatatggaaatagctctaaatttataattagagctaaatgaggtttttttttcttttttaaagatagggtcttgctatgttgcccagacgagactagaactcctgggcttaaagaatcctcccacatcagccttttgagtagctgggactacaggcacatgctgctgggtccagtttgagatttagatatgtagatgatagatacatagatagataaacagatagctaggcagatatagaaatagagataaagatagagaaagatagagatagatatagagatggcgatagagatacggtaaagtcccacttctcagagtacaccacacttcagtgatcaatgaaatacatgtaagcaaataatgatttaatatgatacatgctaatgaaagtatgtattaactaaagaacatagggtaactaaatagtcaaaagaatgaaaaaagtcttcaaagtcaaagatggaccatatgtaccaagattttacctatctgcatcagtttcttatgcgaaggctaataaaagaaaataagaatccagattttcttgtaggatgacgtgcatctgtttgtgtttgctgaaatagcagggctttttctgctcctgttcagtgtgggaatggaaagcagaacatcccctgtgttccatgtactgtgttaggtactttctcatgtcacttctaaacactaagagaagtaaaaaaagaagattcaaaaacaagtcttaagctgaatttacttaatgcaaggcaggaataacatgatcccacacagatgcatgggaccttcagattaacagttaaagaattgttcagagaaaattaacctaaaacattgaggatttgttcacatatagacacatacaaggaagagcaacccttatgaagactttttctcaggccgaagtcaagtgtagagctttaaaaaggcaaacttagaagtttgggtttgtttgtttgtttctccaacaacaagagttgctgctgcaaagtgagagtcgctctccctactttttagttattattccaagatatctatccaagtagacacaggttgagtatcctttttttctgaaatgcttgggaccagaagtgttttggatatcagatctttttcaaattttagaatacttgcatatacagtatataatgagatatcttggaaatgggacccaagtctgaacataaaattgatttatgtttcatatatagcttatacacatagcctgaaggtaattttatattttccttggggatgctaaataaattgtgttctgtgaatctacattttgactgtaacccatcacctgaggtcaggtgtagaattttccatttgtggcatcatgttggctggcactcaaaaagttttgaattttggagcattttgggtttcggattttctgattagggatgctcaactttactttaaagtaacataatttatccttctataaatatagtattttgttttcatattagtatgcaacatgtataaattatatcattagacttttttgaaagaattcaaacttcaagtttgttaccatgaacatatttttagcttttacataggtagtaacagtgacttaattaaaaatactttttctactcttatttgaatatattgataatagccaatatatgtagttttcttcatagtacatcagtagtgaaggaattacttctgaatcttaattccattactgtcttcatatatgctcccagaactttatgagaggtaacaaaaatgaatgaatatggtacttcttactcccactccccaatgtaacttcatggcttccttcataaactcccattggctgtgaaagaacgtgtactgcagagatatgttgaactggagtatttccatagaatcctcccatcagggaaggagagtaccaatagcaaattttctgagagagacttacagaagggtattttattccgaaagggagaaaaacagattaagtactaccagcatccacaattacctgatgataattttaaaaaacaataacaataaaagttatatgaattacatacaattaatgtgtactgaaatcaacagtgtctagaaatatgcttttggaatgattgttcccaagccaacaaagcttgtgtgctgaagtaagaaaaaactgaatggatcaacagcaattctgttcatcaagagttagattttaagttatcacatatccttttaagatttgaaaagtctcactacacaaggttaaaaaatatactttgtggctatatttttaaagtctttattcacaaggggatacatactgacgtatttggggatgaaatatcattatgtctctaatttcttttcagctggtttagaaacaataatacaatatagaaggtgtgagagagaacatgtgtgcagatgaggcaaaccgttaacaaaggaaaaaaatatatctccttcatcacttctttcatttagtaaaatgttttattgtaactattgaagagagacataggtccatcatttgtttaaatgattttatgcaggccgggcttggtggctcactcctgtaatcccagcactttgggagaccaaggtgggcagatccgagatcaggagtttgatgccagtctgaccaacatggtgaaaccacgtctctactaaaaatacaaaaattagctgggcatggtggcgtgcgcctgtagtcccagctagtcaggaggctgaggcaggagaatcgcttgaacctgggaggcggaggttgcagtgagccaagatcgtgcctctgcactccagcctgggcgacagagcaagactccatctcaaaaaaaaaaaaaagattttattcaaataatttgaatatgccttgaactgttctttatagtgtttaccatcttttcccaggaattattgaaccattttaagtttattttttaacaggatgcatttagtttaatggtagtaaaacctcctaagccatagatcctccctctgtttccatattgaaatgaacaccaagtgtctctaatgtcgtccaaagtgccatttcttcattttgcctctaacttttctttggcacatgacgttgaactgtatgaaacttttttcctgactgatatttaggtatggaataagagtaattttcaggaatatttgtgattttcttccaacattttctcagaaagcatattctgaaagtgtgtagtaatatctatatgcattcccaacacaactctctctctattctcttgatctaatttgttactaactttttaaaactttctagactaaatctttttgcttaccttcaagcattttgttttatactacaaatcttctgagactcgaataattttatcttactgtttatatactgctaacttgaaggtatttcagcctttttcactagcagcgataccctccatgacagatagtcagttatattaacttgattctattgtaatttacatagtggtaaaacaaaataattttacacttataatcaaaattataactgtttaaaaaattaccacctaggattcattttatgtaatgggaaaatatacaaaactgttttgataaatattatatgcaattatataacttggacatctctgtgtagttttttcctcctgtttaacgtggtatgccagctctacagtagtcatgacaggaattatgacaatgactcagacattgatggtgcccaccaagcttccagcatatttactctagatagtacctcaatacagcccttttgtaaaaattttaaacccaaatttggtaattgaaatgaactaaatcaaagaatgctgtgaaattgacacctttattaaaaaacaatatgtgacagtagggagaattaattctaggttcagataaagctgggtgagaaccccagcactcacccttattagctggcatggagtttcttcaactgtataatttggtaattcagttgtttattttgcttatttattcatgcattcattcatttattcatttagtaaatgtatgctgagctggttagcaggcacaattctaggcactgtggctaaaaagggaagtgagaaggacaaagtccctgctctcaaggggtttacattcaaccggggagacagaaagcaaagtggatgcataatataacatcaaatagcaataggtcttgtgaaaaaaataccaaggcatactctggatcaagtgaccaggatgggaaggcaaaaggcctctctgaggaggtgatatttggcaagaaagaaagagaaagccatgcagatggttggcgaaaaatgttccaggcagagggaagagcaagttcaaatgcctcagtttatatttctgtgaatagtaaatgaaagtttatagactcctggcacatcgttaagtgcttattagatgttagatataattttaagataataaatgtggataattaattccacgttattatgtgtcttctttgctgtaatgtacatcctccttttcatctagaccatttttcttctcttgaatattatattatttatcctgttctcagagctgttagattgccctcttattaatttgtagtgactttaaccctgcttgcaatattcaaatgttattactgtcagaggtcctgttttctcagtctttgcccttttgctcaacatttgtatactctgagtaatgccaaattgattttcttgctaagtgttgggcaactgccctctctaaacagtaaaattcacaacttctctgtgatgatgataatgttgatgtacctgccctatggggacctgttgttttgtatgcatgtgcagggagaggggtgatcaaaaaatggtgtcaagatgtcatttggaagatggtacctgcagaaaacacagaaaacccaatcataccccacccccatcctccgcatttcccaccatggtttcttgtttacacttctccgattctcccagaagtcagagcaaagtgactgtttacctctgtctctggctgggaaaaaaccactcccagagctcaactcacttttattgatttctatattgtttggctgtaaaacatttattctcagttgtatcagtttgggtccagttagagaaaaaaacacagtcatttgaacagtgaaagtttttacaaataattattaaatgtaacaggggattatagtaatgaagggattggctagcataaaagaaagatgtattagtttgctcaggctgccgtaacaaaatactatagactgagtggcttaaacaaaagatatttctttctcacagttctagtgactgggaagtccaagatcaaggtaccagccaatttggtttctggcttttggatggctaccttcttgctctgtgctcacatgatctcttttttgtaatcacgatggagagaaagagcaagctctctggtgtctcttcttataagggcactaatcccatcaagagcctcgttctcatgaccctcctcatctaaccctaattacctcccaaagaaaggcctcatctccacgtactgtcatattgagggttaaggcgtcaacatatggattttcaggggagggcacaaacattcagtctatagcaaaagagaaccataaataatagaggaatggctaccattagccctagggctgagatagcacacctgagaaaaagtccctatgttttcatccccaaagcagagatccgcactttattgggaaggtacaaccatagcttaccgaatggcagaaatcgctaagttgctataccagcagaacttgtcagaaatctgtcttcttcaagttaacagagaccctccctctaaggtacctgggaaacatcgccaagctgctggttgccaagcactgtaggagccaggtgctgaagaaggcttgcacgctgtaagagcctgccaagtgagcacattgaaaataggaagcaaatccctttcttcctgaaatgtctcaccagtgccctctccccacaaagcttcagtgccagctagttaagaaaaacatatctcaaaggcccagatctatttttaccgagcaggcagaaaggtacatttagaactaagaggcaataaatcaataaccagcacactgatataaacaaataataaataacagcagaagcagactcagtgaagaatatattgtttgttagcagagtccactactttgcagggccattctcagtttgattcattgctatgtgctctgtgcctagaataaaatctgacccaatatggatgctcagtaaatatttgttggatgaatgaataatctaattgcttattttttttgcctctaatgtttttcctctctttctctgtctctttttttacgatagccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcaggtatccctttaattctattactgctgaatcaaagaaagcacaggctgctttctcgtacttaaatgttgctgctatctcttttgcctaaagccgttgtctcaatatttgcatgtgttgctgctttctaaaatttagaatcaaaatcataaaaagatgggattggaatttatattagacattatttctagcttatggagaaaagcgataccatctgggtagctacttatgttaccaagaattactaaaaactatgaaataaaatttatacaggaagtaaaatggtgcaaataaaatgtaagcaaagacttgcagaaaggatgcatagtttcttgctaaatgagttgtaacattttgctattgcccttcgcagacagatagagcatggatacttctggttcacacacatttgcaaagatgatttaggtaatgtgtgtatgtgcacagggagaggaagagagaattaccatgttagagaatatgaaggttgtgttccagattgctttgctaaccaaaacttctgggtcaatacaaaaatcttcccaagtctttcagggccaataccaaagttaataacaaattcagttcctgtatccccaaggatacccaccatacatctacacatctttgtcagcttctggaagaggtatatgcagtttgtttaaagataatgcattgaagcaatgcccatgtaacacattcgcagttaaaaacctcagtttaagcatttagcccctcatagattgtgaatcacatccttcatgaatgatcatgtatgtcattggactattagaacattagcgaagctgggtatagtcatatagagggtgtgtttaaatctatttatttggctttctgtatttgggcttattcagagaaataaagaagaatctaaagtaatggattcccataactcagagaaagtctcagaatcacctagtgtctttttcaaataaaaatttaccgctcctgaaatcctgatcagcagctaacactcctctgtcataaatatcatgcctccctctcaccgtcatctctaataattacctgtaagctgagccatggctacgggtgtgctaggacattgaaataggtcaagttgcataaaagttaaacagaaaggtatctttctaacactagcaacatatattatgttagagttaatgttggaaaatataaatgaatataagtaaagagttgtgcttgggaaaaatgcctaagggattttcaaagaacaaatgcatctggccgggcatggtggctcacgcctgtaatcccagaactttgggaggccgaggcaggcagatcactttaggcgaggagttcgagaccggcctggccaacatggcaaaaccccatctctactaaaaatacaaaaaaattagccgaggatggtggcacgtgcctgtgatcccagctacttgggaggctgaggcaaaagaatcgcttgaacccaggaggcggaggttgcagtgagccaagatcacaccactgtactccagcctgggcaacagagcgagactctgtctcaaaaataaataaataagcaaacaaatgcatcattcctttggcaactcttcttctttctcttagggtttactaatccttttatgattaaacataactcttaataaaagtagaggttttgtaggggtacagatcaataactgtcacactagtacagttaaagaatactgtttggactagctgttcccatttgaccaatagtaattagattttaatttcatatctgctgtgtttctttttaaaaatcattatttctgattgttcatgcatgtcgtaaggtgattcttcaagataggcaaatgtgtgtcctcatttatctgacattagaattgagttggatgtccatagtataatactacatttcgtcacttattattgatggaaaaataatgatgtgttcacattagtaatctgaattttgaaaacactgaggttgcaattctctgatgtatttaaatatacactgtgatccaatactctgagaaactgcattaaaatgcctctggaagggctgggcaccgtggctcatgcctgtaatcccagcactttgggaggccgaggtgggcagatcacctgaggttgggagttcgagaccagcctgaccaacatggagacaccccatctctcctaaaaatacaaaattagccgggcatgatggtgcatgcctgtaatcccagctactcgggaggctgaggcaggagaatcacttgaacccatgaggcagaggttgcagtgagccgagatcgcgccattgcactggcaacaagagccaaactccgtctcaaaaaaaaaaaaaaaaaaaaaaaaaaaaaaaagcctctgaattaccagttgcaataatgaatgaaagattgaaaagtttccaaaatgatgacacttgccatatgttcatatgtctacattttaataaaaggtgaaactaaaagacaaatactttaaagtttatgtgtgtcaagtggcaatctagagaaagggataaactgcaggaagagatacttttgtcactgaaattcaaatatgccaatcaatttgaagggagtgttgttacagctttcttttccaatttggaaaggggtactcaaaagtctttacaaacagcatttgaaatagcacggcttggtgttgacgtgagaggagctcaagggctgtcagttgagtcactgacattttggcatattgttagctatcaggccactaaactgtcaccattagtttttaaataatccacttgcaaagaattttagaggcttgaaaatgttagcatccattctaaggttctagtctttctgataaatattctgagtattaacttgtcaatgaaattgtttatcaagcttttcatatacaactaatttccatttacacttaaatatatgcaattaaatggcatacataatggaaacacctaagactcctatcattataatgaacaagaactttcttatttccttctttaatatctattttggacagaataataccacacaattctttgctccatacttactggctctttactcagtttactcattcttaaatttatattttattttttacatgaaaaagtgaatgaaggaaagctatgtaacaatttcttttgtcttattttatggccatatataaaaacaagtttactcttaaaaaaataaaaatttggtggccaggtgtggtggctcacacctgtaatcccagcactttgggaggcagaggcaggtggattgcttgaggccaggagtccaagaccagcctgcgtaacacagtgagaccccgtgtctacaaaaatgaaactgtttaaaaattagcctggtgtggtggtgtgcacctatagtcctagctactcaggaggataaggtgggaggatttcttgaggccaggagtttgaggctgcagtgagctatgatcacaccactgcacttctgcctgggcaacagagcaagaccttgtctcttaaaaatgaaatgaaataaaataaaataatagttccgtattcttgacctccaactttttaattccccttttcatagttatgccctattagcagtttcatatgcaaagctagctggtatatgtggaagcattccagtgccccccaaatggtagcatgctaagttatttggcaccctatttttaattaaaattttatttttgagataattgcaggttcatattcagttgcaagacataacgtagagagatgccatacccagatttgctcggtggtagcattttgtaaaactgtggtacaatatcataatcgggatattgacattgatacagtcaagatacaaaacaatgccatcacgtctcaagggcccctcctattgttcttttatagctacatccatctctacccaaccccaatcccaaacccctgtcaaccactaatctattctttatatttatagttttgttaatttattaatgcaatattaatgaaatcatacagtatagaaccttatggaattggatttttcactcagcataattcctttgaaatccatccaagttgttgtacatatccatagttcattcctttttattgctgtgtagtattccatggtatggactaccaccatatttattcacttgttgaagggtgtctctattatttccagtttggggatattaaaaaggaaacttctatgaacattcatattcaatttttggtgaacataagtttatttttctggaataaatgcgcaagagtgaacatggattgaatggtagttgtgtgcttagttttatgagaaagaaccaaactatttttcaaagtagctatagcatctgatgttcccaccagcaatgtatgatttctccacatccttgcagcatttgcgattgtcactacttttaattgtagccattctggtaggcatattgtgataactcattatgattttcatttgcattttcctaatggctaatgattaaaattttcatgtgttgatttgccatctctcttcttgtcagtaaaatgtccatatttttgtacattttataattgaattatttatgtcctcctcattgaattttgagaattctttgtatgttctaaatattaattctttttggagatgtagtttgccaatattttctgactgcctgtaggttatctttttgtccttctaacagggtcttttgcaaagcagaagtttttaattatgataagtttcaatttgtgaatttttccagttatggaccatgcttttggtgtgaagtctaaaaattctgccaagtgctaagtcctgaagatttttccttgttttattttttatttttaagatttaaaaaattgttaaaaattcagttgctttacattttacatttaagtctgtaattaattttgaattaatctattttttgaagaaatgcttattttattttttattttttatttttatgtatttatttatttattttaagtcctggggcacatgtgcaggatgtgcagatttgttacataggtaaacgtgtgccatggtggtttgctgcacctatcaacccatcacctaggtattaagtccagcatgcatcagctatttttcctgatgctctccctcccccagcccacctgcccagccccagcaggccccagtgtgtgttgttcccctccctatgttcatgtgttctcatcgttcagttcctacttataagcgagaatatgtggagtttggtttcctgttcctgcattagtttactgaggatactggcttccagctccatccatgtccctgcaaaggacctaagctcattcttctttatggcagcatagtattccatggtgtatatgtaccacattttctttatcccgtctatcattgatgggcatttgggttgattgcatgtttttgctattgtgagtagtgctgcaatgaacatattcatgcatttatctttataatagaatgatttatattcatttgggaatatgcccagtaatgggattgctgcatcaaatggtatttctgtttctatatctttgaggaatcgccacactgtcttccacaatggttgaactaatttacgttcctacccacagtgtaaaagcattccttttttttctgtaacctcgccagcatctgttgtttcttgactttttaataatcgccattctgactggcgtgagatggtacctcattgtggttttgatttgcatttctctaatgataagtaatgttgaacgttttttcatatgtttgttggccgcttaaatgtcttcttttgagaagtatctgttcatatcctttgcccactttttaatggagttgtttgtttttttctcataagtttttttaagttccttgtagactctggatattagacctttgtcaagtggacagattgcaaaaattttctcctattccttaggttgtctgttcactctgatgatagtttcttttgctgtgcaaaactctttagtttaattagatcccatttgtcaatttttgcttttgtcgcaattacttttggcattttcatcatgaaatcttaattttgaattaatatttatttcaggactgatgtttgtttaggttaagtcttagttttatggggttggatgtccagttgtcccagcaccatttgttgaaaaggctatgcttcctccattgaattgcttttgcatctttattcagaatccattgagcatatttttgtaggttaatttctgtgttttttattccatacctttgtctatccctctgccaataccaaactgtattgattagtatagctatatggtggtgaaaatatcaactagagtgattcctcctactttatatgtctttttaaagattgtgtttagctattatagggcctattatttttcatgtaaattatagcataagtttgtctatgtctacaaaaatccttactagaattttgatagcagtttcattaagcctatggatcaatttgaggagaattgatatctttaccatattgagtctcactatctgtgagtacagtatgtgcctccacgtatttaggacttccttctttggtttctttcatcagcatacaaatcctataaacattttgttaaaattttaactaagtatttcattttctttggaatgtttgtaaatgatatcttctgtttaattttggtttcgacatgtacattgttactatgtgaaaatgtgattgatttttgtgttaacattttaaaaacatatttttttcaaatgacatatctataatgtgttatatctagcatgtagttcatttgctcaagtcttgatttttccttttgggactatgtaactcttttttctcattgaaagaacacagtaagtaagcatctatcaaaaagtacttaaagaacatccatttattcactcatgctatgctaatggtaggatttaaaagatttaaagagaagcttttactttcaagtagtttacctaagagaaaataagtgtgtaataaattgctgcagatactatgaaaatagtttagaattcagtggaattctgccgagatagagtagccccgttcctcttaagtcttccttcttacaactaaaaagtctgcatgtaacggcaaacaagcataagaagtctctgaaagatggaagaaatacctctgagaaagacctcagaacttgaagaatgacatggcaacatgtcatgttctcactatcctgtctgctcctcacagattaaggcatgaattcttatcattttttcactttgttccttcatttgaaattcaatattttcattgcctacctgaacaatacatatttatttctggatgaaaatccagtttatgtttactttctttctatctttcctataattacttcaaaaacaattgtttcttctacctattctggggagaaaacacactaaaacttagtgccttaaaacaataaccattttatttgcacgtgactctgcaatgtgggctggactcagctaggtggttcttccagtgatcttgcctgtggtcacctgtggctggagtccactgcaatacagggttggctgagcctgtttctctattatttctgagggcctctccatgtgctttttccatttatctatcaggtgagccagactttttatgtggcaactcagaaagtataactgcttatcaagcatctccttgagtcatgcttactgatgtctcatgagccgagttttgagataataaaggagaagactttacaagggctttgaggtgtggttcattggtaggaccaccaaagtaacagtctaagagtcaacctttgacccttaatactgtcattcatgtccttataaatgcaaagtatagtgaccccattcctaaaacctccaaagtcttatctttctgtggcatcaggattaggttagaagttgatgatcttattatccaagtcagctctgagtgtgaatgaggttcttcctgcttagttccctgaatacaactgctcaggagtggctgctcttcatccaaaactctgtgaactaaaaaggtatataatttggccctcacatagccaacataaatagtgagatagggataacatagctaaaccaaatatccccatttgaaatgggggctgcggataggagatacagagcagtcactggcccatggcaattctaaaattcagctggatacatggcaccagtttattttattcttttcccaaggagagtaaatatactttattttttattttttttattatactttaagttctgggatacacttgtagaacgtgcaggtttgttacataggtatacatgtgccatggtggtttgctgcacccaccaacctgtcatctacattaggtatttctcctaatgctatcactcccctagccccacaccccccgacagaccccggtatgtgatgttcccctccatgtgtccaggtgttcttattgttcaactcccacttcttaattagggctcagttctggttactggaagtggttctctgatattcttgggtccatgctcttcctttctatataaaattaatggcccaggcctctttgcaatttgaactttatcccttttggtataaggtagtatcgttccttaaaatgttgtgaagcttccatgtattaagttgtaatccacttcatgaagcagaagccacacccataaatatcttcaggaaagatgcccctctactttgctgttcaagtcaggatgctggaggacaatgtaccaaagattcttaaatgagttttgcctagctagtcttagggcatgcctcatagaccctcctagctaagaatcttagagtctgccccatagactttcttagctactttctctggatgatggagtatgcattgtataccaaacatattaccacagacatttttccccctcagaatcaatatgaggtgtttgtcaatgagaaagcactcaatacatatttattgaacaaaataatgagtgattgaggttagtgttccttagaataccttgtggaaaacactgctatagacaaaattaaacaattttctgattcctatcattttccataagaaaataaaataattctttttcttatgacatctcttgtctgaaaccaacacaaattatgaatggcttgtcctaaatcatgatttttggtatttcagatgacaattttctgtcttttgacagaatatacctttactgtcacctggtggaaataaaaactaataaagtgttagatctgatagacccaaacaagtaactgctataactgtagtataaacaatttaagtaatttttaaaaatctgtatgatacagtatacttttaatatttatgaatttttatgtaagttatttaaaaaatcaagtcattcttgaatcaaaggatatataatgtcagcattattttagaaagccttaaacatttatgccataaggagtcttcataatttgttcagggcaatcaaagtccgtataaatgttttatatcctacccagtaattttaatgattgtgtgcatatgtgttccaaggatctagtgtagtttcacaatcttggtttcctaatttttaaactatctctcttaattgaaaccatagtatacccttgagaatatcagctataatttataggttataaaaatgcaattaaacctacataagccagtccctttaaaaaaaaaaagtcatatacaagtgaaagtctttaaaataagatttcaagtttggatgtagagtctcttatagataatatatttattttgtaaaactgcacatcaggcactttctgtagttttttggtagagacatctttcttgccatagtaggtttcaatgagatttttcagctggataactctgatgattcttggagatggtgttgaagtttaagccatatttccatgtctgagacacgaagacattttctaatggatcaaactacttttaacagagcaataattagccaaattgctatatttctgggttgtgctcttttcaaaaacaacaaattcaattgatggaagtaaaagccaagagctgtgtgaaatgtctatttgatttactgattttttttaaccatctaggaaatacatgtcttcaacaaaacagcctattttttttttttttttactaagaagatgaaataaattctgctggagtgatcatggggtagtttcttagatcactggattaagaaaagctttgtctaatcttaccaagtcctataggagagacagctttgagaactctttgaaatcaattgtgtcatgttcaaggcagagacttataaattttcttcaaaaagtatcaaattaatatggagtagatagagtactggaaaagatacatttgtaaaataattaggtgcataaagtccaatttgagattttatgtagtcttttttgttttccattttaggtcaaatgaatcaccataggcccttttcaaccatggatataacatgtgtatttatcgtatttcacaaacattactgaaaatctaggacatgacataattggtaattataatgagggaattttaaaaattacaaacaacatatgccaggcaaacaaatcacttacaacccaacaggactttattggtggctatacagggttatactgtgattattactatttgttctttatttgtaaaaaactattctccaaaaaaaataaaatgttaactgctaatattgatgcactaagtgaagagaaattgattaggcttaataaagtagtagctgctgatcagcaaaatttgggataagtgataaggtaatcacttatttgagatcagtgaaaaagaataggaagttaagattattccaggctctttctaaatctaattttgtgtgtggtcctaaagtaaaaaaaaaaaaataaatgaataaaaatctcatggaatgtagagaagacaaaaaggggctgattaaagagcgtatgaaggacttgtgatttgagcagtagtttcaagactaaactcatggctagggaaagtgtaactgggaaagatttctgttaaaaggtttcaggaagactactacaagaaaaattaaataatgaatgaaaacaggggttggcaaactttttctataaagagtaaaattgtgcactttgggaggctgaggtgggcagatcacgaggtcgggagatcgagaccatcctggctaacacggtgaaaccccgtttctactagaaatacaaaaaatgagccgggcgtggtggtgggtgcctgtagtcccagctactcgggaggctgaggcagaagaatggcgtgaacccgggaggcagagcttgcactaagccactgcactccagcctgggtgacagagcgagactccatctcagaaaaaaaaaaaaaaagtaaaattgtaaaaaattttagatttttcaagccatatagtctctattacaactactcaactatgttgtaatagctagacaatatccatacacaagatataaatgagtggacatggctgtgtttcaataaaactttacttacacagacaggtggtgggacggatttgggctgtgggtcacagtttgctgacccctgatctagaaaatgccttgcagctgtcaaatagcaaagccaacagtagcaactgttgttattaacaaagaaaaagctacaatatattcctgataaagcaagtagatcagtgttgttagaaaatgggctttctgtaggtgatagttagaaggatgactgtaaataatggtaaaaaaatgctaagacttcaatgccaagaaatatcaagcagggaatggaaaacagaaagcagttttcctggaagtaccttacaggaattctatgaaaccagagaaattagaaaatggaaaacagacaaggagtgtttacaataaatgaggcataaggcaatggggggcctatgtttagagtattaatggtagaagtgccaaagaaaataaaacagattcaaggtcatttttggaagaaaaaaatccatgagagatgatacttgattggatatattctgagcttcattggatgttgctatgggaaataagtaaaagagacagcaagaggcctatcttaatgcttttcaatacaaacctaaacatttttaccaaaacaactcaagctctgagaaataaaatcgcctacactttaagctattagacagggaaacatgtaaataaagttcccccatcgctggtttgccatagagcatttgaataaataaaggaaggagtttgggggtactttctaggttctctgatggtctgcttattagtctttcccttagatcatcttaaaggcaaaggtgtaactttgcatctttgcatctttgcatctcttattacacatatatgatcactgagatctgaacagagtaaaatcttttgattagttgtcacagtttgggggtggctttgtgtataacaagaatcttagaaataacggtggcttaaacaggagagaactttgtcagggaaaagtccaatatatccaaatttcagagcggatgtattggctgcctaattgtctaggcctcaggattctgccctctatagggtatggtcttcatccttattttcccaagatgaaactctgtccatcatatctacgctattacaagctcgaaggtgtagactgaaaggaacaaaggacatgatccttcccacctttaagaacaagtcccagaggttacttatatcacttttacttacattcataggccagaacttgttcacataactacaccaagctgtagtgatggcttgggtatgtagtttttgttagtaaaacccatgtgcctgataaaaatactactaatttaaggatttcaaattgatttccctaagagaaaagcctaagatagggattcctgtgcaagtgagctatgaagagagtgctctcagaaaaaaacctgcagggaagaagtcaggcagagatgtgttttcaagtctagcttcagcctgatcccacagggagctgtggtgcataaattgcatcacagagtttaatctcacattgaagcaagcctggacatcgcaagtatctctatctgagtggttcttgtcataccaaggtgattatcaagaaaagggtacagctatgggccttgaccagctagtacccacagcagctagagaatgagtacaacagctggtgaagaaattctgggtgggatgtcaaaagcatctgctacactgaagaaggaggacagattttgagggaaaattagtagccatttttgtaagagccaaaagtatcccttcacacatactgagatgactcaatatcctatttctgttttgtacatggttagtactctatcagtatttgtagaatgagtaatgcatattcttggacaaccttctttttttttttttaatttccacagccatcctttaccatttttgaaagtattaagaaatgttaatactttcagtaccaccatacctacccccagtacatacacaagcatcctgccctcaatagctatttcctctactcagattctaagtcacactcacaaccaattgtagaattacctcactggcattctgaagaattagctggcaaatttcctgcattttcaaatattttaagttccggtttccagaaaaattctccttgccctggaaataatagccagacaactatgattagaatatatataacctgcttatattcaccttctttaaatctttggtgaagaataggtatggcttttctcatcggtttgctctggcctagatttatgttggttttacagtgacatttctgactttcaggcaagtatccattgagtaactgttttattatacaaaatctgaggttataaaataaagacttaaatgagcatttcactgatttcattatatctcacaattatagatctggatctatcaattttttctcatgaaggtcccaaaagactgttctataagagccgtgattatggagtgaatgagtcaaatttgaagtctggtccaatggtttcaggaaaatgttttatattgttctaaagccaaaaaataaagaaagaataaagcatcatttcaaagcactatcacaccaggttggattagttaggcttcatattacagaaaagcagcttaagtaagatagtttagtttctcacgtaaagtagttataaggtaggcattcctggacttttatgataatttcaacgttttgcatgacttaggctctaaagctttatgctttgccattctcagcatgtggcttccattcccaatgtcactacgtgctcctaatacaactgaagaactgaatttttaatgttatttaattttaaatagccacatgtggatcttagtctttgttttcaaatagtcattacaagctgtttgtggctactgttttagaatagaaactcttctggatagctcttatttagcctggaatcatgtaatgtaaacatggaaaagattttagatttcactgtaggggttgcttagttttacagataaacaatggaggaagtccaaagaagtattggctttctagaaattcaaaactaatgtttagaaatactgaaaatcgagctggatcttttgatttcttaatcagtgcactcataaaaaataatttattaaaaatattttgtaattgaatttgttgattattcaggtagatcttcctttatttacttaaaaaagtaagattttaatacaattatttttttcaatccattcatttccaatggctaatttatttgaagaatgattgcagcaatctgacaacaaagttttaccccatctactctagatattgaggcttaggctgtgtttctattcttgactctataagccaatccattaaatgataagctaacaattaatttacattaaaacaagactactatttctgttactgtagaagttttagaattagttgcatgtaagttaatgtgattaaattggctaggaatatttgatactgtatctatttaatttattcttttagattattaagtatctattctatgcaagccattaggccagctgttgggagcacagcagtgaattaaaccacagtagaattaagctagaatagaacatgtctcttctggaagtttattctagaaaagagcctttgaaacagtaattacttggatcctaacttttatgaagagaaagaacaaggtgccttaagatcaggcaacaggctggcttagcccacttggtaaatagtctctccctcaaaggctcaacctcttcaaactgaaatctgactacttctgaggttgcacaaaagttccacagactgttccgaaaaaaataatttgaaggaaattcatctccagaacctcaactttcacatgtactcttgtctaaaattgcctgaaatctcagaatagcatttcctccaccttacaaaagaaaggcacacctttcttccttcccaaattgtagcatgatgcattgccccagaacttagggtgccaaacaaagggatagtctaaaatattactttgaaaactcaaggccccttaaactcagagatcttctcctgcctgtgtttcaggaatttttgataacttcagtgcttaatcaaagttggtatattcctaattcagaacagccaaagccttatatagtagtgatactgaattgtgtcagtgtaattggaatgttttataggactatcattttttcaagatgcatttgataaaactcaggaacacactttacttgtgatggttaatactgagtgtcaacttgattggattgaaggatgcaaagtattgatcctgggtgtatctgtgagggtgttgccaaaggagattaacatttgagtcagtgagctaggaaaggcagacccacccttaatctgggtgggcaccatctattcagctgccagcacagctagaatataaagcaggcagaaaaaaaaaaacacgtgaaaggactagactggcctagcctcccagcctacatctttctcccatgctggacccttcctgccctcaaatattggactccaagctcttcagttttgggactcgggctggctctccttgctcctcagcttgcagacagcctattaagggaccttgtgatcatgtgaattaatacttaataaattcccatatatatgtcctattagttctgtccctctagagaaccctgaccaatacatttgttttctttcatatttgatgtgcattgtccaaaaataacacatggaaagcctatttcattaaatcatgtactatgtattccacttagttaattctcatcatattccatttatacaatatatagtattttctctctcctattaacaaataactaaaattatttaaacatacaaaaatagatgtcacctttaaataataggtttttataagtcatttaaggtaaatgtgacacaaaaaagcttggaaaccccttttcagggtttctcaaattataatcgtatgtctaattagattaaaaaaggtcaccaaggtgctagtgaataaaacaaacaaacagattcctagatcctaccacttactgttgaatcagaatttctggggaaacaaggatcagaaatctgatggatcagcatgcatacagatgattcttatccacattaagtttgtgaatttatattcaagtgataacggttactatggtttggatgtttgtttccccaaacctcatgttgaaatttgatcccagagttggaggtcaggtgttactaatgggagtttgagtaatgcgggtgtgtccttcatgaaaagattaatagcctacttcagcagtgaatgagttcttgcttagtttccaggagagctggtgctttaaaagagcctggcacatccaccttttttctcttatttctgctctcatcatgtgatctctgctctcttttgccttccactataagtggaagcagcctgagttcctcaacaaaagcagatactggtgccatgcttttcgtacagccttcaaaactgtaaactaaataagcatcgcttctttacaaactagctaacctcaagtagttctttatagcgacacaaaaaatggactaagacaatgatccttttaagagagttctatcccatactaattcaaagtcaacatggtgtttcatataatcttgttgtaatagtctcttggtggtggacatccggcacctaacacagtgcccagcacatgttggagtgtcaagaattaatgattgaaagtgaatggaaaaaaggtatatatctcctcccaaaacatcaggagattgaatataaaggacacatcttccttctataatgtgacagatgcactctatagttactgtttgagagtttttttagtgcaaactatttacctcttaggctaaatttaatttacaaatggaatcattagtagtgaagatatagcagggtgccttccagattcctctgctgtgatcttcaaatgaataagcactgcagattagtcaaccttctgaaaagttcttaattaaggaaaccaatactgtgcagaataacagcctgtgtgttaaccttgttgacacagtgtagaaatctcatgtagatagctagtacaaaagaataaaaatgttgttctagtttctaaagtggcgtttccaaggaattatacttctaatgaaaattgctgctgtggatgtctgttcaaaggctttggcttacaaagtaaagatttgaaaatatcaaacttgcttaatctctgaatgttgttttcattcattaggtgaatatgacagctctctctttaccctaatcgccccccctggaggaaataacatttttgtttgtctaaacagtacttaatgactactctaaaattagagtttaagatctttaactctagagtgcaaagctctacgtccttgactctgacgtttatcatgaatattaatttctgatcttaaagtcaagccatgaaatttttatatattatcatacatttcccttgacagtttttgtaattgccgtaatttcctcatcagcaagagttgtttgtggctctcctggtctgaggaggctataaatttggcagctttgaattccctcttttgtttgaatgtggaaccatcgacttgtttactctgaacattaactagatctcagatcttaaaagaactatagtttttattggtgcctttacatgacaaaagactcaatatatttgttgccattacatgttttcattgttacctttggattgactttcttgttaggggagatttatgtccatcttcagatacttttcctgctactcacataaaaatgttattttctgccacatagctaccattttctttaaaattgatttattagtagtgtttgattatcgaataccagactgtatatattcacattgtgtataagtatccaacatgaaaattatttagacaatattcatggacatgtatacataaacacacatactttttaatatatgtaattcaactgaaatgttatcttccgtttgtactttcaacaaagatttatcgaacatctactacacatcaggcctggatttttttctgcacacaggaataaaaatagacaagacacaaattggcctgaagatgccacagtcaaccaggcaaacagacagactcataaaaaattatctgtatcactgtacggcaaatgctgttaaaaatatggtgacaaagagctgttgcaaccagagagactcagggatggatacacagaagacaggtctctgaggctacacgagatagatctttcttcccagagaaattgaaagggcatgttattttacacagtaggagtggccagacatggtgatttagtaaaagagcttcagaagggaaaagcaacagatacacgtggctggagtgaaaagtgcaaagtggtgcgtgggaaagaaacagaagctagaaagttaacttttggatagatttgggaagtacccaagaatagaatctcaggttcaggtgtttgactttttttttcttaggacctgaagacagtgatccaggatggcctaaatgtcgcagagaaaattattctatatattcagtcattcagacaattatctaatgaattctttatgagagttgtttttggccaggtgatgaacaagagtcaaagtctctgttcttaggaatcttatagtctttcaagagagaaagttaagtcactcaacgtttaatgtctgatatgacagaggttacaacagagaaaagaacagagtgtaatgggcacatagatgtgatgtgtaattcagaataaaaatcaggtaaggcttcttggagatttaaatattgagttctgatacagaagtaaaacttacctggatgaaataaggagatgaaaaaggagatttggaggagatcctaggtggtaagatagtatatggctacagtcattatatattcttctaattgtccacgactatagtaaagttcccatgacttgggtcatttttagagaagttggaaaggatcagttcatggtcttggggtacaaaacgggagagctgaaactttacacaaaaaggttcagggagacaatgaaaaactttaatcagatggatgacaaaaattggatttgagttttggggcggtcatttagcagcagtgtgtggggatgttgaatggagggcttggagagtagcatctaactacagggttgtcttagattggactcctctagaaacaaaccgcaaggaaacatcactagaggaatggggaagtaagatgtagcagagaagggaagccagtaaagtatgcattataaagctgttttatcccttttggcaactggaaattaggtttactggaaaactctgtgagacaatgtagacatactctcagagttatacccgaagggagaggaaactgggttgtttttctaccagctccctacctgttcctgattgagggtttcttctactaggaatcttagttctctagcatttctggcttgcccttcatgaagaccaaggttggtctcagggccagacaaaagccatcagactgagggtgtcacgtatttgtaagaagcagccttcatacggtagacgtttgggtggggcactgacataatcagctaaagaactaacaagatgggaggtgttgagggtctggacttaggccatgatagtggtaatccggggaagtttgggagtgctactaggccattgttttaataagatttggccatgcattaaatgttaggggtaaattatgaatgatgactttccagagagtagacagatgttgatgatgtaaaatgtgtgtgtttaacaacgtaaaggttttagtataaatatgaaacctatattaaagtctctttataattgtatctattttagaaaagtattataatacagcagtataaaaactctctaaccagaagacctagagtacttcctagatccagatttctaacagcatgaatcttggatgatactcttaatctctcagagcgtctcatgaaaaaaatggaagtaaacatgaaagaagctttgcatatgttacgtaaaccaaagtgtcagtaagccttgtacaaaattttaacttttaaatagaaattacataaagtatttgggccctaggacctaccaagtcgattattattaatgaatgagtaaatctagtcaatcaaagacctttcatttttcccacacctatatttgaacagatgccagttagtgagcatctttgtttgttaatatctgtacttcatacttaatggactaattttttctctatcaaaaaagctgcctttgttaaaacatttcaatcaactaaattacttaactctaatgcctattttgagggaaaaatatacttagagggagaattaaatgtgtaattttatttctgcctcattaaacctcctctgtgtctaggccaacaagagtttcctcctcctccaccggcacacacttattggacgcttcattgtgagaaaatcctcaggtcgctggaacttggtagtgagttacatacctgcccgtcccctccagtatatgtactaattatcttatggaaaataactattttcttgcttttttttttcctcaagaaagccttgagtctcatccagaagtcagatgagtgttagatttcttccttctcttggcttcaatggcaactcttttttttctgattctaaataaatagattgttatacccacatgaatatccacaggaccaacactgcccctttattactcaggaagtatttatttttcagctttctctttcctttctggccctttgaaattcaagcttatttaataatgaattttagtgaaattattttaaaatatcttttaatcacattagcaaacttctagcagagcattgagtttcttcctcagataattcaagttgtcttttctaaaatatgtacttaaaatgactttgaaaaaagagatgtatgatgtcagaaatttctttcaaaagaatctgggtgtggttggggtgatgggtagggatatagatgaaattaaataagcgctatgttgataaatgttgaagttggatgatggtatatgggagttgtgtagtgttttctacttttgtatatgtttgaaattttttctacacttgaaaagataagagaaatttaaaaattaaattggttctcacaattttatttttgtagctgttttttatttgagacgaagtttcactcttcttgcccaggctggagtgcagtggcacgacctcggctcactgaaacctctgcctcctgggttcaggtgattctcctgcctcagggcatgcatgtgtacaagcaatgcccttaccatttatgcattcaactattcttccctctacccattatttaatataagaagtacttatgatgtctgtgctgctgactgtgctaatcattgaagaacctagggtgagcaaaaacacacacagccattgccttcataggactcatagagaaatgagcaagaaacccaatgagaaatcacacaaataaatgtaaaattgcaaaaataacagctgttaaagaggaaagatacatgattttatgtgaaattataaccgggtggtattgacttgatgatttgagaaatcaggggaggcttatctgagtttgtgctgatttaactgagatcaaactttgatcttggtgtgtggagacatagaacataaacctcaattcacccatggtagacatgtagcttgagtgagaaaatgtaactttgttattgaaaaagtcatgacaattttgtaatctggcctatcctgatgaacattcatagggttatgatgggttatccttatatatcttgagaacaccaaggacagtggcagagcttggagtgagaaggaaatccataaaccagatgccaaaccttcctggagtcagcatagacatgaaaatgcacaagagggcaaaagagttatagaaccaactggtatgcatttcaaaagagcaggattgtggagaagagagtggatgaattattatttaggagctggaataggaaggaaggatatcaagcccagtccctatctctgaaatgcaaaaagtatgaggaagtaaataagcaccacctgagatagctgtaggagaagtgataatcacagaggagagctaggtttgattgggtgaataccaagaagagaaggggatactaaggatttagagcggttatatgagtatggaaatattgcatcaaagggtacagtgaaacaatttgagccatgagatgtgtgtgtgggcacagaatatgaataaatgaatgaatgaatgaataatagcattatagaaatgctaatgcagtagaagtgtatgtatatgagtgtgttggagaggggatgcttacaattttggcattgatttgttaaactaaggatgacagacatcctgaattcaaccttaatatctctttgaggaagatgactcacttggttgggggtgatgggaaacccagaggcaatagaatccatatacttttgatggtgggttgatagtaaaccagatcttcagatccccagtgtccattactacctacgttgtagtctaatctctcattaattctcacatgtttaattccctccaatccagctgtcagacatttttattcctctctgcttagaaattgatatttatggggggccgggcgcggtggctcacgcctgtaatcccagcactttgggaggccgaggcaggcggatcacgaggtcaggagatcaagactatcctggccaacatggtgaaaccccatctctactaaaaatacaaacattagctgggcatggtggtgggtgcctgtaatcccagctactcgggaggctgaggcaggagaatggcttgaatctgggaggcagaggttgcagcaagccaagatcgtgccactgcactccagcctggtgacagagcaagactctgtcaaaagaaaaaaaaaaaaaaaaaaaaaaacgaaaaaaccagaaatagtttatttatggccaggcgcagtggctcatgcctataatcccagcattttgggaggccgaggtgggtggatcacaaggtcaggcgttcacgaccagcctggccaatatggtaaaaccccatctctactaaaaatacaaaaattagctgggcgttgtggtgcacgcctatagtcccagctacttgggaggctgaggcaggagaatggcatgaacccgggaggcagaggttgtagtgagctgagatcatgccactgcactccagcctgggtgacagagtgagactctgtctcaaaaaaaaaaaaaaaaaaaaaagaaattgatatttataaaatataaatgtgaacttgttatctcctgtttaaaaatccttcaatgatttttcaagctttccagataatatttaaactgtgttaaaacacaaaagccctttaccgtctctcctgtagctactactttagtgtcccttcaaagcactttcccctactcatctttcatgtcagcaacagaactattttaattttttaaagctttcttgtttcatgctgctgtactggtgtctgtgctattcaatctatctggaacctccatcctaacctctttgtctggttaactcctccccaaagggattaatgactgaattaatgatgccgcatatgtttttctaatgttcttttgaagtaactcaattgactctgaaagtttcagaaaccccttgtcaagtactgatcaagcagcttatttcactgcatattttttaaaattattttttcctgaagtttcagaagtcatgactttatttcctttggaagtgttcaatatttatgaataaaattatgaagataatcatgtaaaaacagcttaataaatttaaataaattttaataaaataaagagatgatgaaaaaaaggagttatgaaaagccataacagcagagaaaaaagaagctacaggaagtgtgaattggaactaagatagaactatacatagcataaatgggaaatgtaagaatgtaaaatttgtgcacttgaagaaactgaacacaattgcaaaagtttattttgataagtggaaaacattgtcatcatttgtacatttttttcccttaatagaaagcttcttaaattatatctaagcacttatcttattgcactgaatgtaagatgccaaatatagtaagagacacaatcaacaatgctttcttatagcaatcataaaagatatacccaattttggagatgataaaatacaagcaaaatgcacatcttagaactgatgaaatctggaaattgatgaaaaaagtcaagtaactaggttattgcatacatggtattagaaaactgccaaaggaaatttttaaaatctttagaaagaaaattatcaatactgcttgatcacatttgatatgaatttttaggaggacacaaatattcagtccataacactctctgagcttgtcttcttcaagattctttcagttgcaagtgacagaaaaccgagatcaaagactgattaagcatagaaagggatttttttgattcacgaactgaaaagtccaaggatagcctggctttttaggcatgtctggatttagattagaggctcacatgataacagctgaaacattctctctttttcccacttctttccttggtgttggctttattcttaggtaggcaaagatgacccctatctcctctagtcttagattctactgtcttagccaccagagccagagaaagacatcatgcattcctaaatctccaacaaaaatccaaagtgtggctctcattggcctcatatgtccatccctgaaccaatcacggtggccagtggaatagaatattcagattgaccagttctcaggcataagaaccagagagaatcagtccaacttgaactacatgctaataacaaaagaagggagaaaatgttggataaggaaaaacagtagaggagccccagtactcactaaataggattaatttcttaaatctgcaaactgggagaagataccaaacctttaggactgctgtgaaacagaattaaacaatatgtgttattatactgaattgcactcatgtgactaaattattacacaccacatacccgtatattgcaaaattctaatttcttaaggatctgtccttgacttcattgtggcgattatacatcccccttgtagcccacgatagaaatgatcaatagaaaacattgtccaagcgtcctggctttcctcaggcaagatgttagttaatgagacctcaacaaggatgagtaactctttccaagggacatcttcagggtctccctaaaggagaaatcaatgccccctaactgatttggatgaggaagccactagggtctcaggaagtcccccattgaaatgcaaattggtctagctagggctttatcttaaacaccagcaaatagctcagttattacttagcacagctgcagggattatcaaaacttgcagttttgttgtcctataggacataagtcaatattgtatctaactttgcaatcttattctatctcttttagtcaaagcgatactgcaccaggcatttgttaaaaaaatggcaaggaaaactttattcaaagctattgtaatatcagttaagactattgcaataggggcaagaaagtatactcaactttattgaaatgaaaggcaggagaggttttaagccttagggtgagctagaggaaaagcactggaagacactagggggaaggtcggtcagggtgattgggcttatcaaaattaggctcctaccctcccacagagactgagaaatgaggatgttatctttcttgatgattggatttcaaaagaatggcttccaggtgcttgagaaagacattccagggatgtagaagatttacatctcaaagggacagagaatacatttacaatggaaagttttctaaaataactgctccaaaaaaagggcggggctgggctcagtggctcacgcctgtaatcccagcactttgggaggccaagtcgactagatcacctgaggtcaggagtttgagaccagcctggccaatatggtgaaaacccatctctattaaaaatacaaaaattagccggacgtggtgacgggcgcctgtaaccccggccactcgggaggcttaggcaggagaatcacttgaacacaggggcggaggttgcaatgagctgagatcacaccactgcactccagcctggggagacactgtctaaaaaaaaaactggccaggcgcggtggctcacgcctgtaatcccagcactttgggtggccgaggtgggtggatcacgaggtcaggagatggagaccatcctggctaacacggtgaaaccctgtctctactaaaaatacaaaaattagccgagcatggtggcgggcgcctgtagtcccagctactcgggaggctgaggcaggagaatggcgtgaaaccgggaggcagagcttgcagtgagccgagattgcaccactgcactccagcttgggcgacagagcgagactccgtctcaaaaaaaaaaaaaaaaaaaaaaaaaaaaaaaaaaaagaaaggaaaaaaaaaaaaacaaaaaaagggtaagtcgggagcttattaaggaaagaatcctagtctctggcattctatttgggccaactttgtcatccttgtaattccctctaaagctttggcatgtgctcacactatatccgtatgaagttcatggctttatatttataaaaattatattttgacttcttttctcttatattagttggtagaataagcagaaatcaaagaagctgaaactagaaaacagaacatagcaaaatagcaacaaaaagacattaaaacacaaattttgaaagggcaaaaaatcatttttggaatctgactaatgagacagcatggggaaggctaatggggtaaggagaagaacaaatagaaataattgtctttggaatgtgaacattaacataatggagagcaatgaataagaagtatgacaatgttaagtattttatgtcattgtcccaagaggtgctcaattgagaaatcacacacacacacacaactttaattataagaaaaatatgtggtaacaaaataacaggaaaactcagaagtcagagaataaattgcttattaccacctcctaagtagcttttaatgctctttctaaattttctttgtaaattcaaaagttaaattgaattttgattcagacataaaatgaaactgggagcatttatttctgtattgccaggagaaatatttaccttgatttatttaaattcttctaggcattcctatttattcaattttataaacatcctcttctttgatgttactctaagtttattgtttcattgtctgagaaaaatcttattgccatttcctaaattggtgtttttttccccatgaaatttccagaagcatccaaatgactggattaaaatgaagtatggcaaattgccttttagaatgactcttcccaattagaaattgccaaaagtagagatcaaagcagtatacagtggttttaaactagctcatataacatcttccatgagctagttatataaagatttttgttttgattacttttatcttataattattcttaccaaattccaaccataaaagatattttgtacataataggtactcaataaatgaacattacatttgaaaagcaatgacctgctttatatttcagtctaaatgtaatcgatatgaatcaagcagtaaagaatatggcagagttgcattacaatttgcagtccaaaaattcttgagtaatctcaggaaaaatgtactctaccagggctttccaaagatcgttttcaggaatactagcctgtctatgtgctgccaaagcgagcacaggaatactagcctgtctagatcaatgcagttaacacaacccagtagatctctgtgcttgatgatgaaaatattctatgtctctgctgttcaatacaatagtcaatagctatctgtggctgttaagcacctaagatgtgactaatgcaactgaataacaatttttttcatagaaattaatgtaaatagccatatgttgctagtggctacggtactggacaacatagctccaaagttctcaagaacaaagaaaaaaatttatttatttttctttaaagaacaaaattttgtctaacctagcatttcccaaatttagttcatcacgaaattcctctttctactttgagaagaacattagggtacacttttcaaaaattttatattattaataaaaaggaataagatgtttaaggccatttacacatgattccttattttatttgctgattcatttatgtatccactcaactaacatctaatgagctaggggcttggcaatattgagatacagttttgttcattattgagttatatctaatgggacaggcagattaatcaagagataattacacacagtctggtaagttctaagaaacacagaggactgtgggaatacacaggtgggtgcagaatcaaaatttgtcatggggaaagtttccagagggagaatggaggacaagtaggacattgtctggttaaaaagaggtccccggccaggcgtggtggctcacgcctgtaatccctgtgctttgggaggccgaggagggtggatcgcctgaggtcaggagttggagaccagcctggccaacatgatgaaaccccatctgtactaaaagtacaaaaaaagaaaaaaattagctgggcgtggtggtgtgggctgaggcaggagaatcacttgaacctgggaggcagagattgcagtcagccgagatcgtaccactgcactccagcctgggcaacaagagcaaaactccatctaaaaaaacaaaaagggtgcctttgcatttttatttctcttattcccctccccagggtttgacacttagtctgtcttattcaagctaagtccttgaatcacaactatgcctagatccttatgggttgcttatttatacctttaaacaaagagaaattcatctgatttttacagattgatttgagaattagaggctgttaatactatttcctttttgccaccccaaccactttttcctgttctaacttcttcatactccagtatacaccacagaaacagaggctgatatggtttggctctgtgtcccacctagatctcatcttgaactgtactcccataattcccatgtgttgtgggagggagcggtggaagataattgaatcatgggggtggtttctcccatactgttctggtggtagtgaataagtctcacgagatctcatggtttcataaggggtttcggctttcgctcctgtcttattctctcttgccaccatgtaagaaatgcctttcaccttctgccataattgtgaggcctccccagccaggtggaactgtgagtccattaaacctatttttcttcccagtctcaggtatgtatttatcagcagcatgaagaaggactaatacagaggccattcgtactttaaatgtattacggctaattatagtcaagagattagaagtcataatacaaatattaaccacagagaggtttaaatttctctatataatctacagtcttctcaaaatagccttcaaaattttgacctgagagcaggaacaggcctttcatgttttaatcctcaataaaacacagacatacaagcctgtgtgtgtgtgtgtgtgtgtgtgtgtgtgtgtgcgcgcgcacatgcattctcacgctcatagtctgtcttttcccaacttcgacaattgtcccactgatttctctgtaccttcctttctattttaatcaaatctccgcaaaataaataagggatattctaaaatgtaaatctcattaagccctcccccagataatactcttcaagagtttcctcagtttccttcaaaatatgttctatggccattagagtagtttaaaattccctgtataatctagtccaagtttatttctccaacctcagagcaaacaattctagaacagtgtctagcatataataaacacccaataagtgttggctattgttttaggaaatggttgtctgtccaggaagcctaaaaaggtgtcaaaccacaatattagggaggcaatgcatagtgcagccaattcacaaaagagaaacaagtcctagaaatgttactaagagctcaccattcatgacaacactaatctcctcccgcaactctgccctcacccttcattctttgaggcttcaaaggatgaagtttatccattcatatcaaaaccttcctttttcacatatcaatgcacatttaaaataatcttgtagacactgttttctccttaagagtctgagagttaggaaacaattctgtaaatattaaaaacacaggtattgtaagactgattggaatcttacaaactaattttgttttactaaccaagacagtgtaggatagttacacgaacccaggtctagtaaataattcattcgcgattgtgggattgagtgcaaataattagtgtaaattgtcactttctcaaaacaaccgccataatagcctgttgattaagcaacgctgagtttattacttagtgcagtaataaagatcaacacttgacacagggtcttagttctctgaagacagtggttgaaggtagatattttttatagagttttgagggggtctaggttcaagtggtttaaagaagttctttgaatgcagagatttgattgaaattgggcaaaatccaagatataatagacaagaattggtggacccagtgagtccaggttcttagaataagtcttgatgagtaaatagctgttgaataagtaagggagttcatcatgttaacaatccattgtcccatgaaagggagctttttctccaaataaacaacttattgtcttaagacagagctacttgatcactgtgtagttcagataaatgcagtttcaggaatttcctgacgctgtatattagtttacaacattatttcctgggaaaatgttttgtggaacaaaatgcaaagttatattgacgtaggggccttgataattaagttgagcgacaacctctctgagtttcctcaattgtaaaatggggataccagtggcacctttttcttttggttgttttgaggatttagtgaaataatgtgcataaagtcctcagcaggatacctggcacttagtaaaagtacaatggctgttaaatatatttttcaactactttcacagtagttactcttaaagtatcaactcattttttcatccactcttctaaaacattcaccaaaatattatatgccatgttctttgctgtgtgttaggagcacagggatgaaagaaccatgtactcaataacttgtacttatagacatgttaccctattactggagactgttttggtaaaaataggaataacatgccaaggcagctcaggggatgtaggaaagtctaaaaacctgtcctagtgaaactgatgcttgacctgggccttaaaggatgagtaataatccattagtcagccaagggtccgatcattccaagctaaaggaaaactatgtacaaaggctaggaactattaatttccatgctgggttccagatataaaggagaaatccatgtgatttcacctaaagggtcagatggatcagcagaagatgagttcggataacaaaaataatagttaatagaattcaatatatgataagaatattcggtgtttataacaaacgggataattccaaccagaggatggaaggatcaaaggttttttttctatcaaggtgtggagctggggtcctatcttacacagtttagtcattctcaaatatttttatacaccagaaaaacatggaaagacttaaaattgcctccgtcttgctcaaaccttccgaagattccaatttaattgatctgggatggagcctgggaatctatattttttatttttgtgtgtgttttatttgtttagtgctctcctagtaatactaatatataagtaggacagaaagctgcctgcagtaagcagtcacaacccaataccagtagttagaagcccaaaatgagtcatttaaacaatattcttaaggtccacgtgcaaaattctggaaacaaggagtcagtagaggttacagaaggtaattttagcagcagtgagaggttgaattaggacagtgagttttcagtcatttctgcttatctggcacttgctttctatgaagaaaaggaaagagcatattcagatactcccagtgatactggagtcatagtctcaggctaagatagtgggcatgagatgagatggactcaaaagacagaagtagatgttgggataaattagagtattgggataaagaagaaagagagagctcaaagaacaatccaaaggttgtaactataggggcaggagcagtaggtctaggatgtagataaagaactaatttgaaagtgttgactataggcagcttcccaataaaccatggctaatacctgagccattatttctttcacagccccaggcacaactgtgtggtgcctcactttctgaaacattttaacagtctcctcctttgtatatgaccccagtgccctcaggccattcccggactgctttcttggtttcaaaatatttcctctacttaagtattggttttagaggagactgaattgagaattgtgctatagggagcatcccagaaccacgaaaatgacagtggttatgaactatcactgatgaacattttaggcaaaagtggccgattttgaagatgacctcgaggtcatccaaacttccctctttcctcattgccaaaggtcctgaggaacattatgaaaaataaaaattaaaggcaggtggaaagcccaaacatacgtctttttatttgtgatattgaattataaagtgagaattactaggctttgttgatggcaaaaccagactctgtaaaatattttaggcagtcagattacagtttggttttatacattttatgaaggcaggagttttaggcaaagacataaatcaatatatggaaggtacacattggtgaggcctaaaagggtgagatatcttgaagcaggggcttacaggtcataggtggattcggagattctttaatttgtgattggttaaaggagtaaaggtttgtctaaaaatttggagtaagcaggaaggaatgttttaagttaagataaggaagtctgttaatcaatacactgggtcagagtgacctgtaggggtgtgcgatttaacccttgtctgacatggccttaggtcctgtttataatttggtatcttaatgttgcagagtccattttgttagtctttgctctctattttacaataacattaatgctagtcagttgtgcctaaactccaaaagggagggggtataaaaaagcgtgtctgacctcctttcttgtcattgccaggaattcagtttttaaggtttctctggggtctcagtggctaagagagggtctggtccatttgtgacgggctaaggattttatttttagtttacagcaggatcaatgattatgtttcctaagggacctaattctagaagtccttcagttctccccaaatattttgggcccttgtgtcacaattgctgaaaccctgactccaaatttgggaggataacattgctgccagctttttactggtatcaagaaaaatgccagaaaatatgcaacatatgttgccattttgtcaaaagcagcaatgttaacatgacaatgaaagcaagttccttttggatttctttttaatccctggaaggtcagagggccaaagttttctagtaattcatctaggaaattaaccacctttggcttttcttactattttaatttacaattatgatttatagatgaacgttggttggaaaatatttttacacataatggcttttttagaatagcatctacagatacatgacagaaggataaaaattgtaactgtgacagcaatttcaatcagaaataaaaaccttaaggagcatcatgaaatttaccaaaatttatgcttctgatttcatggtatgtatttgttgatttgtttcttccccaagggattagtagtgaatatgtaagtaaaaaaggacatgattacacatgaaatacaatatgtcttctgggaaggtggagaaatctttcagccttagtggcattcacgtttgtgtggctgtgtatgtggatgtgtgaatttattcaacaaaaatgataccacttccatttgcatgatattgtaaagatttttttctttcccatatattctctctttttggtctcctgataatcctgcgaggtaacattaatatatgtgatacatttaatgaaagtctttgacaggcagcaacatatttgagaaaacaagcttgggaagtaagcaatattatcttcatttaaataatgagaaaaatgagtctcaaatagggtaagtgatctaccaaccagcacccagctctccaagatagaactgatactcaaaactaagtcttgttaacccagtactgtgcttgattcatagaaaatgttccacaaatatctgaaatttaattcatagtttgtgtaggtacagcatgcaaccaccacaaggaattttggctttctctttaaaatgtggacttttatgtgccaagataaattttctttgtggctgaatgtttttcaggaagagattactcaactaatttgaaccacattgacctatctgtaatttatggaaaagtgcaacataatacaggattatagaggctagagtcacgcttgctgaatacatatgctgtacattattttgaaagaaagaaaacattttaatacaaactatgtgaatttgatgacgcattttccctttatttctgttagtataaacctgcctatatctgataattgttggtgggcatgaagtaaaaggaaattatccccctttctgtaggttgtctgtaaagaaataaagcaaaagggaattagtacaaaataataacggtaatctaagcagacatagagttcagtgtttgttttatttcacagaaagatgcctatgcaacttgtgtaacaaattggtaggctgaaagaataacctcatgtaaatgaagaatgtaattaccatcttcacagttttggtacatgttggaaatgtcatttcaatcagggctaatcataatatgacaggaataactgtgataccataagtgataatgttatgctgctcactttttctaaatttggtggcaaaatatgcaaagataaaactttcaaagagccagtaaaacatgttcaagaattttctcactttaaaaaatattttcagggaagtactcatcattatagatcaacaattattttgataactccattgtttttaaattaaccctgttttagtattttggtcatcttttatggtcaattataaaagaaaaggatccattttaagtgacaataagtatttgatattttactttttccacatatatattcctatattccatatggcacatatgtatattttgtatatattccacatataatccatatatatatattagacacacagatacacacatacgtatgatatctgtctatctgtctgtctatctatctatctatctatctatctatctatctatctatctatagttgagacaaggtcttactctaacagccaggctggagcgcagtggggtgatcacggctcacagcagactccatctcccaggctcaaatgatcctctcacctcagcctcccgagtagctagaactacaagtgcaccccactgcatgtagataaatttaattttttttttttttttttttgtagagacagggtctcactgtgttgcccaagctgtcccctaactcctgggcttaagcaatcctcctacctcagcctcccaaagtgctgggattatagacataagtcaccatgcctggacacatgtgatattttgtatgtatgtatgtatgtatgtatgtatgtatgtatgtatgtatctatctatctatctatccatccatcgatctaaaaatttaaatatagttttcgaaatgttgtctctcattttttttttccgtacatgggcttcttattaacaataaataaagtagctaaaaacaacgaactaagaacttcagcataaagctcaatgggtgttcccattcattgcattgtgaagttgatatgaatgccattttgatgctacctcattttctggctcctgatgaagaaacagattaatgacaaattcctttcattactaatttctgtggttctcatgaagtttatgacattttaatttaattttattttgttacttttctaatccactactttatggacaagtcaacaaatggtttcttaaaagtacctctctactaggaagttggcaataaatacaaataactaactgttgctgtgtggatacagcctcccaacgggagacaacaggggagtcaggggagtgaagaagaaaggaagaagtatgatttgtattttgtttttgttcataatttttggtgttgagtacaaagtttgacccaagacataaataaatgcgttgatttttgaaaactttaaataaaggtatcttattctgtggttcaagaaccactggaaatgtagaggtcatccaaatgtcctgaaattggatgcaaatttttatttctatgtgcatatgtacatttttatggggaaaggatacacgacattattcagattttcctcaacatataagactagcaaataggttcaggaccactgccttatctattaattatattcaggtccaaatgggaaaaagacgtttctaagaaacaagaatataaatgccttaatccatgaatttacttttatttatacaagatattacataaaataatctgaaacaaagcatcttccaaaatagtgttataagaatgaatattatgccgggcacggtggctcatgcctgtaatcccagcgatttgggaggctgaggcaggtagatcacctgaggtcaggagttcgagaccagcctggccaacatggcaaaaccccgtttttactgaaaatacaaaaaaattacccgggcgtggtggcgtgtgcctcaaaaaaattactgaggcaggagagtagcttgaaaccgggaggctgaggttgcagtgagtcgagatcatgccgctgcactccagcctggacaacagagtgagactccatctcaaaaaaaaaaggaatgaatattataatactatgttatttacttaattataagaattaaaaatatatttgagcatatttagggcctcataatcatgcatagaggaaattgatatgatccattttatgttgagtaactcattatcattattattattaataatattgcttactacaaaaaattaggcaaattccttttcttataaaaattaagagttgaatatgttgttatgcctaaactacataacgtctgcaaaggttatggtcttatggatgatgatttttctcaaatattagtgtgaaaataacaagtttctaagttttccaaataacttaatgtgaaggcaaaggatttttaagaggttttgattatactcagagagtggaggactaagtgatgaaagaccaagatgagtggtgatctgtgttcctttaactattatgtgcagttgctgacacaaaatggttttgttctttctaaaaggtagagagagaattttgcccacagacagaaagaaaatgtctttcaagaagtggtttgagaggctggagagaagcagattggttacttgattactgagagggccattaataggagctcatttctagctaaagtgctgacatcactttgaagccatttacaattgttaaaaggaagcaaccctttagtataaataatgagcctgttacagtgaagtgcattggcagatattcataaacacagatacaggaggagctgttattcattacaattactgtttttcgtatgtttgaaaaatgcaaatatatgtgtgtgtgtatgtgtgtagtcgcacagtgatattttgttttagtacgtataatttagaattatcaaaaggaggtttgctccttatatgtaggttatattatgtcatgtgtctacttttggagagagtgataaattgagacaaatattccctaagtttggatttaacaacccaaaatcctctaggatgtcactctacactttatttggcaacttttctatgtgcatattttagggacgcttgcagaaaaggtatgtatggacaagacaagatccttgcctagaaacagaaagaacaaatatgagcagaggcataaatcaaaacataagcaatacaaatcagtgctaatttttttaattaaataaggctttctgattcatgatctaacctttaaaagtagtttctgaagtatattctctgttatgaaacttcgttcttataataaaaatcatattttgcaaaaaaaaaaccctaattttcaattacactatgaaaaaataaactaatgagttttcactattaaaaaaataacagaagccaagttcatggagttgctttttctatgtatgtttattgcttgtagtctttcacaaggatacatatattccaagttcaacatctttctttctcttttctttctctttttttctttctttttctttctttctttctgtctttctttctgtctttctgtctttctctttctctctctctctctttctttcttttttttttgatggagtttctttcttgtcgcccaggctggagtgcaatggcaccagctcggcccactgcaacctctgcctcctgggttcaagtgattctcctgcctcagcctcctgtgtagctgggattacaggcatgcaccaccatgccggctaattttgtatttttagtagagatgaggtttctccatattggtcaggctggtcttgaactcccgagctcaggtgttctgtctgcctcagcctcccaaagtgctgggattacaggcatgagccaccacgcccggctaagttcaacatatttcatattcaaaatatctgtgtcagttagctttggctacataataaactactctaaaactgaatggcttaagacaatttagttcactgttctggtaggtgtttcttctggtctgggcttggctctctcatgcatctttggctcaagtatggctttccacagtgtcttaacccttcaaagactcaggttttacatctaaaaccagagttcgagaacaggaacctcataactgacaaaaaaataaaagttactcctcagtgttgtctgaactcatctctcctgctaaactcccaaaggagaattcaaaactggcctattttcctcaagctccctattcaacccttctcaaccttcccctctccttagccaatatcctacctgatatgtttttaaatattttagaccctcagatatgaatgctcttgccttccctatatcctaatgataaatgtattcatgatcacagccaacctcacgttcttttcctggctttctcagaggagagtctcatcgtccacttaagagatacctatttcacttgcatccttgattttatcaattcttattctctttcaactgtatggtcatcttcatcttttcctctctactgtagaactgccattttatttttcttcttttctgagccaatcttctcgagggagtaatctcaattctctatctccatggcttaatttcccacttcatgctaatctactgtaattcagtctttatttgtcatggtgcaaaaactattatttttataatcaatggtgacttttatattggtaaatctagtgaacatgtgctagttttttttttaactaggtctctcttctgcacttgacactgttcattactctgtcttagtctctacacacttgcctcttattatagtattctctgttttctttcctttgtgaacactgtcaacatccttcacaagtttctcttcctgcagtcaccttttggatagaggtgccaccatgcttccgtcccagttcctttactcttcttatcctgcacatcctcttgctgtcttcattccatctccaacccttgcatttccatcagatacttctctggagtggttccatagggatgccagatgcactacctaccaactcatactgaattttttatatatatatatatatatatatatatatatatatatatatatatatatatatatatatatatatatatatccccttcttctttagcacaatatcctggagaatcacgtagattagaaacaaacgggtcactcttgttcccctacttcctcactttcctattcaattagtcatcaagacttgcacattttgacaactaagatttttcttttgttccatcccctttcagcccatcacagtcccctaagaccacctcttagttcaaatattttgtacctcttgtttactaccacagcacacaacagtttcacataacttcacattacatatacactttcactcaaaaaaggatagcatttttggattttgaagcacggcataccttttaacgtgtgtataagatgtgttttctcatgacttcttatacaatcacatgtactattctgcattgctgctttatacgcttgtgacttatctcatgtaggaatggaaagagggtgatccctttccttcccatcataagggtcacagttgacacctctataaaaagagagaagccatacaaatttattttatcatagtttcttgtggcttgggagggagccttcagaatgaagaccccaagatacagggaagactacctttttatgcttaggttccatgaaggatggacagctgtgtagaactgtgattggacaaaaagggtatgatctaatactaatagactgagtgggaaaaatcagcaaggcctgtctgtccagattcttcttgacctctctgtgcagcgttccttcctcccaggtgtggtgcaggaactctctctggtatgggggatctttgacctatagtcaacaggtaagttagagaatttctttatggccagttcttacacataaaggtagggggtaagttatgatgatatttttaggttttatggctggccttgaggagaaacatttctgatttctatgaccagttttagggaagagggattttaatttcgatggctatcctcagggaagaacaaggggtgagagacaaaagggcaggagggcagaattttgtttctgaaattgcctctgaggacttcactttggggtactgcttcctgtgcctcaatataatcaatgtgatcaattttacattgttggtattattcaatgatactttagatttgtgaaattcactagttagaaccaagctatttattctacattaaaacatttcaatagatagaatatcttacaatagctattgtcaaaaaatcattattattgggtttaacatttttatatttagctctgtgtggaatatcttaattattttttgacttctctctcatgtagcatcagaaattattcacttgaacagattttagattaatttattgatattatgattaccatgcatatccattaaatattttgatattgacaattaaaaagaatgaagtatgcatatatgtctcaatcatccagctgatcctaggaaagggatgtgcatttattaatcatgtttttaacccacagcacttactgtgacatttgtcacatagtaagcactatatatgtttttaaattaatgaagctatcaaagttcaccaaccaatataatttcagaggacagatgaaggctttcacgtcttcatttgttcacaccctatattcttccttatgcagctatttaaaattaattggcaagaattaccactctccttttctcatacttgttttggattctaaactttgttattttatttttgccatctctattctttctacttacttgacaattttaaaatcacacattatctaaaatcaggcagtgttttaattggttgatatattttacaagaaaccattccaccattatgttcttggtgatttaaatgcctatttggctacttacttgcacattatttgcaagaatactgatatctctttgaaatccttatctgtgagtgtgttagtccatttgtgttgctctaaaggaacacctgaggctggataatttataagaaaaaaagtttgttttggctcacagttctgcaggctgtgcaagaagcacggtgctggcatctgctactagtgagggcctcaggaagtttctgatcatggcagaaggtgaagggggagccagtgcatcacgtggttaagagaggaagaatgagggagaaagagtggggaggtgccacagttttaaacaaccagatctcacatgaactgagagtgaggactcattcattattctgagtacagcaccaagccattcatgagggatctgtttccatgacacaaacacctaccactaggccccatctccaacattgaagactatatttcaccataagatttggaggggacaaacatccgaactatcagcaattatgtagctacatagaaacaccaaagctgttctttctattttatttggtagaggttaagataagagaatatgacagtttatttcactcaaggcattttattaattcattgacatttgtctttgaacaaagagggtcatgtacgttcctgccttattcatggtgaattggtttggatgtaatggtacttgtacaacctgaggtcttaccaaggatactatctctccagttcatttgtatgtctttccaaggactctgaaacattttgtccaaggaaaaagtttcttattgaatttgaacttacatcaaatgaggcaaagtacttagcagccactccactttcagcataggaaaattctataatttgtcttgtgcattgtatgcattgttctatttagaatctgtgtttaccttgtaaatgtacttttaataatacctgaaaaagtaatattgagaatgcattgttctatgtcatagccctcattatttcattaaatgaagagctgaaaaagagataatcatttaatttatgttttaaatatctatactgacttgtttgaagaataatatagccaccatttattaaaccttggaagtagtgattttacaaacatttttttctcattcgcacaatgactctgcacataagtggcctattattattttcattgtccagttgacgattcaagggttatacaatttatgtgacttcccattgtcatattggggctggaatctataccaattttgcagaacttgagaatttatgtcctttcctgtataaccgtggttttccatgttttccttctgcttccatatttccacatgggcaacacattcccactcttttacataatatttcttcagaaaaaggcaagaagaaggttgtatgtaatctgaattggctgtcttttacattcccctctcaaaccctagaggttgcaatacccatgatcctcttgagaattgccacactatatagcagtggttggatgctggctccaaattagaatctctaatagtctgatttaattattctgggtactaagatgctggtattttaagagctctctaggtgatttaatatgcagccagagttgaaaaccaaggtttcccttctattgtatttcatgaaatgaaaaagacaaaataaaaaaagaaattcaatttatattgtttgctgtcaatgaaacatatcacataacctcccaattcttaaattacaccagtacttcatatttgaaatatatattcttaataaatcttttaactttcagggctctttccccctaattcttttcagttactttattagctctttgaccttgggcaactttctcttagagtcgattttcttttcttcattctaatttataaattaaactcttagctaggtaatattatttattacttttttgaataggtgactcttataaaatttcatttattttgtttctggtatttacatattggcctagtgaccatactagatacttaatatgctgtatatattttatacacataaataaaaatgtaaatacacactatatatatactatatttatttttagagtaaataaactttttaaacttcaggttatttagcactaacatactctctgatggtcccagtattaacatggtttttaggagtgcacaaacccttttctgcaagagaccagagagtaaatattttaggctttgtaaaacttatggtctcttttgcaacaattcagtatctgtcacaactattcgactccaccattggaatgctaaagcatctgtagacaatatgtaaacaaataggtatgattatgttgcaataaaactatatttatgaatgctagctgtaggctaggtttgacctgcagtctgtcgtttgttgaaccctgctttttatgatgattgtgaccttgattttgttttcctttttcatagcaggtgcttcataagtattgatttatattagtatgtttcctactttcttcctgccacaacacagcagttgttcacaggaattttgttgcttctcctagccttttccataattttttggtattaaccaaagtaatctactatatatggagaaatttgctatggtattacttttgtataggttatgtggtcagctgctctaggttgattattttagctctattgaaatcactttggtagatctaggctgcagcaacaaggtgaaataaagttagaacaatggaaagagtggtaaataaaaggatcaaggccaatgaaaaggcttatataagaagatatcccaaaatattagagttttttagtggctctccctattatacacactgtaccaattaaaataaatttaagagacttcagaagaataacacagttttcagatgggtggatatggacatattctccaatcctcaggtgactacaagtaagaaatccactaattggaaagaaaagaaagtagactgtaatataacaggtaacaacttcatgaaatgagtaatctcaatgagtagtttagactaaaaatacaaataaattatatatgtatatatatatagagagagagagagagagagagagacagagagagagagggagagagagagttcataaatgaataattgtagaaagttggtttgagatttcagtaataacgtcatggagggcagctctgttcatttttcagaatgctctattcaaagtagttatgtctgtgattttatttatactgtgattttttcttaaatgttttgatttctcttaaagtcgtatgcttttcctctcattatttaaatttagatcacggtagtatgatttactattaaaaggttaataaaatgggctgatatttctcattatatatgagatagcttcaaattatgatatagaaaagccattacattgatatagagcattttctgttttatctaacacagaaatttcccaatcacttaatctgcttaatatttatagatcttacattatccatgattactgtttcagcttatttttactttattcatgttgtgaatagatagtacatgctcatggtacaagattctaaacacacacacatacacacactcaaacacacacacacacacaaatgatacagagaaacagtagtctcttttttcttctgtccgtctatatcctgaattcaattactactatgagtctcatctagaaatagttcatatacttacaaacatatttaaattcttatgtaatcccatttgacccagcaattccactcttaggtatatacccaagagaaatgaaaatacatgttcacataaaatcttgtgcacaaacgttcatagcattattcataatagtcaaaagtggaaacaacccaaatattcatcagctgatgaatggataaaacaaaacgtggcctatctttacaatggagtataattaggcaataaaaaatgaactactggcttggcgcagtggctcactcctgtaatcccagcacttcgggaggctgaggcgggcagattatttgaggtcaggagtttgagaccagcctggccaacagggagaaactccatctctactaaaaatacaaaaattagccggtcgtggtggcacacgcctgtagacccagatactcgggaggctgaggcaggagaatcgcttgaacccaggaggcgaaggttgcagtgagccaagattgcaccattgcactccagcctgggcaacaagtatgaaactccgtcttaaaaaaaaaaaaaaaaacaactactgatacatgttacaacattgctgacccttgaaaacattatgctgagctaaagaaggcagctattattaaaagaccacatattattcaatttatgtgaaatgttcagaacaagcaactctatatagagaaaaattactgttacagggctgctgctggtggtggtggagggtgatgcaggaaaggggaaaatgggagtgactggtaataggtaagaggtttcttttggggagggtgaaatgctctgcaattacatggtagtggtggttggacaaccctgtaaatatactaaaaacactgaattatacactttaaatggatgaatgatatggtatatgaattatatctcattaaagctgttttaaaaaatgtatatttgttcaagattttgaaccagcaacatctgtaacatattcaaatgcaatttcattttagcttccaagcatggtcactctacctcataggtgttaattcagtattagaatgactagtccaaggtagcatctaaaactctgaacttaatttagtgttaaattgtgccccttccccggtttagggctactgcagacaggagtattacaacagaaaagacaggcgtggcaggcggcgtctttaaatctgttccttggacttctctcctgcttacaccttgctattctgactgttccaaggtcagagcagaataaagacagaatgaggtgatataaagtgttttctaggcctaatggctggttaagtgttctttctctttgtctctcccctcccagccctacctacctctcctacagtttccttgacccagacaggctcaatctctatctgtgtggagacttgttactctttccttctcttctgaagatctaggcttcacctcaggttcttgttgctgaggttcttatactcccataggtggctactggtcagaacccaagtcaacccagtgttgactctattttctgtgtactttgctgttagggtgcccgtgtaagttatcatccaaactgaaatacatttgtgagtgaaagggggtattactaataattttgatgaggccgggagtggtggctcacgtctgtaatcccagcactttgggaggccaaggcgggcagatcacctgaggtcaggagtttgagaccagcctggccaacatggtgaaaccccatctctactaaaaatgcaaaaattagctgggtgtggtggcacacgcttgtaatcccagctactcgggaggttgaggcgggagaatcgcttcaacccaggaggcggaggttgcagtgagctgagattgcaccattgcactccagcctgggtgtgacagagcgaaactccgtctaaaaaataaaaaaataataattttgatgagacaggcataaaatgggactgttctgagcaaatgggtcttatagatacccactgtatagaaaatactcacatatcctttgcccccaaaggtttggaacactgcctcatctattctgcttgtggccattgctctgcctctctcaggtgtgaggtgagctccattcctccacatcacccaactgcaaagaacacattcagtagatttcaaaggaatctcatagaagacccctttacttggctggagataatagatgagaattctcagctctttcccaaggagatagacaaaatatcttgtcagagaaatatctgcacaaaatccttcctctgcactttcctaaaccatttaaaatctgaaagtcaccaaggagttcaagagtaaggaacagatgcttacccatttcctttaaaaatctctatttagtgatttgtaactcacactagtatttcgcatctgttgtaacatggtgcctagttccaacttcaattttaacatcttattctgtatatattctttttttgtccacacaaatgtgagagttatttttgaaatataatgtcaaaagagatgatttgtcttagtggttcagtgtggcacaggctttgaaatcagaaaaccagtgttattagatttttgactttaggaaagtaacttgacttcttgcagccttaacttcatccccagtaaaatgaggataataatagtacctacctcatgggactattatcataattataagaaatcacatatgtaaagaaattaacataatactcaacttgtggtttgatgtgcaataagttaactattattattactatgattgttatttttaatatctataggaaaccaaataatatgaaatgtcacaaattatttttgaaaatactattctaaggtcttttttttttttttttttttttttttagattctatatcaatttttattccttcattgttacgaaacagatgaataatccttggcagatatacttgagagaagactcttctctcttcctgactggggtccaagtagtcctaatcccatttatccgcatctgtatattccacattggatttgtctcacacatgtccttcttgagatgttacttctgtgtttgagccagattctctgtctagaaaattgtccttggttatacctgctcaatgtttgctattaataatgatatacatcataatcatttaaaaagcccaaaactataacaaccctttagattaaagatacatgctccattggcagccctcaagccatttattttcacaatgtgctgagtttaactcactcattcatttataaattgacttggttgccaatatttggaatcagaagatgtttatcccaaatccagctttccatgggaaatcaggtaacatgggagaacttggcccatattttatttatttatttatttatttatttatttatttatttattttatttttttttttttattgatcattcttgggtgtttctcgcagagggggatttggcagggtcataggacaatagtggagggaaggtcagcagataaacaagtgagcaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctatccacacagacccggcaaccatccgatttctcaatttttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcagctggccgggcggggggctgaccccccccaccatcctcccggacggggcggttggccaggcagaggggctcctcacttcccagtaggggcggccgggcagaggcgcccctcacctcctggatagggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctccaggatggggcggctggccaggcggggggctgacccccccacctccctcccagacggggcggctggccgggcagaggggctcctcacttcccagtaggggcggccgggcagaggcgcccctcacctcccggactgggtggctggccgggcggggggctgacccccccacctccctcccggacggggcggctggccgggtgggggctgaccccccccacctccctcccggacagggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgacccccccacctccctcccggacggggcggctggccgggcggggggctgatccccccacctccctcccggactgggcggctggccgggcggggggctgaccgccccacctccctcccggacggggcggctggccgggcagaggggtcctcacttcctagtaggggcggccgggcagaggcgcccctcacctcccggacggggcggccggccgggcggggggctgacccccccacctccctcccggacggggcggctggccgggcagaggggctcctcacttcccagtaggggaggccgggcagaggcgcccctcacctcccggactgggtggctggccgggcggggggctgacccccccacctccctcctggacggggcgactggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggccgggcagagacgctcctcactttccagactgtgcagccaggcagagaggctcctcatatcccagacgatggggggccaggcagagacgctcctcacttcccagacgggttggcggctgggcagaggctgcaatctcggcactttggggggccaatgcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcgtcgcaggcactcggcaggctgaggcaggagaatcaggcagggaggttgcagtgagccgagatggcagcagtaccgtccagctttggctcggcatcagagggagaccgtggagggagacggagacggagacggagaggggagaggggagaggggagaggggagaggggagaggggagaggggagaggggagaggggagagggagagctattctaaggtctttagaagcaaacagtgccattgagaattcctcaaagcactaaattacaaaaatattcacatagatttaaaggttaaacctggcttatagcaggtactcaactaatattgaatgaattaaatgaaacaactctttatctatcaggtacctttacaaagtgtacactaccattatgttataatgtattagtctcctgagtctgttgtaaaaagttaccacaaacttggtgacttaaaacaacagaaatgtattctgtcatggatctggaggccacaattccaatatatgttagaaccgcagcttattagaggaaataagcaagtcagaatgcttgactgtacatatcattctaaactgatagacttgacctgaggcctttgacctcttacggaacaaaggacaagtactttgtgacagctatttttctattttattatttgcctatatttgaaagcacatttaaatgatagatgttgaatttgttagaaaagtgtcagtctttaacttttgaaaaaatgccagttaataaaaaggatatataggtatcaagtatccttgattgtgttgtatttaaaaacagtcgtgcgtatgtaaatagttccaaaaatatgtgatagctacagactttttggttgtttatggaaatatatctcaattatagctgttttttataagcctgaccatcatagccaatcactggtattaaaaaaatatatatgtatattatacgtatatattttatatacataaatatacatatatacatatatatctataccttatatacctatattattattctgctttttggtagaaaaggtgtgtgtgtatatatatatatatgtacacacatacacctttaatatatcatatgtatatatacctttaatatattacatatatatgccatatatatatatatatatatatgcaccgttttggggtgtgtgtgtgtgtgtgtgtgtgtgtgtgtgtgtgtgtgtgtgtatatctatgtatatatatacctgatatacctgtatcattctgctttttgaccttatctttgaaaaactttgtcttcttttgtttttaaggatattcacaagaatatgaatagttcgaaatgtaaaatacaaactgctgtagggtagaaaaaactgtagtgccttttcctcagggattccaagcgttgtggccaacactcctatgccaaaagacgttaataagataaaagcataacagaattaatcaaggtattttgtgacatggaaggcttcagaaatgaagacccgaagacccagggaaaactgtatttctgtgcttaagttcgatgaagcatagacaggtgtggagaaatgtgattagacaaaagggtatgatctagtgttaccagattgaggggggaaatccagtgaggcatgtttgttcagattcttctggcctctttgtgcagcattctttcctccaggtacagggcaagacacctgtcacatgtgggttttcaggggagaacagagaaggtcagagagtgacatttcttggttttatggcttgctttgggggagaggagttctagtttctatgacttacctgagagtgtgggtggagaggaattctggtttctatgtcacactttggaggagaaaggggagccggagactggagggtgggagaaggtctgatagacctgcttctaaggtccccccagtctcctccaagtcaaagtactcagcatacaaaggtgccatactttggggtattgtgttctgagttccaacatggcaaacatgcccttttattataaaatggctttggacattttactgcattgccttaaaaaataaccaaggaaatgtgccaacatttataaaatatatgtgtaaataattatatgcattttaatgtttctatcaaaatatagactagtatagataggttttgagtttatcagttgaacactgtcaatcttaaattttaagctgactgtggactattttatcttaaagcattgtctaagagataaaagagtatacatttacaagattactttctaatttaaagggaaaaaagattagtattctcaactttaaatgaaaatcagtagcagtgaggaaatatagtactagctaaaataggcgtcttgcagctcatgacccttgagtttatgcttattatatatgtgaccttagagaagtacctttacctcagttaacttcaatgtccccatctgaaaaataggagttgtgataatgatatatgaattacaagattttttttctgtattaaataagatactatacacaaagggcttaaaacaatatctgacaaatttatttatttattttttttgagatggagtctcactctgtcacccaggctggagtgcagtggcttgatcttggctcactgaaacctctgcctcctgggtttaagtgattctcctgcttcagcttcctgagtagcttggattacaggtgcccgtcaccacgcccggctaatttttgtatttttaggagagacagagtttcaccatgttggccaggctggtctcgaactcctgacctcaagtgatctgcccgccttggcctcccaaagtgatggtattacaggcgtgagccactgcacctggccgacaaatttattcttattattatgcatcatattaaaaattaggctttttaaattttttggtatgcgtcattctctggactgagcatcttaaggacatagaaaccatatcttaatcattttttattgtggcttcatcaattaacactattttatccttaaatgcttgaataaatgattcactgattgagtgaattgtcggctgagttaactataaagtgtgtgagaggcatataaatttaatcactttaggaaatttttagtttcagtattatatgggaaatggcacacacacacatacacacacacacacgcacattgctgagccaaatacatttgaacatagaatgctctatttataatgaatctaaaagtgttaaattatacgtttgattcttttcatttctaagaaggttttgtagatattattaaatctttgtttacgtagttgttaaatatttgcttttaattttagacaacaattggctgaaagaaaagctcatgttatttttaaaaatgttgctttttaacacacatttcctatattacaactctctgagggacaagtgacagaaatctaactgaaaatagttcaaagaaaaatactgactcagtcagtgagcactccagtggtaggactgtcattgtcctcagataaagttgaatccgggagctcagttgatattattagtactttgtttctctctctctgtgtcactctccctcatccccttcttctcttcctgtctctgtctgtctctccatttcttaactgttcatttctctgagtccctgtggtaactttattatctgtgaggccctatctttctggtgattaaaatggcctctggctacctcagacttacatgattcttggtgccccccattttagaaagctccacatttttgtttggtctgattttgatgacatgctttgatcacacgcccacgctggaatcaaccctagtggctaaggggatatgttaccctgattggccagtcttgggtcatatgcccagcactaagataaataatatgttcggcccacccgagccgcaggtactgagaactgtgatctgttctccaagcttatgctgggtaaatacacacacacacacacacacacacacacacacacacacgcacacactcaaatatcacatgttactatgttgatgacactgtgataaaaattggacaagtcttttataagaaaggcaacttgacatattggaaaaatgtaggaggcagatcattttcactcctgtacattttggctatttgctgtcatcagccaagttatataacctttctgagcatcaattacttcactgtaaacataggatagattgtgatgaaaattaaatgatacattatgtaaagaacctaacctagtacttagcacatagtagataatcaatgtatattaaatgtgtaatcactctttgataaaaataccttaggattcagaaaagggaattgaaaagtggggaaggggtatgaaatttaaagaaatactatctgttccctttataaaaaataaactttttaaagaactattctagatatgcagtattattatagttagttctttttaaagaactattctagatatgcagtattatacagttagtttctgtataccctacgcttagttttccctgttactaataacttgcaaaagtatggtacagttgtcataattaatgagccaatatatgttactaactaaagtccacattttattcagctttcctcagttttccttaacattcttcttctgttccaggatctcatccagataatcacattacatttaatcatcatatatcaataggctaaccttggctgtgacagtttttcagattttccttgtttttgaggaccctgacagttttgaagagtactcactaggtattttgtaggatgtccctcaactgggatttgtctttatatgtatattttttcatcagatgtttctgggcaaaatataaggtcagagacttgtcagtcaccttcatccctatagcttagctcattatctgttgcatagtaggtgctgaatacatgtttttctgccaactgaaagaatagatacagtggtagagattactgtttatctagtcaatattctttgtttccttctgccttactgacaagaacatactttaaaaatatatactcaattgtttgttgattgaggtgaaatttgtataacataaaatcagtcattttaaagtgaaacattcagtggcatttagaacattcacagcgctgggcaactaccatctctatctagttccagaatattttcatctacccaggagaagttgctgtacccattaagcaggtgtgttccccatctctcccacttcccctacccccagctcttggcaattaccaatctacattctgtttctacagatttacctattctttatatttaatataaatgaattcacacaatatgtgactttttgtgtctggcttctttcacttagcataatctttttgatgttcatccgcattctgtcgtgtatcaacatttcatttctttttataataaaagcctaattttttttggaatagcaatgaccaagtttaaaactacattccctttcctttggtcgtgtggcactgatgccaccaatgatgtctaggaatcccgataaggcctctaggcaattttcttacagacagctggttcagcctgcaagtaccctgtttgctcttttcccttttccttcttcctttctgaaatacaggtattatggtgagagctatagatctaagcaacataacacaaggatgatggagtgaaaaggtgaaggagctggagtctccgaggacaccatgtagctgccataccagccctgtaatgactactttagccttcattcatgtgaaagagaaatgaacatctagtgcccttaaaaatattagtatagcaattcagattttactatgcattagaaatccagtgaaagctagagacatttcctggccaatgggtttatcataattctgaattaacctatgtaagagaatattcaaatgtccactgaaatcaatgttctaattattattgcccttgtcacccttagcttactattcctgtgttcctagtatggcagaatgaaaaaggctaaaacgttatatctgaaattggaggttgctgacctgtaaaatgagttagttagacaacaatataccattataactccatcttaacacatgttaccacccccttctggaaaataaatccaagatgtctgtagcacctttgtagccctgacggaagagtcaggccctttgtgttgcctgcacattcacttaggagagaatgaagcgtgctaatttgtggagcatataatctattcttttattaaaagtgtatgacaaatggatacagagatacctacctggcatactcatttgcatactaaaaatataatctttatagaagacaaaatagaatacgtccttgagcaaaacagagggaacaatttagtgttggaatggctaagaggttggaataatgatgactaaacttgaaagtgaagatgaaaaagttgagtctgaagggcaatgaaaagccagtgaggatttttaaaaataatagtgtagttggagcaaaggaggaaaaagttattttggtagaaggaacattttctattacgtgaggaaggtaaactaatgaggagactggagcatggagtatgctaatatgtgaatgaaaatagtgagtacattgagagcaaccttaggattgaaaataagcttaaaaatgaaaaaatgaattaatatactgatgtaccgtgattgctttgctttgattctttttttaatttttgagacagagtctcactctctcacccaggctggagtgcagtgggatgatctcggctcacggcaacctctgcctcccgggttcaagagattctcctacctcagcctcctgattagctgggactacaggtgcacctgctaccacgtacggctaatttttatatttttactagagacggggtttcaccatgttggccaggctggtcttgaactcctgacctcgtgatccacccacctcggcctcccaaagtgctgggattacaggcgtgagccactgcacacggccttgttttgtgtgtgtgtgtgtgtgtgtgtgtgtgtgtgtgtgtgtgtgtttgttttgttttgtttgtttgtttttgtaattttagcttcaggaaaaactttctgaggcaaaaaagttaattgggacttaaaaccaaagaccagaataagtcattcatttgaatacatttattgagaatttactatattccaggactctgctaggcattggagattaaattgtgaattaaaaaataaggcttttacccccattgatcttaggttttagtgaaggaaagacagtaaacagataacaagtaaatacttaaagagacagttaatagtgtcacagtttttccaattttagttccatttagcagtaaaaacagaataaaatgaagccacatgtaattggaagagagaggtcaagcatgtaacttttcttgaagatgaatcattcaacaagcatgtttgcatctggtcattagtgatgcgtttgggcagctttgccctcactgtcctcagtcacaagaaaggatggacatgagcagaggaccctgtagaaaaaggcagacatacatgacaatatgaagtatcacttggttgcttttctaattatttatcagtttttaaattgtaaatatgacttagactgcaggctagtatcacctgaattgtctaattatgctaacacgctactaaaaattacgatgttgataatgtgtttctctttaagttcaagtaaacatcattaaaagaagcacaaagcaagtgaaatatgcatggcagagaagcagtataataagggaccattgctaggtcacaggttccaatgttaacagcgaatgaagccgttttcttttttttctggaatagaatttcaagtagatgatgactgaaaagtcgttcttggacagttcagcctcattacttctggaggtctctctcatcagtgcctagtggagatgacaattcctaaactgtctgcaacaagtattaattacttgggtaatcaaaacaatataattgttgatttcttccctgtatttattttataaaatgaaaacagctttaactgtttttctggctgttaaaatacaagctccttggaaaaacctgtaaatgaatagtcaaattatcaataatggttttctcccatggtgagattgtaggtacttttgctttcttgtatttattttccatatttttgttcccagtgagtcccacagggagaagctgagatgccataaaggaaaaattggggctcatgagcaaatagggtaaggacccagaagtggtacaggcctaatggttccctgctttttgttttagcccaggtatccccctttccttgggctaatgtagatgagtcttttcctttgcccccaaagaaccctgctaaaaccgggtggggctacattctacacttgtatttattggtcatcattccacagaaccaagcacacagtagaaactcaagaaataaaatacttgattttattaagtgtcttatttcctgaaagtatgaaataacattacgtggtggagatatggttaaaaacaatatgatcaatttcaggagaaggaaacactccataaagtgcgagtcaacttgatgatattctatgagaaaagattgatttgtagtttttttttacattagaaatctcatatatgtgtctttgtgtgcaatatttatttaaataaaggctaaagattcccaaaaacattagtgagaaactcttcttaattagctttcacttcttggcccacattagtctttctctctctcactttctcacacacatacacacacaccacacacaaatgtaggtaggagagcaagggaggaattccgcattaggacatatcgaaagtagattaatgcaaatgaacaagatgccaagtacagtatgaaaattgacatttatcagcacactctgtatgaagatattttcaaagctttgccatacatatgaaaatattccatttttatgcttatgttttcgttattcaatagcatgcattactttctgttgtttccaaatgcaagttgtaaatctcctcagaaaatttcaccgatgtgagatttcacttagtcttttatggttgggtggatcatttcctttcaaccagaacagtaattccatgtaaaagagtaagaataaattgaaatagaaagccatgttgctttgaaattgaaaaagaaataaattattaattttagtggctttttggccatacttaagttcctattttcatctatggaattatattttaacatcataaacatgaactatgttttatgttcacagaaaagggaaattttcatctagctattcattttacatagctatttgccttgattcactttccttttttaaagtatttataaatttcatacatttttaattagacaaatgatacacacatccattcctattatttaagaaaagtaaaaaaataaaacacacacagggaacatcttaatctcccttggccattactcactctactctccaacttctccagaggtaaccatgttttttttgtttttgtttttgtttttttgaaacagagtctcgctctgtcacccaggctgaagtgcaatggtgcgatcttggctcactgcaacctccacctccctggttcaagcgattctcctgtctcagcctccccagtagctgggactacaggcacatgccaccacgcccagctaatttttgtatttttaatagaggcagggtttcaccatatcggccaggatggtctcgaactcctgacctcgtgatctgcccgccttggcctcccaaagtgttgggattacaggcgtgagccaccacgcctggccaaccatgttttaagaccaggacacgaccaatcagacatttttaatggaaacttgatggattgtttcgtagatcatctttttaactgacagagtatttcacgcttaaactacacaaaagttacatttaatcgtttccttattggtagatatttagaattatccaaatgtttcaccattacaaataatgcttcagttataatccatgaatatgcctcattgtacacataagcaagtatttctctgggataggcactaagaagagaaactgagagtcaaagggtacaggcatcatgaattttaatagatactgccaaattgccctccaaatgtcagtatcgatttattttctcaccagtaggatatgagaattcacagcccctctatcttttggaagcactgagaagagaaaatgctattgacatgttgttgtaatatgcatttctctgatttctcacaagctctggttttcatattcttagtgtctattttgtcttccttctctctgaaatgcccattgataacatttctccatttttgtattggtttgttttatttttcattgatttatagataatattttgtaaattgttcattttaattttgttggattttatatcttgcagatatagtatcttatttatcttctttttactttgcttaggttgttgaaaattcttaaatgtttacaggttaaatgtatcaatctttgtctcatgttttttccccttgctgtgttatttaagaaagccagtatcagactctaaactctggtacatttataggtttttaataaaagcaacttgatttataatccatctagcatttattttgtgaatagtctatgatagaaattgatatatatatatatgtttgtacaaacatgaataatatatgacagtttttcttttaattattaaatcaccttacaaatcaaacaactatggaatattattagcttaactacctgggtgattagcaaaagttttatatttcctttccctatactttttaatatctactctaaaataggaaagttactttctctggctttgagttgtcactaaaatatattcctttttgtttgttaaggccagtcagttcttcgatttgaagcccaaaaggctccaatgaggaaaagattcatttcttctctctttggtgctgttgttaatatcctcactcagatgcagtcaggaatatagtaatgcctgtctcccttataaggaccattatgattacattgggctgatctggctaaacctggataatcttctcatctaaagatccctaatgtaatcacatcaacaatctcccatttgccatgtaaggtaaaacactcacaaatactggggtttagcatgtggacatctttgggaggccattattcttccctccacattgtcaacctctggtccaactcacttgtcatcagtgtaggagtgcctgtggaggcaggtagagtggtaggagttgggaggattcttgattgccttcagctgagcttgaacctgtgctcttagtggagcagtttcatttaaaaggggatgtggctaagcaggcaccataaaatgtacttctagtagcatccctgaattgaaagagtttacatataagactgcatgataaaattaaatgagttacattttgtaaagcaggtagaacaatgcctgagcagagtaggcatcatatacgtatttgtgcttgttaaataaaacccaaaaataatttccacgaggaaaggagtttcaagcagataattaatttgcgaatgtgatatatcctcttgatccagggagctaattgattttgtgaattacatttctcagggtacactaaatcctcactgttggctatcaagaggaaatacaccttgacaggtttctccagtggtggtgaagattgtgtatggattatacacttaattgtcacatttttaatgagaataacagcttaaaatcaagagtgaaacatatacgctgaaaaatggcagtattaattagctcattccatatttattgaacaactacactgtaccagattttacagagcatcagtgataaataacagtccttgtgctcaagccttttgaagtataatagggtgaattcttttgggtttgcaaatacagtctcccccaccccttatttgtaggagataggttctaagacctaccttacccgaccctgtggatgcctgaaaccatggatagtactgaacctgattttgtcaaatggaacatgttttttatcatgtcttccacccacaaatttaatgccttttccatcttaactaagaacttatatactgtggctgtaacttttgcagttagaggtgcaactgcaaaactagcatgcatttctttttctttcttcacaatttctcagatagaaaatttcttcttactgtagatcttagcaaacagtatatggtgattttttttctttcttttcttttctttttttttttttggagagagagggtctctctctatcacccaggctggagtgcagtagcatgatgatggctcactacagcctcaacctccccagctcaagcaatcctcccacatcagcctcccaagtagctgggaccacaggcacatgtcaccacacccagctatttttaaaatttttttgtagttacggggtttccctgtgttgtcctggctggtctcaaactcctgggctcaaccagtcctcccaccttagcttcccaaagtgttgggattacagatgtgagctaccatgtccagccgtttacttattaagttgagaatttttactttttcacttaaaggaagcactttatggcttctctttggcatatccaaattgccagcataactattcttgcattttgggaccctgattaagtaaaatagaggttacttgagcactagcactgtaataccaagacagttaatctgatcaccatgagggctactaagtggctaatgggcaggtagcatgtacagtgaggacacactggacaaaggcatggttcatgttttgggcagaccagagctggacagcatgagatttcatcacaatactcagagcagtgtgcaattgaaaacttaagaattgcttatttcttgaatttcccatttaatattgttggacctctgttgactgtgggcaactaaaaccacagaaagcaaaactgcacgtaagggggactactatacttataatacaaaatgaattacactgtggcccgaagaaaatattaaaacaaagtggtataaagtattataaattagagtaatcactcttgtaaagatgtcttagagtaacaaggtagtatttgaaatgagctttgaccataaaggtgaaaatgagatgggacaccccaggtaaggggttaatattacctaagatagagagagagaaaatccaaacctttaaaataaaacagcttggcagaaatagaggatgttgcacctataattgtagtgagaaagaaaatggaagagttcaatgtaacttttggatcatatctgggtgtaaggagttaacaactcattaacaagtggcctaagtgacaaatagtgaaagctttgactaagatagtaagaatgaactagaaaggaggggctgggtatgagagacattgtgttaaagcagaatccacatgatttagcaactgatttaggaggggagagaggggcccataatgactgctttcctgcttggatgactagaataatgtagtttcagaatagaaacaggaaattggacagatgatgtattcttgtctttaaatgaatggatttaagatgctggaagaattttgagggtgactctttcaaacaagtatttgaaaatgaggttggacattcctgagggagatagagaaagatatttgggagctttagtctaaaataatctcaaaatgggagaggggagactttgtagctcattttgtcctatggactcatcttacttgagttccagccctttccttgtaactgccaaatgtttttctatcctgatttgaactttgagtctatggaggccaaacccgtggccccctggaggttacctcaaaatcactgacatgaggcaaattgatgagtgggataaatggcatacaaatttatttaacttgtatatacgggagccttcagaatgaagacccaaagacacaggggaaattgtccatttttctgcttagattcaacaaagtatagacagccacgcagaaatatgactggacaaaaatgatatgatctaatgctgatagattgagtggggaaacccagcaaggcccatctgtctagattcttcttggcctctctgttcatgtatttcttccttgtgggtatggatcaggaccctctctggaatggaggtcttctgacctatagtcaaacaaggtaagtgagatcatttctttatggccagtttgtacacagataggacagagagaaagttagagtaatatctttaagtttatgagtggctttgggacaaaaggagttctggcttctatgacctgccttggggaagagggattctagtttctatggccagcctccgtggagaatgggatagagagacaggagggtgggaagaggtcaaagaaaaacttttgcttctgaagctgtttttgaggctttcattttggggcattgttttctgagccccaacgagtctatgacatcctgaggcaggcaattctgtttgtaccattcagtttgaaatttcttctttattctgagttgtctaaagttctttccctttgaacctagttctacatcttgggaccctaccctagagcatttgcggttctgtctcacaaaagctcctctgatgttttaagaaagctataaagtccctctttagcctcctcttccagtaacgcagggagtgtaaatggtgctcagcggcagtataatatcttcatgccctcttttgcttgctccctgctagagttttcccagatataaataaattaatagaaaactaaaaacaacttgcataggttctaggctcaattaatctaacatgtgaaattgaaataaaaatccttcacagaaattaatagggtttcaccatagataaatgcctgagggcatatgtccacctctgtcacctctcccgcttccaatgctcctttattcttttataggctaaacatctctacttggcacaatggttcatgtgacagtttccagtcatatcactgtctttggtctaagtagcatggagaagaacaagaccagcccctcccttggtctacatactgttattttatatatatatatatatatatatatatatatatgctaaaatcagttgtgtgtttggatacacccccccccccacctggctcatagacacactgccaccaatgcctgttaatcatctgcagctcgctatgtaaccaagtggaggttcacccttcactgctattatatttcaccttactatccatcaggtcctcagataacatcgttttgttcaatgttgtttcattataacactgatgagaaaaaaaatcaatccccagccaggaccactgtctatgtggaatttgcatttctctgaatgtccgaatgagttttctctgggtactctgttttcctcccacatccaagatctgtgcatgttcaattcattggtgtgtctgagtggttccagtctgagtgagtgtgtgtgtgtgcgtgtgcatgcgtgcacaccacacacacacccagcgatgggctggcatcctggccacagtagatttctacatggcgccctgagctgctgggataggctcccaccacttgtgactcggaactggaataagcaggtaaatcgtgatttacttattttatgaatctttcttaaatgatgtatagctcatatgtatttcaatgtttaatattagaagtacgttggtctttagaagttttgtgatattttatgacaagaaatatgttacaagaacttaaatcttgtttatatcaattagcctatgagaaaattggttgtgtatgaggttgttgcacctaaagtcgcagtttccaagaacctatagatgacattaagtgaggacttactgtagttgaaccttactctaatctgcacgatcatttagatctcaaattgatcatgtttatcagcttgccttttttctctcttgctaagacattgttgatgatgtagaattttaagaaacttacatttaggatagtgtgcttgacaaaacagtatttttccagtttgacattaagttgtcaaaggtctgataaggaattttgggggaactttattgaagtggtatagatgttaaaagtgctttttaaaatgagatgacacttggtttattctgaatttatttatataaaataacactgtcttacgtgttgagaacttagacttttgattcaaaacacccagcatcaagtcctggtctaccatttatagtttatttatgctccctgaatctatttccttaagtgttatatgaggctattaatgccttcttcctaggctattgtgagggtttgaggagacgatgtgaataaaacacttagtaccttgtttggtatataataagtggctgttatttttctatgaaagtctgattacagtataaaatataactttattccctttgcgttcattttcatgccgaaaggttttctttcaatatgaaattggtatttaattgtataatgaatacttaggaagaaatatcgaatgtacatggtaagccttctaatgttttttgtaagaatggattttgatttgccgtacattcttttcattctttgcgtaagcagcaatacttactgattttgaaggtgataaaggccaaggatgtagtctagaaatccatgggcttggtgttcttaacttttgtgcttttatccaagctgccctaccatcatgatctgtaaccttcaaaatccatccctttttataaacagtattccattacccatttgtcatagcttgcctggagtaaagaaggatactgggaagatagtgggcactcttacttcaatgactgaccccttccccaccatttgttctcatcagctgtttttaatgttccattaaatctctcccttgaagttttgatattatttattatatttttcatttctggaagttcaaataattttgttcaaatcaggtaatctttgtagacagacatagaaatatctgcataagctttatgcttatcttttatttctttaacctacttgttttaaaattgctggctgataactccaatattcatagtttcaccacagagagcaatagctgctctctgctctttcatatgattcttgctgtaggtactgtatttctttttgtgtttagttgttttgttttgtttctatttcaatgagctgatcagtttccctggaatgttatttgtggggattctctgaggcctaggttgaagggaattcttgtagagaggatttccattagccttggcaggtgcctaaggtataaccactctgggatcactataaattaaatgaaattcatagcttgaggttttgggggaccatccaagtaataagaatttgtgctgtaaatctatcttaaggatatataaggggtggagatggtcaagtttagttatgtttcattatttttcctgaggatgtagcccttagctttactgggtagaggttctctccaatttgagatttaaccaagcccccaccccccatccccatctctttagcctcctgctaccattaaacctaggctcagactactggaatgtccaggatcagtgtcctcaggaaaaatgtcttcagtgggccacttaaccctttgagctctgattttacttagattttgggcataggaattcctatcttgtgaactatttgataactttagaaaaaaaaaataacccagtgttgttccttattttcagtggaaaggttgctccaattaaccttgcttgccatattaatagaaatagaacttccctgttatttctcacttaggagttttctcaaccagattttatatttaacatttcaaatttcttggcacaattctcattctctgaccctacttacttgctactggcagctttatttttaaactctgctttagcttttcttttctcctttgtataacttatccttcaacaccttgaaatagttaactcctgtgagtgtaataggaaatttacaaaaaataatctttaaaaaccaccagattatttgattgtgtgatccaggaatgaatgcatgtcttagaagaaagagggcaaattgggtgaaataaaagatgttaagcaagaaactcatgggtggaaagagagtattattgagatgattggcaagaccacttaggctgtcagataattaaatgaagccaagaaggggttatgggaaataagctgattacggcaggtaagacaggaaggaatgatggaagaactggaggaaaaggagcacctattaatcttggggaattttatcatgtattcagatttttaaaaaatcaattaatgaacatttgactatagaccatataaatcagggctgattcatagttttcccttttcttaaaactaattagcagatattagctataacaaaggatcttttgacctcaaaagaatacccttggtacattttctcatcaaactaatacttagaaacaatagggaaacaggaaattaatgagacatctgaaactttatgatttcttttcatctggaaatattagggggaaatcaaataaaatatacattttatcatgctgtttttacatcagacttttcccctagtattctttctcatttggaacatgttaatgtactacaaatgaaagaggatgaaacacttgaaaaatttctggattgtaatatgtttaaaaatatatatagttctccatctctcattttctacatttttccagtgttttttttttttttttaaatttgcttagccacgattcattactcattgaggtcctcctctgtccctggcactatggtaagtgttttgtgttttgcatatagtttctcattgaatcctcagaaaacctatgaggttctaattattattgccattttactggcaaaattgagactcataaaaaataagcaaacaaataaccttattgtttataaagtttacctatatttattttgatgtgcgttttaattgttatcttcatatcaagcctatgattttgtcagatactgttattattttttttaatacatgaggacaaagaagctcagagaagtgaagtgacttgtcaaagcttccagtataccgatacagatggtgctttatctcaaagcttctaagtcacactactaattttctacaatgctacacttatttggaagataaacataggatgatgatgatgttgatgacaatgactacttttaaagtggtacaaagcttgagatttagaaaaccattagtatccaacactagttgtatttggtaatacagattctcctctgctcctcatagtttagtgtagcctaccttaaacatgttcagcacacttatgttagcctacagttgggcaaaatcgcttgacacaaaacctattttatgatctcatgtaatttattgaatatgctacactgtagagtacattatccattgtttatccttgtgatcgtgatggtgtggctgactgggaactatgtctcacttctgctgttcagcattctgacagaagatcacacaaatatcactagcccaggaaaagatcaaaatccaaagttcagaatagtatttctactgaatgtgtattgttttacccatcctaaagttgaagaatcacaagtcaaaccatcataagtccaggattatttgtttatatatcttgtagggaagggaaaagtgaaaggaaataatgttctttctacccttctacattattggctggagcccctgtaacaaaagacaaattaacaagagaaaacaaacaggagtttactaacatgtatatctcatatatacatgggtgatacccaaggaaatgagtaaatctcaaagaggtggcttaagaatcagtcttaaatacgatcttcacctaaaaacaaagaaagaagggtatgggggaaaccacttatgggggtgaccaggaaaagtacagtaaacaagagtaaggttttttatgcagatttaagccatttccttcttcattaataagactccagtcttcttggtacagacagaaagagacacccttacaaatgaaaatttacgttataagtgtgaatttgccttacaaaagggtaacttctactttgtttgcagagcttcacatgtgtctgctatttctcaaaataactagttcaaaataatccttatactgaagaggcatattttggggtatcatattctggtctcctacaatcttaatatcaaatgccatagaaataacccaaaggatgggcacagtgtgtgaaaagttctaggaagaatataacaagtagactatataactactaatggcaatctgtgtcccaaccatttatttagctttatcagatatatttttctgaagatacttttctttctcatgtgctccactggttaaaacccagaaatacttgtagcataaagatataacccacaaacagcaatcatttcttttttcttgggtgtcagaaatagctcctttgtaaattcaggtgtgatgattaaagtaaaaacgagcgtgagataaactgttacgctaattatctggaattctttttgagatttttatgttagattgatttaggtgaggaagtatggcatagggccataaaatcagaggaaaaagaccgtatctgtgagttataaataatttttgtattaaaagggaatattcagtatagtacatctcttcaatttctaaaatgtctatagtaatattttaaaatattcacagaagaagttgaagtattattgataaggcttttgaagactattttgttcattaagtaaacagtaaaaaaaaacattttttgttaggtaaattttcaggattactcagaataagaatacttacagatataagggaaaactacctcaaaaggagtttaaagagattatattaaaatatatagtttgtacctaacgattaaaattttgtcctgagctcatcttaaattatctttgaaatcattaactatgtgttctgaaattttattttgggtacaaattgtttgagatggttgtttattttatgtatatatgtattcatgcattaattcatttgttcattcatattttttgtaatcttcagttccttatcatcattggcccaggctagtgctgtttcttcattatatgtgcatatatatgtgtgtacacgtgtgtatccatatatgcccttatacctacgacactaatccctttattctcctacagtgaggcaatcgttttaatgtactcaacgtgtatctttttatttgcacgtgtttttgtaaaatttgtgttgttggtttgtgtgtgtatctttttatgtaaattatgttatatatcatatactgttttctacatctttactaagcactatgttttaaagatccatttatactatatacatacatatatgtatatagacatgcatatatacacacacatatgtatattttgtgcatatatacacacacgtgcgtatgtatgtgtgacacatacacacacacacacacgcacacactcacattctaatttctaaatgcttcgtggttctccatagtgggcatctactacatttgaccctattccctctcccaatatggataaccagttgcctctacatctatacgaccgcaaataatgctacagtgaacatcctctcatgtgtccccttatagatccctgtgagaatttctctgagatatacatgtgggagtggaatggccgtgttataggtaaatatctatttctgtgctttccagaattttgcaccagtctgcactcccactagaagtgcttgaagattcccacgattgctcatttccatcagtatttggcaatgagtagtgttctagttttcgcctcagagaaatgtttaaactattttaaacacaaggttttcaagagtattctagtcactattactctgctgataaacctttattattattcatccaccaaaccaatctcaagaaaacctgtactacatgataatttgctagttatggtgtatgtattgtaaaataataaacttatttccttagaaaaattctttcagatattttattaatactgctaggatttagaattggtgatagtttatcttacattttatttctaatttgctcatagcaaattatattcatgatcaaagaatattttctgtcataattattgtccaaacagtgtttaggttgcacatggaatttaaaagtactcttcagtgagtaaatgacaaaatcctgtttttttacttagaacacttttaatactgtggttcacttttctataagttatactagtgggataggtcacatgcagactaaatgtagaaatataactaggctgtggaattaattagctttgattttgcatttatttgaaaaacaaaaaagaatatgaagaccactgacatatatttccactatttttctttttcaaatcatacaattgagataaagattcagtacttcctccaaataaacagccccgtaatagcagaaatgtaaattacaacacttctaaatctgtttttatcaactattgacctaactttattaaatgtacctaaaaatgtagggctactaagcagctggaaaataatgtattcagtttgtagaggggaaagacacgatacctttcctccgtgtcataaggttcttggctgacactcctataacaaaagacagattaacaagtgaaaagcataacacatttgtttaatcaaaattgtatgtgacacaggggacttcagaaatgaaaactcccaaacccggggaaaacgatgtcattttgtgcttatggttgttgaagagtgaatagctgtgaagaaatgtgactgaacaaaagggtatgatctagtgataatagaccgtggagggaaaccgagcaaggcctgtctgttcagattcttgtgacctctttgtgtagcattccttcttctcaggtaagggcaggaaccccctctgaaatgagggtattcaaggtataaaggaggagagggtgacttttctgggttttatccttgctttgggcaagaggggttctagtttctatgacttaccttggagaaggattctgtttttttataaattgcttcagagacagaaggagggataggagacaagagggcaggaggtcagaaagagaatttgcctctgaggctgcttctgcagccttccaatctcctttggttcaaagtaatcagcatgccaaagcactgttctctggggtgtcattttttgagccccagtaagtaaaagaagaagaaatcatgggcaagaaaatttcattgtctgtgtctctatctctgtctctgtctctctctacgcacccaccccccgccacacacacagagtaacaaattcacataaagaattgtaaagttattgtcaagatattttacttcagtacttaaatattaattgggtacttaccaaaaagcatgaacataaatacatatgtgttattttatatatatattatttataattgacaaataattgtatatagatatggggcacaatatgatgttttaatatatgtatacattatgacatgattaaatcaagctaattaacatatccatcaactctgctacttatcattttgtcacggtgagaacatttaagatttactttttaagcaattttgtaatatacatcaggccgggcacggtggctcacgcctgtaatctcagcactttgggaggccgaggcaggtggatcatttgaggtcaggagttcgagaccagcctggccaacatattgaaaccatccccctgtactaaaaatacaaaaattagccaggcatggtggcacatgcctgtaatcccagccactcgggaggctgaggtgggaggatcgtttgaggctgggaggcagaggttgcagtgagccgagatcacgcatcactgcactccagcttgggcaacagagtgagactccatctcaaaaaaaaaaacaacaatgtaatatacatcgaagaccttcagtctaattaggcaaacatactccaaaagtttattttagcaaaacgtggtttatatactacaataggctagtataaagaaaatatgttcattcagattttttcctcttaaacttatcaatatatctgatgtttttagaacaaattccttactttcattattttagccactactgagaagtcaatcatcaagtcactcatagtttgtctacttagggcctttcaccaatactcagtccctttaactggctacaccaaccaccatcacccttcccaaaaatacaacagaaaataaaataaaacaataattatagctcagtgacttcagagtactatcagtctatcactgtcagtgatttcttaccacttgtgaaatttcaaaagcctgccatgtactatttgtcctgtcaactcataccaggatcgtctgccaaatatctcaacatgaaggctctgtacaattacagacatctccatttgattcctcctctgaaatgtgttatttacatggttttttgtgtgtattttgcccatcattcactaatagtggcttactccaatgatatatagctatcctcccttctttacctagttaaatttcccagatgctcttcataggatccctctcaactattcaaggtctctttctatggtttaagggcttctcataaatgcagcctatcctcattgggtaaactatgggactagttagaggatagcagtaaggtgcatactccagcttttccccccacacggattcagactcatacttgggtaccttctgcctgaaggtgatggtggcagatactttgtaacccctgggttactaaatccttctcaatatttctaggtagccatgttattaccattccatttccacaaagatccctcaagtaccagagccaatattcaaacccagatctgtgggaactccaaatgctattctcatctctatatatgagggggtggggagctcaccaattctcttgacatgccaggagccatcttaccctttattttggtcaattttgttttgttcttcttttctcttgagctaatatttatacgctgattatgtgctaggcattgtgctaaatagtttaattattgcatttcattcccataattttactgaggtgtggctttatgaatgagcaaactgggacttaatgagtttaaataactgacccaaagtcaggcagctaataaatggtggagcttggatttaaacccagtctgctttaccttagcagccatacactaaacctgtaagcattcccaacaggacacatgggtttccatgattcagggtttcgtaaattggttaactgtgtttcttaggatcatgaaaaacctgcaggctttcagatttatttgaattatttttgaccattgagtcacacatggagtggattagttaggaaataattataggagtcagagttaaaataaaattaaatccagattggttataactcacacatttcactcttttatattttagcttccttttttttacataaataccacacatttaatagttttaacttgttattttggtcaaaataaattttgtaacgctgattcttctgttgtgtttagactatttggttgaatcaaggattttaaaatttgagtttaccaagttaagcactaaatcgaagtccaaaaccatatctgctttttatcccagtactttagacaataactagcacatagcagttgctcaataaatatttatttagtgaatatgtggaattactatacatttattattaatttgtacatcaaatgatctttcatcttttccttgaaaagtatttcctcattgaagaaatgctcaaattctgatacatctttcttcctaaaagagtatctttctaaagtccctaagcttttaagggtgctattaaatatatgtaaataatgattaatgaaaaatcaatctaattttaagatagtgatgcataccatctcacacaatgtgttttttcccagcttatgataataaaaaaatgtctctgagatgagaaagcatactgtatctgaaacctagccaaccacagctgacatcctcactgaaggttagctggtgttgactgatgcagggagggtacagatggaacaactgtagagtatagaatctagctctatgcgattttcatcttcctcagactaccttagatatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaatattgtactttgtgctaatataattcattagctaaaatattcatttttgtagagactgagcaaaaggatagcagtcttttaaatagaaatatcatacagtatggcctttgtggtcagtatacaagacaaatatccacatggcatttatcaaataaaatttatgtatgtggacattttatttacatgcatatgttggaagaaagccatgtattttaaaaataaaaatgagctgatcattctacaaacgttgcagttgcctattataatgaaattgtgtgttaagtgtcactcttaaatcaatggagatgacatttgcatatcagtttaattgctttggattaaacattgaaagatgagagccaagagagcttattaagctgaaatgagggcaagtgataaaaaagtgatattatgtcaacactacatctggaggtctgttgttgtttccattttaaattctaaattgcagtgtttctaaaaaaattatcatcaaatgccatagttttgaaatatagtacaaaaattaaaacagttaatgcatcaattgtgcttgataaatacaatttgatttgaaagccaagctagggttttctctactttgttgaaatgtatttcttcttaatgtactagattgtaagattttgaaagcttttgaaaaacattatgtcttatttactgctgtatcttcaggactttgacatagtgtgtcctgtaataggtgctcaataaatatttgtgaataaatgagtcaatgcaaagtatggcaacaccttcatagttactgtaaaacactctaagtgagttcctgggtaccgctgattttggttgatgccagaaactgtatccacagctccctaccattcagaagcactgtgtgctcattggccttcttctttgcttgggggaatcatcagtcattattaaatatataaattcctgcaatgatctactttgaagtaggctatgtggactgtggcatgtgtgaagcaatttgattcccaattctgagggtctcctgtaggggtgtttgatttgagactccgcttagaaaccaccatttgtttgctgtgaccacagcatcagaaaactgatgacccatcattatccaacgataatgcagacctctttcatttgcattagagaatttgcatcacttccaggtattccctattgctcatcggagtgatttcatgtttgccagatagactatattgtgttagatcatctaaaacatagccttcaaatttgtttaaattaatccctccattgcagttatattgggggatttattttatggaatatctaagcatcttacaagcattatcttctcaatccttataacaagtgtgtggaaaaagttctatgaaatatcttcattttacagacgagaaaactgaggcacgggaaggttaagtggcatacctacagtatgtggaagagccaggttttgaaattagacagtctggttccagagggtgtgttcttaaccaccgtgctgtgagtaaataggtgcctgaggttcccctaaggtccctgaaaatgaagtattttgtatgccacatctatttcattgttgtttttagcttttaatcatagtacaaaaaaggtaacataaaatttaccatcttaactttttaagtatagagtttcagtagtgttaagtacattcacattattttgcaacagatctttagaactttgagttttaaaaattctatacccattgtacaactcctcatatcccctgtcatatctatttttaagtactatcatcccaaacatagcacctcaatctgatgagaagctatcatactattatcacttcaaatattaataaacagagaaaggagaatttttgtatttgcatagattagtatatgcccagaattcaaaatttagaaaaaatacgaatgcagaagaaatggagttgtattaatccgttctcacatcgctataaggaaatgcctgagactgagtcatttataaagaaagggggtttaattggctcacgattttgcaggctggacaggaagcatagtagcttctgcatctcgggaggcctcaggaaacttataatcatggcagaaggtgaagagaaagcagtcaagtctcacatgcagagcaggagctagcaggggagtgccgcacacttttaaatgaccagatctcgtgagaactctatcactagaacagcaccaaggggatggtgctaaccattcatgatggaccaagcccatgatccaatcacctctcaccaggctccacctccaacactggggattataatgtgacataagatttgggtggggacaaagatccaaaccataccaggagtgatttgaaataaaaagaaatgtcttagtgatttgtcttcctcttgtttctcagtttgaccttggatatttgcagaagaaaacttttctgatgtagtttatctgaatgacctgttcctaaatcatgacttcagaaatatatttttagttaaaagccaagaaaacaaaaagttatatttaatttacttgtttcttaaacacataagtattatgttaacttctgcataaaaataaattctattcaaacattgataaaaacaaaaagtacagttggccctctgcctttatgggttttgcatccatggattcagtcaaccacggattgaaaatatttgggaccaggcatggtggctcacacctgtaatcccagcactttgggaggtcgagatgagcagatcacttgaggccaggatttcgagaccagcctgtccaagatggtgaaaccccatctctactaaaaatacaaaagacaattagccaggcatggtggtgggcacctgtaatcccagctactcgggaggcttaggcaggagagttgcttgaacccgggaggtggaggttgcagtgagccaagattgtgccactgtactccatcctgggctaccgagtgggactctatctcaaaaaaaaaaaaaaaaaaaaagaaaaaatatttggaaaaaaattgtatatgtactgaacatgtacagatatttttcttgtcattattccctaaacaaaacagtgtaacaactatttacacagttggattaggtattgtaagtacatacattggattaggtattgtaagtaatccagaaattacttaaagtatacaggaggatgtgcataagttatatgcaaatactacaccattttataacagggacttgaacatctgtgggtttcagtgtccacaggaggtcctagaaccaattccccacagataacagggatgactgtatagacttttatatatgtatacatatttaaaattctatgtaaactgtagatagaattttaatcagtaaggtaaaaaacacgaatttcatataaatgcatgcaaaattatacaatctacgttgaagaaaataaaaaggactgaaaaagatatttatattaatacatattttcaattcttaattttctttatgtttgccatcatatttaattctcaaaaataaccctatataatagtttgaaatgtgatgtagtaaaggatgctaggaaaatagacttagatgggtggtgctcaggcagagaaggtgaaaggagttcctgggtgagggtcttcatcaacacatagaagtgagggagagcatggcacgtagatagcaccaatcgttacaaatggtcagagccctagatttgtgaatatggaagtggtaggagacagggaggagagataggccaaatccggatcaagaaagatttcctatagccaaataaattaattttaacgtgatttcacatattatagaaatgaaaggaaggggccaggcacattggctcacgcctgtaatcctagcactttgggaagccaaggcgggtggatcacttgaggccaggagtttgagaccagcctggccaacatggtgaaaccccgtctctactaaaaacacaaaaaaattagctgggcatggtgatacatgctattcggggggctgaagtaagaggatcgcttgagcccgggaggtcgaggctgcagtgagccaagatcgtgccactgctgtccagcctgggtgaccaagtgagaccctgtctcaaaaaacaaagaaagaaagaaaataaaggaagaaactaacaggaaaaatacttttttaaaaaagaaagaaatggtccggcgcagtttctcacgcctgtaatcccggcactttgggaggccgaggcgggtggatcacttgaggtcaggagttcaagaccagcctggccagcatggtgaaaccccccatctctactaaaaatacaaaaattagctgggtgtggtggtgcacacctgtaatcccagctactcgggaggctgaggcaggagaattgcttaaacccgggaggtggaggctgcagtgagccaagactgagccactgcactacacactccagcctggatgatagagtgagactgtgtctcaaaaaaaaaaaaaaatagaaatgcaaggaaggatattaattaatcaaaggattgtgtcgtagttagaaatgacacagataaaaatattttatcataaatccctttgctagtgtcaggacccattctgcttccaacttcataatattatattaccttaagttgggggttgatcaaatattaagaagaaagtctgagaatttttctaaggaccccttctaggtccacaagtcagagtagaagtagtttgggataactgtatgctgatagattttgtgtttttaaaaactacttggtaattattttgtcagttattctagcatcaaatattaaaggttctgacagtcgcaaggaagtgatcaatgatatttgcaaatgctaaagagaagatgattaccagccatccacagggatgattcaaatagcaaatatcattatggtaaaaacaaaattttcaacaaaaataactgtttaagaagcacagttttctgatatttttgataggtcaatttttttttttttttttttttttttttttttttgagacagagtctcgctctgtcgcccaggctggagtgcagtggcgcgatctcggctcactgcaagctctgcctcccgggttcatgccattctcctgcctcagcctcctgagtagctgggactacaggtacccggcaccacgcccggctaattttcatatttttagtagagacggggtttcaccatgttagtcaggatggtctcgatttcctggcctcgtgatccgcccgcctcggcctcccaaagtgctgggattgcaggcgtgagccactgcgcccggcctgataggtcattttttaaagtcaccttcaattcgagaaaatcaggaagataacatttttgagtaattttatctttacacttacatataaaatatttttaaagcatatatgcacatatatgaatttattcaagttttttttagggggaaaagagcttgatctagtgatatagtttattaactcactctgttatcttaacatatattgtttagaagctgtggaaatcatgtgtaattagcaaatataatcaaagttattttatatcataattatttattcttcccctgcaattccctgttgtaatttgtttgtttaatcagttcatctaaacttatcatttttcattcatttgtccattataagccatgaaacttttaccttttctctctcttaattataatcttgtctgatgaggacaaaataactgagacagaacagaggagcaagatgaatggcagacagcaggtgcatttgtatattatgaagtgtttgcaaaataataagcaccacatgaataatgcatttgaagaatattgtctggcaaatattattaagagtcatatatccaaatcatcccacaattactgaagaatgaaaaacaaagtgtctaatgcctctggttttgtcagacacagagagaatcaccatatagagcttctaggtagagcaaaagggcttctatttatttttatttatttatttatttatttatttatttatttatttatttattgagatgaagtttcgctctgtcacccatgctggagtgcagtggtgcaatattggctcagtgcaacctctgcctcccgggtttaagcaattctcctgcctcagcctcccaagtagctgggactacaggcgcacgccaccacgccaggcaaatttttgtatttttaggagacaggttttcaccttgttggccaggctggtctcgaactcctgatctcaggtaatccgcccaccttggccacccaaagtgctgggattacaggcgtgaaccaccatgcccagcaccacttattaatagaggactaaaaatttatatatatatctttatacaaatgtatatatctatattttatcatatttatatgtattatttatatatttgtatttactacatatatatgtgtatatataatacagttggccctccatatctgtgggttctgcaattgcagattcaaccaactacatatggcaaatattaataaaaaggatgattatgtttgcactgaacatgtacagtctttattcttgttatacttcatgaaacaatacagtgtaacaactatttacataggatttatattgtgttaggtattgtaagtaatctagagatgatttaaagtacactagaggatgtgtataggttatatgcaaagactgtgctatttttttatatattttatgtatgtatacctagcaaggtaaaatactgacacaattcaaaaaatgaaggaaaacctcagaaacgctttgattcaatgcttgtgtgtatgtgtttctgtttttgtttgtttttgtttgttttgagacaaggtcttgctttgcccaccaggctggagtgcagtggcgcaaccatggctccctgcagcctccacctcgcgggctcaagcaatcctcccacctaaggctgtggagtagctgggatcacaggtatgtgccaccatgctcagctaagtttttttgtttggggtgtttgtttgtttttctttttctttctttttttttttttttttttgtagagacagggtctccctaggttgcccaggctggttttgaactcctgggctcaagttatcctcccacattggtcttccaacatgctggaattacatgtgtgagccaacatgcccagcctctgtgtatgtgtgtgtgtgtgtgtgtgtgttgaaagagagaaaacataaagtaggactcaggattttagagtggttgatatgccactcctcattttgcctcttgactgtcttgctctatgaccactccttggaggtagctgagctgtttgtgttgctagtgttgctgcagccactggctgctgcaagaatctcaactgttctatcttctgttgctgctgctgctgctgctgctgctattgaaaagcagaagacagctgggacctctgctgagggaggctttaccaaatcttttctgggcaaaaccaacctgagatatcatagctgcctgaagctacagaaaacttctgactctggtgagattaatgagaacagctttatgagtccttcaggcctgttcttgattgcttgaaccttgtgcagaaccctgtggccttggctgtggagcatgagaagttgtgtgttgctgaaagtattgttgcagaatcaactgatggagcggcagaagcagcagcagctgctgctggatgttcaaaatgagggaaccaagtggaagctggagtagagttaatggcctgagacctgaggtacttaaaaaaaaatgctaaacacacctgattgaaaaggtgcctgcattctattggactgggccatgcatttggtagcatacctcctgaggaccgagggccactccctttgattctcgaaggaaatggggcattaacagtacagcccagcatggggtttgaaccactccccaaagcccaggctccgcagactgggcccactacattgatgactatttggacagttgagtttgccattacctaggaggctgggattgtttttgaggagttggaggagaccaggcagtgtgggggaaactgaccccatgattcaagtatctccacctggccccacccttgacacttggggattattacaactcaaggggattattacaattcaagatttgggtggggatacggcaaaatcatatcacttagctcaggagaaggtggacaatgagacagctccagatcctaattcagagaagatgtagaatatctcttgcagcattatttcactgagcctgtattcaccttttgctttttataggctgatcatttcagaaattctccctacctcggactccttgtcatgtggtccttatttattcgctgtctctcctgagtttggctagctcatgtcgtatatgttgttgtttgtccttttttatttagagttttaaaaatttatgattcatggtgtctttccaactttgcaatggcttatttaagtataaaatttatttaaaaacaaaacattaaaagttatgagtgaataagaaccagaaaaaattttttcgtaaatttccttttagagtgtcaaaatacaatttttctctgttttaccttgtgtgtggatgtttatctgtgtattgtttttgcaatgtttttatctgcttaattaatattcggctattggctttttttttctcagaacagtaatagaagatacgtttttgaagtggtaggatatgaagatgacatagcttacttaatttcatagttcaagaccagcttcttttgttgccattatgacatgaagtattttttttattgttaactgttgttattggtggtggtggtattttaaataaatagtacacttttccacaagccttgcgtctcctgattctttgacactcttgggtcattaggatccttcaactttagtctgttcttttttttttcccttagccataagtcttcaaagaatacatttcttctcaaaagtgcttccctgttcctaaaaggagatgtttacttctggtcctaaattctttttatgctcctttcttttgattgcccacaaccagtgctctaatctacctagtttcaaatattatctcagtatttcccaatccagcattgggcctcaatcacctcctacaaattattaagaataagaaaaatacctccggaggaaaattaggtcaaaataaatattcattaaaatatataaataatatttacatatatgaaaagatgctcaacctcacaataatagagttgcaagttaagactaaaataaaaggctatatttttgtattttctttttctctttttccttgtattattatttttatttgacacatattaattttacatatttttggggtagagtgtgatatttcaagacatgtatataatgtgcaatgatcaaatcatggtaattagcatatccatcacctcaaacatttatcatttcctgtgttgggaacattcaaaatctgctcttctagctatttgaaaatatacaataaattatttttaattatagtcaccctatagtgcaatagatcactagaacttatttctcctatctaaatgtactttttttttttttttttttttttgagacagagtcttactctgtcgcccaggctggagtgcagtggcacgatcttggctcactgcaacctcctcctaccaggttcaagcgattctcctgtctcagcctcccaagtagctggaattacaggcacctgacactatgcccggctaatttttgtgtctttagtagagacgggatttcacaatgatggccaggctgttctcaaactcctgatttcaggtgatccacctgcctcggcctcccagagtgctgggattacaggcatgagccaccgtgcctggccctaaatgtactttttaaaaaactaaacttagatacagggggtacgtgtgcatatttattacatgggtatattgtgtgatgataagattggggtatggatcccatcacccaggtaagtgagcatagtacccgataggtagtttttcaaagcacactctgtccttccctttccctctagtaatccacagtgtctattgttcccatgtttatgtccatgagtgctcaatatttagctcccacttataaatgagaacatttggtatttgattttctgtttcttcattagttcgctgaggatattggcctctagctgcatccatgttgctacaaaagacatgatttcattctttttaatggctgcatagtattctgtggtgcatatgtacccattttctttatccaatccaccattgatgggcacctaagttgattccatgtctttgctattgtgaatagcatggtgatgaacatataagtgcatgtgtctttttggtagaatgatttattttcctctgggtatataccaaataatgggattgctggattgaatgttctttgagaagtctccaagctgttttccacagcagctgaactaatttacattcccaccaaaagtgcacaagagttctcttttctccagagcctcatcaacatctgttattttttggcattttaataacaaccattctgactggtatgaggtggtatttcattgtggctttgatttgcatttctctgataattagtgatgatgagcatttgttcatatgtttgttggttgcttgtatgtcttcctttgagaagtgtctgttcatatcctttgcccatgtttaattgagttatttgttttttgcctgttgatttaagtttcttatagattctgaatattagactttcgccaaatgcatagttgtgaatattttctcattctgtaggttgcctgttcactctgttgatagtttatgttgctgtgcagaagctctttaattaggtcccacttgtcaatttttggtttcgttgcaattgcttttcaagactttgccagaaattatttgtcagtgcccatgttgagaaggctgtttcctaggttttcttctagaattttcatagtttgaggccttacatttaagtctttaatccatctggggttaatttttgcatatggtgaaaggtaggggtccagtttcattattctgcatatggctagccagttatcccagcaccatttattgaataggaagtccgttccccattgcttttgttagccccatcaaagatcagattgttgtaggtgtgcagctttatttctgagttttctgttctattccattggtctatgtgtctttttttttttttttttttttttgtaccaatacatgctgctttggttactgtagccttatggtatagttcaaagtcaggtagtgtgatgactctggctttgttctttttgcttaggattgctttagctattcaggctctgttttggctccacatggattttagaatcgtttttctaattctgtgaaaaatgacacttgtagtttgatagaaatagcattgagtatgtaaattgctttgggcagtatggctactttaacaatattgattcttccaatccattagcatggaatgttttgcatttatttgtgtaatctcttagttctttcagcaatgttttttagttctccttgtagagatctttcactactctggttaaatatattcctaggtatttttttgttactactgtaaatgggattatgttgtgatctgattcccagcttggatgttattgatgtatagaaatgctactgatttttgtaaattgattttgtatcctgaaactttactgaagttgtttatcagttccaggaggcttttggctgagtctttcggattttctaggtatagaattatatcatcagaaaagagagagagtttgaattcttattttcctgtttggatgccttttgtgtctttctcttgcctgattactctggctaggacttctagtactacattgaataggagtggtcagaatgggtatccttgtcttgttacagtttcgtgggggatggtcccagcttttgtccattcattgtgatgttggctatgggtttgtcatagatggttctcagtactttgaggtatgttccttcaatgcttagttctttgatgttgttgttgttgttttaatcaggaatagattttggattttatcaaaagctttttccagttcaatgaggtgatcatatggtttttgtttttaattatctttatgtggtaaattgcatttattgatttttgtattttgaaccaccttgcatcccaggaacaaagccaacttgattatggtgagttaagtttttaatttttcatttgtttttattttttttaatttttaatgttttgttgtgatgacctctctttttaattttttttttttttttttttttttttgtgacgaggtctctttgttgctgaggctggtctcaaactcctggcctcaggcagtcctccctcctcagcttcccaaagtcccgtgataaaggtttgagccacaatgcctggctgtttttaacgtgctgctggatacagtttggtagtattttgttgagaatttttgtatctattttcatcagtgatataggcctgaagttttctttttttgtcgtgcctctgcttggttttggtagcaggctgatgctaccttcgtataatgagttagggaggggaccttcctccttgattttttgaaatagttccagtaagattggtaccagttcttctttctacatctggtaaaatttgactgtgaatccatctgatccagggctttttctggttggttgctttttttttttttttttttttttttttaacattgaggaggttattttattttattatttattttttgagacaggttctctctgctgctcaggctggagtgcagtggcacaatgggctcaagcaattgaggagttcattttaaatgtatagtgtaatccacatctaagctctgtttgcagaatgagaggttgatgaaagaaagctcaatgaagctgcagagtcttaatcttgcttttggccgcaccagccctggcaggacctcgttcacaaagacagagaattaacatttgtcgaatgaatgaaggagatgccgtacaaagattgtatggttcctttcagagcctaaatatttaataggtgggtcactgagggtctgaactagaatatttgataagcagacatccagggttgagtgttagatgttctgcagggagatggatggaggggtacctacagggttctgcaagctcagtaatagatgttgttgaagaagaaatataagttagagacaggacaggacacacagagaatgcacctctttggggtcaataaaaaaagggaatgagcccagaggaagcactcaagatcagttgcaaattgatatcccaaatgttttggaatacttctaggaaaaaactctcctacatttcaaagtccagataatactgactccaccctctggcacagaggacttctatggcaacatagcacaggagtggtacatgaaggcaaagtccatttgtcttagctcatatcaaatggtaaagcagagcttcttttattttaatttagctattcaagctgctgaagctatacccaaaatccctagccctttctctgatatgagtctctgtgtttccatattgggagcaatttttttttttttttttttgagatggagtctcactcttgttgtccagactggagtgcagtggcatgatcttggctaactgcaacctccgcctcccaggttcaagccattctcgtgccttagcctcctgagtagctgggattacaggcacccgccgccatgcctggctaggttttttttgtatttttagtagagacggggtttcaccatgttggccaggctggtctcaaactcctgacctcaggtgatctgcctgccttggcctcccaaattgctgggattacaggcatgtcccactaggcccagcgcaattgttttttataactagaaatgtgtttggctttcctccaacaaaccaggaaggtcaagagatatgttctagatacctctttgtggttgcttaatgcagagctcatgcagacacatctgcaaacctaaggaaacgaccctctaaggactggttagccacttaaaatgtgggccaagataggctattaaattcgaatcctcactgcttcattacagcttcctcacattgttagcctacaaactaagttaaggacacacttaaattccagaagttgatattagtctattcagagttttaatctcttcttgattcagtcttgggagattgtgtgttttcaggaatttatccatttcccctagattttctaatttgtttgcatagagttgttcatagtagtctctgaggatcttttatatttctgtggaattagttgtaatgtcatctttgtcatttctgattgtacttatttggatcttctgtttttttctttgttaattaagctagtggtctatcgatcttgtttattctttcaaagaaccaactctcagttttattgatctgttgaatggatttttccatcttagtttcatacagttttctctagttttagttatttattttcttttcttctcctagttttagggtttgtttgttcttttatttcctagttcatttaggtacaaagttagatgattgttaatttgagatctttctaacttcttgatgaaggtgtttatcactataaactttcctctaaacaccactttagctgcattccagagattttgataagatatatcccgattttcattaatttcaaagtatattttggtttctgccttcatttcagtgttcacccaggagttattcaggggtaagttgtctaatttttgtgtatttgtatagttttatttttttttttagaaagtgtctcactctgttaaccaggctggagtgcagtggcatgatcatgggtcactgcagcctcaatctccccaggctcaggtgatcctcactagccacccagatagctggagaactataggtgcacatcaccattcctggctactttttttgcatttttttgtagagatggggtttcaccatgtcacccaggctgttcttgaactcctgggctcaaacaatccacccactttggcctcccaaaatgctaggattataagtgtcagccactgtgccctgcttatttgtgtcgttttgagagaccttcttgatagtgatttctatttttattgtactgtggtctgagagtgtgcttgacatgattttgattgttttgaatttactgagacttgctttatgactaagcatgtggtttatcttagaatatgcttcatgtatagatgagaagaatgtatagtctatggttgttggatggagtgttctgtagatgtctgttaggttcaattggttgagtgtcaagtataagccttgatgatctgtttatcaccctgctgtcagtgggtattgacatctcccattattgttgtgtagctgtctcagtctttttgtaggtcaagaagaacttgttttatgaatctgggtgctccaatgttgggtgcatatatattaaggatagttaaggcttcttgttggagtgtaactgttatcattatgtaatgcccttctttgtccttctttattgttattggtttaaaatctgttttatctaatacaagaatgatgactcccactgtcttttgttttctgtttgcatggtaactctttctgcatccctttactttgagtctgtgggggtgtcattagatgtaaagatgggtctcttaaaaacagaagatgattgagtcttttatttgtatccagcttgccactctatgtcttttaagtgggacatgtagcctatttacattcggggttagtattgatagatgagattttgatcctttcatcatgtagttagctggttgttatgtagacttgattgcatagttgctttttagtgtctgtgggctatgtgcttaagtgtgtttttgtggtagcaagtgttgttctttcaatttcatgtttagcattcccttaaggacctcttatgaggctggtctagttaaaactaattccctcagcatttgctcatctaagaaagatcttttttctccttcacttatgaagcttaatttggtaagatataaaattattggttgaaatttattttctctaagagtgctgaaaataggctgccaattttttctggcttgtgagtttctgcatcaaggtctgctgctatcctaatggagttccctctgtacatgacctgagccctctctctagctgcctttacatttttttcttttggattgacctttgtgaatctgatgactatgtgccttggggatggtcatcttgtgtagtatctagctggagttccttgtatttcctgaatttgtacgtcaacttctctagtgagattaagaaaatttttgtgaactatatcctcaaacatattttttaagttgcttattctctcttcttctctctcaggaatgccatattggtcatagatttggccactgcacataattccctatttctttgaggttttttttttttttcattttaaaaattattattttttctttatttttgtctgattgagttgattcaaagaacaagtctttgagctatgagattcttttctcagtttggtctattctgctattaatacttttgattttattataaaattcttctagtaatttttcagctctagaaattcagtttgattctttcttgaaatggttatttatctttcagttcttgcatgattttacttgattcattggattccttggattgggtttcaactgtctcctgaatctcaatgagcttccttgccagccaggttctgaattttatgtctgtcattttagtcgtgtcaggctgtttaagaagcattgctggggagctggtttgcttatttggaagtaagaggatactctggctttttaagttgctacagttattgcactgattctttctcctctgggaggactagtgttcttctatctgtggtgtaagttgggtatagttggttgtctttgtttctgcgtgttttctgagggtcaaggttctgtataatgtctttatttatggcttaattcttgcccatggtttcacaggaggatatattagcaaaatgtttttggtgctgtagtttgggctgcaatcctgtagatggtacataggaataacggtcagtagataggctcttactcagctgtgcagctcctgtgtatttccttgcatttgcagccatgctctgtggtataggggggagaagagatgacctcctcaccaggcctgctcctgggtcttaggaaacccctctgattacttccaccatgcccacatttattttgttaggtattctgggccatgggcctcccttgggcagaggctataacatggagatagactactccctttctggactggccttgcagagggaggcatgcctcactcccatgccagtccatgaacccatgtgtttcacccatttcagtgctgtgagagtgggctcctcccccactagagtgttgcatacagatctcagcttagcattcccgaactgtgcaccacagccttggggcaccaggactggctcgcagctctatcctctagacgttcagggttggtttctgggtgcactgggaaatccaaagtgctcccaggctgctgtgaatgtactcaggtgaagcaaagcatccaggctgggcagcataggctgtgccatgtatacattcctgtgtgggggaatggggggtatccaggtagaggctctgggaagggcttttgggcaggagagcctgcgaagtagacataccctagtcctgcaggaaagccagccccactttctcctggcctggcagtcagttgggcctagagattctcagaggaaaatggggatccctgtgggatgggcacctacctaaggccatgccctactggagctctcccacacagaaaggctcctggctttgcaccagctgaagcgttgtctctacctactctctgggtagattcccctgccagctcaaatgtctgtgggggacatggaatcccctgtagctaggatcccagaggttcacagtgagagtgggcagtcccacagcttctttactcacccctttcccaggagccatttggagccgaaaactagccataacgttcaggtaccttatacacggttcccagattcctctctcttcagcctcagtgcctgcgtcacatttccatccactcttggcatttttctctccaaagatgtattcaaattatgttgctttacttaacattttggtccctcttggcgggaacagtgctttctagctgtgtctagtaagccatcttgtcccacttcctagctgtatttttttttatctgttaaccatcctttggctatccctctcccttccctacccttccctgcctctgataaccactattctactctttacttcatgagatgtattttttagcttccacatacatgtgagacaaatataagcggtatttgtctttctgtacctgacctatttcacttaatgtactccaggctcattcatgttaccatgaaagacagaattttgttctaaaagaccattcttttttttttttttcctactagattactgaagatcggaacatttcatagcttatcatgttagctaatggtgtggggaaacagacacactcaaatgttgttgagggtttattttgtgtttttttgtttgtttttgagatggagttttactcttgttgcccaggctggagtgcaatggcacgatctcagatcactgcaacctccgcctctcgggttcaagtgattctcctgcctcagcctcccaagtagctgggattacaggcatgcgtcaccacgccctgctaattttgtatttttaatagagatggggtttctccatgttggtcaggctggtctcgaactcctgacctcaggtgatccacccgccttggcctcccaaagtgctgggattacaggtgtgagccactgtacctggccattgttgaaggcttgtattggtccaattcctatggataacaaagaaactaggaataggatttaccttcaaggtttttgggaatttctcaccactggcctatagtctcattaaaaatctactactttttaaaccttttaaaaataaatgcaatatttaccttgttgctttgtataccacctgcacaccagtgttactggtcagtggggcagcactactacattccgagtatcacttggtaacatgagagaattcaagaggaaatgtatagcaaggacaaaatcctaggaaaagtctagcatttatgaagaaagaagagaatgaatagaggcatattacaatcaggaatagacttactaataaaatttcaagaagaatgggagtaaatagtattaaatgccatggagtgctcaagccagttaagtattgagccagtgaaactattgaaaccatgtaattgttgaaaagtaggtttttgatagccttagtaacaacattttctgagaaatagtggagaaaaatcagaacatagtagaaaaacagatgagtctgtgttgagaaagtaaagagagtagcttagactgtcctgaaaagtttttgttagtgttgagaaagaagtgagttacaggttaaaatagaggacacacacatgcatacaaaaaaattaatagctttgtgtaaaatctctcaataatgcaataatagaccaggtaaatacaacataaataatgatgttaccaataatgtaattttggaatttttggaattgacataagctttcatggagatttttatatgataaatgaaaaagtaacatacgcaaaagcctctattcaaattaatgacttggctgggtgaggtagcacatccctataaccccagcactttgggaggccgaggtgggaggattgctggatccctggaattagagaccagcctgagtaacatagggagacctcatctctacaaaaaaaaaaaaaaaaaaaaaaaaaaaaaaaaaaaaaacttagctggacatgctggcatgcacctgtagtcccagctactcaggacactgaggcaggaggatctcttgagcccaggagttcaagaacagtctgggcgacatggagagataccgcctctacagaaagtaaaaaaacttatccagatgtggtggcacattcctgcagtctcagctactcaggaggctgagatagaaggatcgcttgaacccagaaggttgaggctgcagcgagccatgattgtgccactgcactctggcctgggtgacagagcaagactgttgccaaaaaaaaaaaaaaaaaaaatatatatatatatatatatatatatatatacatatacttatgtgctttgtacattatagacataataaatggtagataatgacatcagtaaccacaaagtcaaattatacagcaatacttcatgtaattttgattccaaataaatccatattagtaaaagaaagccaggagcattgtaatagcttttgtaaattagccaccaaggtagtcaatttacagttgtatttaatagactagtgaacagaagggttttgagagtgggaatgattacaatgctgttgcataaattggagctttaggaaagcactgaaggaaatggtgtccagttaatcattaagatattcttcacgtgcatatgaagaataatttgggaaaacttgacattcagataagactgaatataattgggttaaactgcaataatacatacatgttctctattttcttgctattatcataatgtacttttaaggaagaggcagatattgtaactgaaaatcatggatacagtaaagccatttcagttctttgttacagttgtttcctatgagaagaacatgagaaatgatcttatagtattgacagaaaaggagtgttgacagctgactgttgcaaagcctccagtgtaattattccacctcccctacggccagggatcagtgtttttcatatgacccatacttctgaaaataatgaatttcaaaatgtctgttccatgtacacagttgttgacatacacaaatatttagctatctagttctagaatccccttggtgtttcatccatctgaaactgagaaaagagagcagagtcagtaacagataagccctcgttgctgttttatttatgtatttgtttatttatttatttatttatttctgtactgctgcatctagggatgccttccactggatgcctctgtgtcaactgcagctctttcaggcaatactatgagacaagattaactgaatttcaaatgtatgagactccactcacagaaagggtgttctattcatactgaatctttctataaaaatgcaaaagttggatctggagaacagaaaaaggaagagagctgcattcacagtaggataaggagattaaataggaagagttatgtgatttatctcttttatgaggtgctgctggaaagcagattaagctttttaaaaagtggtgaccttgatataaatttcatatttagccagtgctgatggattttgaataatgaagggtatgtgcaacaacactgagcctgagaagatgcaagaaatgtagtgaagttgaccataatctgagtgctaatacatcactgcaaacaacagtaacaggaataatacctattgtgtagcagtttgcccattacaaaatacattcacaccaggatgctatttacttctcacaataactctatgagattaagtatccttagaatttgatgatctggtgctgaagttcaagaaagatgttacttgttcatagtcacacaacttgcaaataaattcctctccctgtgaaaatattctcttcttatattcattgtcacattcggataaagattggacccacttgtattttatttctaacacttttaatcatacctctaacataactctatggtattacattctgacaactgaaatgtaaagtgttttatttctgcattgtctctgttgacatgaatccttaatataatgtcatattctgagcatgtttatgtttataaaaaaatacaaatcattaggccattttctttttccaaaaatgaccggttattgccgagtaaagttactaggttgctggtattcaagccattcgttattttaatgaataataggtaattcagattaatggatttccattctagcaagaaatctctaaaaattacatggacttgaactgatattaaaattgtatataaaggaatggaaaggaaaccaactgtgaaatgtgtccaaatcatatagaataaaaaagttcccttccccaaaaacctaactctgcttttaaattctactaattcacagtgtaattctgctctttccttttttcctgtttttggctttagatacataaataagaggctttaatcatagaaaggaagctggaaaagtaccttaacttattacatttaccatgtttgaacactgttatttgtaatatttgcaaatgtacaactatataatttgtttatctttttcttttacctcatgggagacttctaggaatttatatataatgtggattaaacacttagactatttgttccctaagctactgtattggccaggacctagtcagttaaagcaaattcattccagatagttcagtagaagaaacttaacatgggaaacaggatatcaatatgctagaagagctgaaatgacccagaggttagcaacattaggaaaccactaccacccctatatatgaagggacaaagagaagaaggaagtcatgttaccagaacccagaaactgaaaggatagatcccctcttgtaaaaattcatcaccaatgccatttgtgaggagaaactgggaaattgagaaactacgtatgggataaagtggtaaacaaggcagataagactccctcatgcatgactcttacaatgttatggaggagaaaatatataccaatataaagaaagaagacaaagaaaagatcagttagtgataactgagaggataactataaatataaaactgagtgtatgaaaaaattatgagatttattcttgtggattatttttgcattaatttaatttttgaatattgcattgaaatattatctatcttaactagtgagtttatggcaccccctcattcaactcatgctagttccattggggtaagcccatgatgtttcaaaggactttcagctattttgcttgagcaattcggtggatggtgtagtatatgtcacaaataaatgaagcaactttttaagatttcaaaaaggcataataaatagacatttgaatatataaatctagaattcagagctggagatacaaataaaggagacacaacatagaaatggaatttagagtgagagggttaaatgagattacatagagggcaatgaaatgagataatgcattaagtctttttgaaatgatggcttaaatgaaatataattcatatatcatataattcacccatttaaagtgtaccattctaattttttttaactgtggtaaaataccacacaattgaccctttgaatcatttttaagtataaaactagtggcagtaattacattcagagtgttgtgcaaccatcaccactatctatttccgaaattttccatcatccaaaatagaaattatttacccatgggcgcagtggctcaagcctgtaatcccagcacattgggaggccgcagtgggtggatcacctgaggtcgggagttcaagaccagcctgaccaacatggagaaagcccgtctctactaaaaatacaaaattagccgggcatggtggcacatgcctgtaatcccagctgctcagaaggctgaggcaggagaatcgcttgaacctgggaggcggaggttgcggtgagccgagattgtgccattgcactccagcctgggcaacagagcgagactccgtctcaataaaaaaaaaagaaaaagaaattctttacccatgaaacactaactttccattccttcctcccaccagctcctggtaacctctactctactttctgtgtctatgaatttacttatcctagggacctcgaataagtttaatcatacaatatttatccttttgtgactgactgatttcacttagcctaatgttctcaggtttcatccatgttgtatcgtgtatcagaatgtcattgctttttaagtctgaataacattcctattgtatgcatataccacactttttaatcttttcatttgttgatggacatttgaattgtttccaccttttgggtgttgctgctatgaatattggtgtacaaatatctgtttgagtcccttttttcaattattttgtgtgaatacctaggagaggtgttgttggatattctatatttaacattttgaggaactgcgaaactgttttctacagtgactgcaccaatttacattctaccagtaatacacaagggttctaatttctccactccttgccaatacttgttgtccaacccccaacacactttttaaaaattttttttaattattgtcttttgagacggagtctcactctgtttctcaggctggagtacagtagcacgatctcagctcactgcaacctccgcctcctgggttcaagcaattctctgcctcagcctcctgagtagctgggattacaggcgcccaccaccaaacctggttaatttttgtatttttagtagagacggggatttcaccgtcttggccaggctggtcttgaactcctgacctcgtgatccacctgccttggcctcccaaagtgctgggattacagatgtgagccaccgttcctggcctacactttttattttttgataatacccatcccagtgtttgaggtggtattgaaaggtaaagctttctatacaatatttcttccttccccagtttgcctctcaataggatataaactccataaaatcaagtactctgtttattcactgctttatccccagccaggccacgcatatagccattgctcaatacatgtgttgtattgactgagtgaatgattttttttttttttttttgagacagggtctcattctttcaccaggctggagggcagtggtgtgatcttgtctcactgcaacctctgcttccaaggctcaggtgatcctcccacctcagcctccccagtatctgggactacaggcacacaccaccacgtctggctaatttttctattttttgtagaagtggagttttgccatgttgcccaggctggtcttgaactcctgggctcaagtgatctgccaacctgagcctcccaaagtgctgggattagaggcatgagccaccctgcccagccgtgaatgaattttaaatgctcagtaagtgagagttgtattcaattctttaataaataatatcatatatttagtcttatattacattgcatcgccattgctgggcttagtgttttctttttgttttattttgttcttatgaaacaacatcctttttgaattggaaatttaaggaaagatatgctgcatatacatagaatgaaattatttcaaaccatgacaggggaagaggagatgaacacgggatgaaagagttgaaaaatatgaaattaggaagtggtgaagaaagtcaagtaaaatctcatgtcctgccttcaaattagagcatcaagcaggtgctatgaacatgtaatttgagggaagtgcctgtgattctcttcttcagggagcacttctggtttgcgttttcattttctctagaccttttatagatgaagaatatcttgtttttccagatgcagatagtctgttatgttctgtctgtgtctgcagagtatggacccatttctaaatgtgctgagttcaaagatgtcactttttatacgaaactctgatcatgagttttggtaaatattatgaccaccttagaaaaagctgcctttgtaaagcttggagaacaaaaagtgatgtgcaacttacccaaatgtgactcacacatttatcttccctatcccttgtctttcacatcgagaatgtcaactatggttagaagaaggcctgttgtgtgtaggatgaaataagaagatcatcaggtgattgtgtgtagcttttcagtgcagagtatctttacaactctatgtcaattttttgccgggcatggaagacacatctgtttgccgtatatgctatcaaggaatatgtgttatttatagctgggcgcagtggctcatgcctgtaattccagcactttgggaggccaaggtgggtggatcatttgaggtcaggagtttgagaccagcctggccaacagggtgaaaccccgcctctactaaatatacaaaaaccagccaggcgtggtggcaggtgcctgtagtcccagctacttgggaggctgaggcacgataattccttgaacgtaggaggtgaagtttgcagtgagccgaaatcatgccgctgcactccaggctgggcgaaagagcaagactctgtctgaaaaaaaaaaaagaaaaaaagaaatatgcgttatttcaaaaccccagaaaatgaaagatggcaaaaaagtagtatggttgagtttaggtgggagttgtttagaaaggttaagccaaaaaaaaaaaaaaaaaaaaaagcaatcagaactttgtagctattagctaatagttcattcatttattcatgtaatatattgagagtacctcctaaatgcctggtactgtactaggcacttaaggagatcattaggcctttgaagtctttagcctcaacaggtcatcagtgaacaaattcctgtaatgaattaccatccatgtgtcaacagaaactgaaatgttcagaaaaggagaaagagtttaagagattaaaaaaaatatatatatattcctggtccctcaaaaagttaaaccatatgacccagcaattcaaattctagatatataccgaaaagaattaaaagcagggacttaaatatttgttcatgcatgttcatagcagcattattcacaatagctaaaatgtgaaaacaaacccaaatgtccaataagcttatgattggatacatggaatgtgatatatcatacaatgggctaatgttcagccaaaagaaaggaatgaagtactgatgcatactacagcgtggatgaaccttgaaaacattatgctaagtaaaagaagccagatacaaaaggctacatttatatgatgacatttatatgaaatatccagaataagcagatccatagagacagaaagcagatgggtggtttccagttattgtagggagagaggaaagaagaataattgctaatgggtactagcttttctagtcttagaactagatagaggtgatcattccaaatcattatcaatgtattaaatgccacttaattataaactttaaaatagttaatggttcattttatgttgtgtgaattttacctcagttaaaaaaatgtgtgtctaagaattcaaacagcatacagcttacttctttattttacatattatgagaagcatacatattaatagtggatgtagcaaaatgaggataaatactgtaattaaaaattgtgattgttggccaggtgcggtggctcacatctgtaattccagcactttgggaggccgaggcaggtggatcacgaggtcaggagatcaagaccagcctggctaacacggtgaaaccccatctctactaaaaatacaaaaaattagccgggcgtggtggcgggcgcctatagtcccagctacttgggaggctgaggcaggagaatctcctgaacctgggaggtggaggtagcagtgagccgagattgcgccactgcactccagcctgggcaatagagcgagactccatctcaaaaaaaaaaaaaaaaaaaggttaaaacggataaagatcaaagaaatcagccataggccctgaagaaattatatgtaatgtatgtaatcttgaacccatgtcctgggcctcagtttccctcagtgacatggtttttacttcttctccctcttatcttttcccttactcttggaatctacagaggtgaagtttgaaagtgttcatgtccaagaataactcagacagagaaatactggactagaattgtatatgcctaggccttctcaattctagtattccaggaataataggttagaaaaataaaaataggaaaattatattgatcactttctactaaaaaagagaagacaattatcttgaatttacagttagcaaaagactgtaggtggagttcaattcaccagttcaacaaaatgtttaaaaaagaatttcaaatgagaaggcagtaaactggcatttttaggttttaagcatctgctcaatggtctcattctaatcttttcaccaagggctgatttcaaccagggttaaatcaataggccctccagagctcttctgaaaagaaaaactaatccaaacaaatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgtatggaagtaattattttgaatttatttttgtgtcatatatcgattacttgtgttcaaaaatatttgggaattcccaatattttcactgaatcagattttttttttcttctttgtaaggcgggactcaaagccagtgcttcagaagtaaatgcttttatatagtagaaaaatatgaagaaaacatagtatttcaggtcatttgctcccttatatcacttatcagattttggggactttaaggacctaaattttcaaaaaaatcaagttagatcatggatttttttgaaaacttgggtcattaaagtcctgaagaaaatttgaaaatttaagtccttaacgtccagaagacgtttattttagactgtaaagtaaagtaaaaccaagggttaagggtaggtaactttcttttgttttaaacaatggtatgtctatatctatatctattatcatctataggtatatagcgtctatgtgtgctaacccagcaccaattgcctcccctagcttatagaagagaccagtgaattagaagtaggagatgtgagttctaaccccatttctaccactaattagataatagaattcgaaaaactcattgacttctttcagcattgggtccctttgctgtaacatgaagacattgaaagaagtaactttatgttagttgtttctccaatatgttgtgtgtgtacctggtgtggacctcacggtcacccttgccagagacaactagattttttttttaagtctatactaatattctttcctcactagaaaggatagtggggtgtttactctcagttgtaaataactctgttttctctgcctgtatgcatgtcctgtctctctagccattttataaatactgaaaccagtaatcatgatttaagtttttgtgtagactgcagctcatctgttataaacaataaaagctgagtaaatatgtgctaatggttttaccataagtcctgtaggagcattctctttaccccatttaccccattccacgttatttccctgacagcagagaaccatagcagttatgtcgcgagtttgatgatggtggaatgtactctttgctttgagagtgtgtaaattcccctcaggggtgtcatatgtttattaatgtgtcacaagttgcttgcttcctgttagctcttctcagtaaataggactatagcattcgttggatactactttatttttagctttttaaatcacctcctgatgaacagaaacagtaaacaagtattaaacatcgaaagtaatttgaaaatagtgccatcctggagagtctggagttccagacattaccagacactcatctcacagagctgaaggagaagttaggaaaataagaatacctaagtgatgctcctctggagccactttctgaagattaggggacatttgtatttaaagaagagaaagaggtgatggctgtggtagggagtccatatttaattcaactttagtcattcttattcaacccactcatatatttcaaatgaaaagtataaggacttatctggatttttaagcttcacactaattagacaccaaagaactgaaggcctcatcatggtagtattttctaatttgttaaacaaacactgtgcgactgtactgcaaaatggaagtataaagaaactgggaatgaaggaggcggtgccgataataagatctaacgcttactgagtgttctaagctctttatgagttttattgtattcgtttcccacagcagcctatggagtctttggtattactttcaccttatcctaataaggaaatgaaagccaaaggagccaagtaactttccctagttttctgttttttgagatggagtctcgctctgtcgcccaggcttgcagtctcgcgatctcggctcactgcaagctccgcctcccgggttcacgccattctcgtgcctcagcctctcgagtagctgggactacaggcgcccgccaccacgcccggctaatttcttgtattttcagtggagacggggtttccccatgttagccaggatggtctcgatctcctgacctcgtgatccgcccgcctcggcctcccaaagtgctgggattacaggcttgagccaccgcgccctgccaactttccctagttctcaaaaataatgagtgattgagcttgaatgagtgattgagattgaacccatgaggttgggctttggagtcttgctcttcacttgaccctgcctctctctctctctctctgtatatgaatgtctcgtattccatacaaagagatatagtacaacagacaaacaaaagtaatcaatagtttgaggagaaaggaaacctaagactcttgtgtctaaacgatttatgtggaagtttcaaaattatgatgcacagatttactttccttaaaaggcctttctgtttttgtttttgtttttttttttaattctgtgttctacaaatctgtatccttccaaaacctaagcattttctgaaagcatatttgaatgtgccctaaaatagttaataggttaatgtagataatttttttctgaaaaaataatcttataatgagcctagaaagagcatgctccagtcagccctggagtaaaattaataaataatgcatgagcagtattgctggcaaacccaaagagggatatctttttcacttgggtgtgaagctcaagctaaaacttaacacactcttttctctcaaagctgtttctttttcagtgttttttatgctgaaagattgactctacctttcatatactcaactgagaaaaattcttgatcatcttggatgcctctctctttcctttgcttcctcactgttacattgattcagtgtcttaagtatattttgaacatgatccctcttttctgtcccaatgtgtattgctttcattggggctgccatttgtttctgagtgaatgcagttgctttctaatttgcctcattgcatttattcttccttacagtcaaatccatttttctcattataatcagaaaaacctttctaagatccaaatttcatcattccttaacataaagtttaaactctttgaagtggcttatgtgactttcagtcttgcttctgtgcatttgtccagtctcaagtcctttatactccagtcactccacattatttgcaattacttaaacacagtaagttgttttatgccttccaggctttgtgcaaaccgttacctcagataacccttcttaaaattgccaaattcttattcagtctctaagatagttcaggtatcatcatttatggagccttcttgtttctttctttgataccactgtggtagttcatatctctttgtagtaattatcatattgaatttcagctgtttatttgcctatctctttccctggattgtgagggcctgaggacagggaatatgccttattctagcaaaattcctgaacacacacgctcaggacttttttcaagcttctgattacctttgtttaatggctaattatttcacctattaagtatctttcatctaattgtaggctaggtattataggaagctagagatgtctacattcaataaagaaccatctaattttgtggaaatattctttgttaccagatataaagcctaataacctacctatctattttctggacattctcactgtgtcatattagcattcaacaaaagcaagaatctaaataagggagctgcttaaatgtcaaagcattagctgaataaggaggaggacttaagagatgttgtgcatgtgtacagacacaaagaggaaccagcagtatcacggagcacctatgacaggccaagcagatttctatccagtatcctttttaatgctcagacaagtgctggctctcccatgagtcccacctgagactcaaaggagttaaataaattgcccagttttgtagagatggtaagcagtgagactcaaatacaggaatttgatggccatgtacatgaataagcagttgggcacttatttaccaaatgggaagttctaaagcaaactttgaattcaatattttattcctctctttcttctcattagccagcaccatgcctgacacatgatcagtgttcattgaatgtcctgagacttaaaaagcaagtagaagtagtgcaatttacccaaaaaacttcatttggtctcaacccttccaaaagatctctgcacaggatttatagcctcacttattccaagttataaacttgatttatgtaccaggaagaaaaaagagatgcttatttaatgacccaattctgtagaatctgtctatcaggatggggttgttcttatgtaacacagtagaatgcttagctctgacaacctggactctaggttccaacccaagtagatatgggtcgataaagatagtaactttgcaatacttttatccaagaatgtgttctgcccagactcagtaactactcgtcttagcaagacaaccaatagtgtaacttttatccaagaatgtgttctgcccagactcagtaactactcgtcttagcaagacaaccaatagtgtaagagtatgcagcattattcctgaacctcactgtgattaataggccagttacacttttctacttctattgaatttgccaattttagcataagcccaggcttgactttattctggacctaaatcttcctttattttttttctaggtacaaaatatctattaaacattttaaaacttaacctgaatgtaaaacaaaactttttctctggcaaataaaaacaaataaatatacatttagcttcacaagagcaagtattgtttagctgggtagcaagagagaaccctgtggaataagtcaagataccataaaattagttaaacagtgaagtttttgcttttcttttaagtgaattaaatacactgccttggcagcacttgctttttgttcacaccaggtcactgtatttattctgctttgttacagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggtatggactgcgggtggttctatttcctattaacaaattaattgtgccttatattctgggacaaattggatagaaaacttagatgggtgtgatatagtttagctttgcctttctagaataatatagcaagttgtactggtcattatatgttttttaaccaatggctttagtaaattctagtcaatgtttgtattggtaatccactgtaataagctgttgtgtttatgtttatattttatttccatggacaattctttcaagtctactatggtctgggttgataatttcaggaactaaattaccttgaaccttcttttcagggttcttcacattagcatttcaaagtgtccccaaacaaaaggaaaaaggactgatttttttccaggataaaatcgtatactagtttttcatggaatgttctgtttaatggacataattttgtccatattctaatctttttcatgtataaacataaacattttaaagaaataacatctgaggaaattgtatgacaccagaaatataatattgaagtaactttcttccaaaaccagttgaaactttaaacttaaacagaataatccaacctctgactttcctatcaccatcattgatgtttatttactgatattccagatttgaacataattttaagcttgtttatacaataaaagaaatttttgttattgaatgtactcaaaaaataaagtatagatgctgtgaacattcttccagaatattttatacatagtttaaagaatccttatgtaacatttgctttgtctaactcactggaagtgggactttagaaactgggcctctttgtaactagatccacaaatgtcagtatacagaatgtgagccctcatgacagactgaagatgaattcaaaaactgttagaaataaaacaagaaacaaacctttaacaattttaaaaaagatttttccaaaacagcaatgctctttcctaagtaagacttacttttgattcttgataatgtgaaattgtgggttcagaacatcaagggaactgttggaagatttttatacttgtcccttgcttgattttcaatcctagaccatgttaaatggagctcaaatattagtcctgctggtttctgttactgtgggaatgaattttctttttctctttttttaattgttggagtatttcttatccttaaccaccctcacatctcaaaccaccctgtggtttgtctgacttccacaggcagattctgaggcaagccctgatgattgcttcaagggggagtggtattaggggaatttgacccaaagtctccaaataaacccttttttttcttagtactcatgtgtgacatcagcttctaaatatgcagtgtctttgttgttcactaataagtttattttaagagttgtgtttcttttctcaccttttgcaaagagcatcttaaaatttgctgaaagatgagagactacacacacacagtgtaaaaagtggctggtcctttagtcctatttccaacattgccacaataattttgaccttaagctatgcagactagtgaagtggtgggtggggatgcagtatatgtggtatttaaaagtcataacatttcagattatttttccatagtcaaagattagcccctgtagtctaaatagcagagatttaagggctacttctatagtggaatactataaaataatcaatctggctaaatgtagatgtcacacattcagtggaaaatttatgcaattaccacaagtcatgcaactaatatggcatatacagtgtatattttggtcagaaataacacgaaaattgcccccaattacacaaaggcattgagccacataaaataatgttctgcaaaaatttgatttggcaatacaattttttagaaacaatattacccctgaagaatgtcaaatgttttaaagctattttatcctcgttccattgatttcaaatctggctagaggaaattgacttctgttttggcaaaaacagaaatctcctgagccaacatcattattattcaaagcttaattcagagaccataatttgctaagtctattaacaatgaaaacagatatttatggaactctaaagaccttgcatataaatgttgattgtttcatggattatagcatgcatacactatgaagagatttaatttttactaaatgcaaaactaaaatgtttcaaatattgaaatagaatttaggtgcaatcattgaacggtgcaatcttttgtacagcaaattttctgctttccagtaaaataatatggtttgtattttatgttatcaatttcaatatggttgatttcacaataatgaaatgtgaaatatctgtttccaaaatgatgtcacggatagtcttagcatacatctctattcttatatctaataaatcagtacatatctggtttagatatactaatcttagaagttaattgacttttccaaaaaaataatcttcagattgaagtattcattggttcaaaaatgtataatgaccagtgcaacttgccatattattctaggaagcaaattgattccccagagattttgagaagaaatgaaattatttagcattagtttcaaactttttagtccctttaaaatgcaattttagaagcttttgttttagttatttaaaactgttctatatttttccattactatatgtactaccaaaattgtatgttcttcatataggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacaggtaatcacagtcttcaatatttcacttgcaagtgatgaaactactattttaagttagtttttatgctacacattgatatttttactctctaaagaattacataatcaaatgctaagtggattcctataggtgaaatttattcctccttgcttttgaatcatcttccactgaagtccattcaaaaggctagagacaatatgtttagggagttatagaaatgttaacttttgggccgggcaccgtggctcatgcctgtaatcccagcactttgggaggccaaggtgggcgaatcacgaggtcaggggttcaggaccagcctggccaacatggtgaaaccctgtgtctactaaaaatacaaaaattagccaggcgtggtggtgggcgcctgtaatcccagctactcgggaggctgaggcaggagaatcactcgaacccacgaggcagaggttgcagtgagctgagatcgtgccattgcactccagcctgggggacaagagcaagacgaagtctcagaaaaaaaaaaaaaaagaaatgttagcttttgaaagtacttgaaataaaaatgagtttatggtttccaaaaattatgcttatattttataatggtatcgtttttggaaacatttcctagagtggctaaatagaatatatgaaatctacctctgtcttcctgtcttgctccaaattagaaaagtcgcttttctcttttatttatttatcactctatcaatctgacatacatgtcctcatgaacttgaaaatagcataacttcaggtgcagtcattgaataattatgtgagatgtgatgcatagagtcattttcatagctggttgctaaggtggaaggacatgaggacaagattcagaacactacctgtaatcatgaatctacaactcactagtcacataggttggtggagttaccacagccttcagcatattagtttcttcatgtataaaatggtgttgataaaatttgctgttcttatttcatagggtttttgcaaggatcaaatgaagtaaggtaatatgtatgacataaatttgcaaaatgcagaattatatccaaatgtgcataatttttgtccatgaaaattgcattcatacattttttttctttatagtgcatttcttacaaggtggtttcatgagaaaagtggggataataagaacaacattcagaaattaaaaatattattctcatattcttattgagagattcttcttggtgacttttgtgtatgatcatacttgtaaaacttatatagaaaagcataaaaaggacattagctgttttaaattaaacagagttttatttgttcactggtccacttaaaattagttttccctgtatatgaaaagtgttttgtggtagtcacctacatcttataataatttatttcttttaaggtatctggctatacttgagtttctatacaatcaattttgaaatttgtttttcatctgttacttaattttttcctttaatctctactgaagtggtttttcaaccagtagtattgaggcaaaggaatttaaaaatataaagtaaagcaatctatcctgaatagaaaatagaatgcacttctagtctttattcttcagagtggagaactcatctttagtaagcacctctttcccctttctagaaatgctaggattctaaaccagtacctagtatgagacagttggagcacagtatcatggatactgaacactgggctctgaatggtaaaacagcttgtgtaagactattttatagaaccaaaaatagaactctttatatcctaaatgctttccagggcaaccgtactttcctaaacttcatttgtcccaaaatatcttgttttctttatataaaaacaaagagtaattgagtcttgatattcaagaggaagataaagttttaatgaaagttttcattccacttattatcataaatacttatatgtagccttacctgagacaatgatttgggcaaataaattatgaaacagtttgactggatgtgaaattttgggttaatgtagagctacatgccctagaattaagaacagtatatactaaaatgcattttaggtattaacaacaagtctactgggaagatatatttatgtataacattgttttaaatggtgtgacactatagcgcatttactgtggggccaaattaaagagcagttcttaaaacccaaattatattcctcagttaaagcaacaaacatgggcagtatctgaatgataaggaatcactgttttttatcttggttttctgcacatcattatcatattttacttaatgaaaatattatggaaaacataatattatttggttttagtggaatttgaagtttgttataatgtcactttaaaaaaaaaaaaaagaggaatcctatacgtaaaaaggaaatttctggccgaaggaagtggctaaatgtgcaggcagcatcgtgagcttttatgggtgatcgatccttcccttattgaaaatgtatatccttagctaagtgaagtactggttcaacaaaacagatcacagtgaaaggaattataaacctgtccagcacttttggtattttaaacatctttttttttttctttgggaaacagtttctctcttgttgcccaggctagagtgcagtggtgcaatcttggctcactgcaacctctgcctcccaggttcaagagattctcctgcctcagcctcccgagtagctgggattataggcccgtgccaccatgcccagctaatttttgtatttttagtagagaccgggtttaaccatgttggccaggctggtgtcaaactcctgaaacattctcaatttttttcttttaaattaaagatgttacggcaccatctctagcctctatcttttattagccttacccacattgaagttcttactccaaatgtcctccctctgaactcttattcatggttttctccctctggaaggttttttatcttctcctttgtcacatccctgattctcaccctttcttcaaggcacagctaaaatgttatccccttgttgaggcacgtactccatgcatccacagcacttttagcatctctattgcagcacttacctcattgcatcaaactatttaatgacactcctgtattttcataagaatgtgagcaacttagagtcaagggcaatgtcttttattttttaaataagcatttgattttagaacggttttagatttacagaaaaaacatagtagaaatcccatctagcctgcattcagttccccctgttattcacatctaatattaatatggtatattcgttatagttaatgaactgattttggcacattattattaaataaagtccgtagtttatttagatttctgtgctttttacctgatgtccttgtttctgttccaggatcccatctagaatagcacataacatttagttgttatgtctccttaagatactcttggttgtgactgttttacatttttttttatttttgatgacctttacaattttgaggagtattttgtcgaatgtcctatatttgggatttttctgagattttttcatgattaggtgagggttataggtccttggaagaaaaaacacagaggtaaaatcacaacatgtcatatcagcctgacttatcactgttgatgttgatcttgatcacctgaggtagtgttaggtaggtttttccactgtaaagttactctcttccccatttttatactgtagtttttgtcatccatgctatatgtcatccatgctaaaggagtgagaggttatgttccacctctctgagagcagaatgtccacatattttgtgtggtattctgctacatgagatatatgtctgttctcccacatttatctacttattcaattgttgctctataccagtttggacttaacagttattttatactttgctttataatccaaattaccttatttattttgttgctcaaattattacagttttggtcattaagagctcttttagttggctcctttgtccctgtgacatacttatattggggtgtgtgtgtgtgtgtgtgtatgtatgtttgagtactttcctactttctggccctttaagatgctctaagctcatcttgtatatttcctgccccagtccctacatcagatatattttttcaaagatgccatgttgcttttattggagaattataccaaaaatgaataccttcatgttgagagtactcattgctactgggatatagttgttttgaagcttttctaatcgacaaaaaaagaaaaatgtgtatagtaacacataaacatatacacatatctatagatatttatatgtgtaaccacctgtgtttatattaagttaaacatgagttcatactgatgtttccaactctaatttattaccatatggatcattttagcctcttcccctaccttatgtgtaacctcccaatccagtagttagaaaactggttctcaccatctgccattcttttactgaattgttcacttccagtataaatgtatagtgagatcagaatttgttaacctgtgcccatgtgggaaacaactttatcaattagaatatggtgtttacgtacaattgttttagcatttagccttacagacttcactcatttccaaagttgctaaggtcagcacctttcccctcacctgcttcagtgaggttatctcacatatttgtaatatagttagattgttttatcatattctgtatttcccaggatcctctgacctcctgaattatatttaaaatttgcatacattaaggttttctctttgtgctgtgaagttctatgagtttaaacaaatgcatagtgtcatgtattcataattaaaaagtaacagaatagtttcactgccctaaaaaagactctacacttcatatgttcagcccttctttctgccttccgaatccctggaaacaactgatctttttaccataactatagttttgctttttccagaatgtcatataattgaaatcatacagtttttggccttttcagactggcttctttcacttagcaatatgcatttccttcactcctttctgccttccttccttttaattgagcattttatctcttccatttttacatcaattttccttctttttagatatatattttagtgatagccctggatattccaattttaaactaatctcagtccaccttcaaaaaacgctgtgtagtacagataccttattacagagtactcccagttcctctctcctatcctttatgacattgttctcattcatttcacttacccatattgtataatcacccaatatattgttactgttattttaaacaaagttatcttttacatcaatttagaataagagaaataaaatattttattttaccttcatttattccttctctggcactcttctttatgtagatccaagtttctattccatacacttttcttctgcctgaaaaacttcctttggcatttcttgcaatgaaggtccagtggtgatgatgtcccttagttttcatttatcagagaatgcctttatttatttttcccctttgaaaaagaattttgctggatatagaatttttttgtttgtttgtttgttttgttttgttttgagacggagtcttgctctgtcgcccagggtggagtgcagtggcatgatctcggctcactgcaacctctgcttcctgggttcaagtaattctcctgcctcaccctcccgagtagctggaattacagacacgtgccaccatgcccagctaatttttgtattcttagtagagacggggtttcaccatgttggccaggatggtcttgatatcctgaccttgtgatccgcccacctcagcctcccaaagtgctgggattacaggcgtgagctaccgcgcccagtctggatgtagaatttttgattggtacttttttcgttttgtcactttcaatatgccactccactcttttattgcttgcatggtttttgatgagatgttcactctgatacttatctctgtgcctgtatagatatgatattttctctgtgttctttatttatttatttattttttttgagacagagtctcgctctgtcgcccaggctggagtgcagtggcgggatctcggctcactgcaagctccgcctcccgggttcacgccattctcctgcctcagcctcccaagtagctgggactacaggtgcccgccactaggcccagctaattttttgtatttttagtagagacggggtttcaccgttttagccgggatggtctcgatctcctgacctcgtgatccacccgcctcggcctcccaaagtgctggaattacaggcgtgagccaccacgcccaggctctgtgttctttcaagattgtctgtgttttttttttctctgtagattgaatatggtatgcctaggtatagtgattttgttatttatcctactcagtgttttatcagcttcctggatttctggtttgatgtctctcaattttgaaaattccatgaccattattatttcagatatttactctgctccattctttttttttctacttttgatattccgattatacatatattatgccttttgaaattatctctcagttcttggatgttcttttctgtttttatcattcatttttctctttgcatgtcagttgataaagttctactgatctattttcaagctcacacattgtttcctgaactggtgtccagtgtactgatgagaccatcaaagggcttcttcatttctgttacaatgtttgttttttaaaaactctagcatttcctggctgggcacagtggctcacgcctataatcccagcactttgggaggccgaggtgggcggatcacaaggtcaggagatcaagaccatcctggctaacatggtggaaccctgtctctactaaaaatacaaaaaattagccgggcgtggtggtgggcgcctgtagtcccagctactcgggaggctgaggcaggagaatggcgtgaacctgggaggcagagcttgtagtgagccgaaatcgcgacactgcactccagactgggcgacagagcgagactctgtctcaaaaaaaaaaaagcaaatctagcatttcctttcgattctttttaacattgcaatctctcttcttatattacccatctgtgggtatcgtggaggaataataccctccatacagatctcacactctacttttattaatatttaggttggtgcaaacataattgcggtttttgccataactttgcgggtttttgccctggaaagtaaaggcaaaagccgcaattacatttgcacgagtctaatactaccgagttttacataaaccttttcatttcctacattatattgctgatttgtattgagatttaagtcaaataacatcagttttcttatattgttaagtcaaatgcctgcctgtggttgaacttttaggtatgaatacagtgctgagtattcctatagagatgattatgttcatttttaatacgtcatcccagtgtatgaagataggttttatacttgattctgtcttacactataataacttctcttccttgacaaaagtcattacgttttttgttggaagatatgtctgttttgaatggaaacattgtttaaaatgttatatttaaaaggctctgtataaagctgtgtaatatgcttttatattttttctggaatgtattatttcacctctctttagtgagagatttttatcctaataagaaatacagaatccagtacatatttttacttatttcttttaataataacatatataaccaaaaagtgtataaaatgtaaacaagtagctgcttagcatgctatcaaaagaactcaactaggcaaagaaatagaatactgtaggccccatagaagcccccatatgcccttctgattataaaccccttcctctccactactggataggtacctcagtatgtgagttttggggtatttattttcttgcgtgtttaaaagttgtattagctgatagtgtatgacaaagcgatatagctacattttgcctggttttgaaacgtataaattaggacccacatgttgtgtattctgtctggcttcttcaactccaaattttgtttcaaatatgcatgtatgttattccattcatctgtactttattcattattcttatgctatgatattccattatatgaaaatctcagtttgttgatagacattagggcttgttgtaattttttgcttatgtaagtaatattgccattaaccgtcttatgtacacacatatatacacacaaacacttacatatttccttgaacatataagcaagcaattctgtaggatttttacctaggaaaggatttgctcattaaaagtatgtatattttcaaatttactaactattgtttgggctaatttgggtcatgggcgtatcctaaccgaattgactgtagggaggagagaagtactccaaagaaagttggaggtgccaaaataagtggaaattattctaaggaacataaaaagccattttctactacttctacacattatgatttcttaaagattataaaatataatttgatatgcataaaattctgttttgcattgtgtaacaattttctatacttccatattgttaaataaaaatgtgaaaacattcaactttgtattgatatacattgccatatcctaggattccttgcactaaactctaactcacatccagactacactataaccctagtcttctgccagatatatgtgggaatgtgggtatggggaaaacgtcatatccagaggtggtccataagcaatctagtgattccaaaataaattaaatcaccttggctcatcataaataccaactatgtagacaaaaaatacaaatattagtaatgatacatatttttggatttgttaggtctaaggaaaaaaatatacactatataggatttttttagatgtattgattacattacatgattttcatttttgcccatttaatgcttatttccccttctggccaaaacatttttctattattttaaaaagaaagatttaaaacaaagtaacaactgtattgccatcataaagtttggaaatgagtcagaccagttgcaacaccatttaatttctagggtcagatcatagaattaagtaatggtaagggaataccttgttaaaatgttatgtcagaaaaaattttcccaagtaaatttgagagtcagcaagcagagtgaggaagtgaagaaaggaaaactgattcgaaaagaagcaaaaagaatgaggtgattgttacaaggatgtgatagttttagtagcatttttatcctttatataactttttaacagttaatacagcagaatattcaaactacttcccaatcgaccacagactgaatttacgctctcaaaaggtacatcttcctcctcttttaatggatgaggaagctgaggcaaagaaaggttaagtggctttatcaaggtcacaaaacgtcacagtgacaaatttagaaataaaatttaattccctgaacctcagtctatgatttactccactggataattaatagcaaggcattgtagtgttcatattagctctgctgatcgctatgagagatttatattttaagtgcaacggaaacacatttaactgagacctctaattcttctgccatggatgtaattaagcagtgtatttgtggtctagcctggggatggagtattgcttctttttcttcctatttctttcaaaaaattgcgtattttatttctcctttaaaaaaactgtttttgttaaattacttcatggattaaagtgtgctttcactgactacagcctaacaataattgatgaaattgataaaaggggcagatctttccagactttactttgtatgtttgctaacattccaggatccatacccacaaaaaccatcatgtatattatttttgatgaattgacatatactacatttctagctgttttataagtaaatatctgccatatttttgtaactcaaatatcatttagattaattcacacttttgaattaaaagagaaaaatgctcataaatatggtgaaactgaatttaatcaacttggctatctaatgttgatttggagttgaattcctaaaacaaaagagctctttcatgagtggtttccaataactgtcctgaaaccactgacactcattacctttatttattatttaatcttaatatactaaatgggttgttcaaaaatgtatgaatcaaattaacatttattgttaaggtgtagtaagtttgaataaaaacaagatgtttttactcttgagcagaaaacgtatacattttagaacatattcatagcaaggttggaatgtgccatctctggccatggggaaaacaagacatcataaacttgaatgatttccattaatacaagaaaaattaaatattaataattagaatagttaacacctactgagtgttcaccgtgtgccaggatctgttctaaattctttttttttttttttttttgagatggagtttcactcttgttgcccaggctggagtacaatggcacgatatcggctcaccacaacctccgcctcccaggttcaagcgattctcctgcctcagcctccccagtagctgggattataggcatgtgccaccacgcccggctaattttttatttttagtagagacgggttttctccatgttgatcaggctggtctcgaactcccaacctcaggtgatccacccgcctcggcctcccaaagtgctgggattacaggcgtgagccactgtgcccggcctgttctaaattcttccacataacctcaacttactcacccttaaaaatttttccagtgctcgccaggtgcagtggctcacgtctgtaatcccaggactttgggaggctgaggtgggcagatcacaagatcaagagatcgagaccatcctggccaatgtggtgaaaccccgtctctaccaaaaatacaaaaattagctgggtgtggtggtgcgtgcctgtagtcccagctgctcaggaggctgaggcaggagaatcgcttgaaactgggagatggaggttgcagtgagccgagatcacaccactgcactctagcctgggcaacagagcaagactctgtgtcaaaaaaaaaaaaaaattccagtgcttgccaagtacctaatattcttctaggtttcataaattgcacttgaaaataattcactattttatttcccacttcatatggatttttgaatttaataaaagatgaacatccatttctggaaaatgcagtcaattagacctccatttgctgctctgaaacactgagaaaaattagatgaaataaaatagaaataccattttaaatgattagttgagcttgcaagaatgttcttttttaaaaaaagaaaaatctctgggtctaatttttatttagcagtattgaagtacaaaaaagttacataattcaaatcataattttatgaatatcaaatcacattttataatctttaagaaatcatgaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccaggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaattttctggctgccctattgctgttgttgcctgacatagttcatcagccagaagtagttcttaattttttcactgattttctttgacagcattgaatttcaagtgtactgagagtgttttcattataataaccctgccagtgtaatccaacggattgcttgcctcttagaaatgatacagtcatcctttctgtccgtcccaggtgttagagctgtattacttctagattttcagaccactagctaaacttattcttacctcattgttaaagaaacaactacttttttttttttttttactgctaaccatatggcaggtactgtacacaattatttataggcattactatctatatttatcaaggagaaaagtcaaagtacattttggacacatatttaaacttttaaatacaaatcattatcattatttctaatgaaattcccttctttatttgcactctactgcttcaaattttcaaattctcttatattaattctaacaaactcaattttgagagtcaaaaagctgttcaataaatatcccttgatagaattattggtttatggctgggcatggtggctcacacctgtaatcccagaactttgggaggccgaagtgggtgaatcatctgagatcaggagttcaagaccagcctggccaacatggcaaaaccctgtctctactaaaaatacaaaagttagccaggcgtggtggtccgcgcctgtagtcccagctactcaggaggctgaggcaggagaattgcttgaactcaggaggcagaagttgcagtgagccgagatcaaaccactgtgcttcagcctgggcaacagaacaagactccatcaaaaaaaaagaaaaaaaaaattcttgttttagttagttagagaaaaaaaatatcaacaactgggctgtccaatataatagccacaagcaccatgtgtccactgagcaactgaaatttggctagactggattgagatattttaaatgtaaaatatgtgctaaatatttcaaatgtaaaatatgtgctggattttaaagacttagtttgacaaaaataatgcaaaatatctctttagtaatttttttatattgatatcatgttgaagtgataatatttagttaaataagatatactacaaaattgattttacctcttttcacttttttaaatgtagctgctagaaaatttttaattgtatatgtagttcggcttatatttctgttgcacagagctactcttgaaagtgaagtgtggtatcagcctggagaagtgtaagggaaacacacaagaccaagcatctaagggttgtcttagttccattggtggagctgccatgcctgggctcagtgaccttaactaagttatctgtcttcattaaatgttgtcttagtgttgagactgtgaatagtcatcactcacagtgctttggtgaggggtaaattagcgcagatgcatcaaaccggactgtgaaggaatatacaaatggaagtggctactgccatgatttggtttgatttttgaatctttaccttggtgatatggtttggctatgtcctcacccaaatttcatcttaaattgtagctcccataattcccacatcttgtgggagggaccccgttagaggtaattgagtcatgggggcgggtctttgccatgctgttctggtgatagtgagtaagtctcacgagatctgataggtttagaaaaagggagttcccctgcacacgctctcttgcctgctgccatgtaaggcaccgctttgctcttccttcatcttctgccatgatttcccagccatgtggaactgtgagtccattaaaccgctttcctttataaattacccagtctcaggtatttattagcagcgtgagaacagactaatacacgtggtttgtttcagttaatgtaattttaatatttataatcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccctacccccaccccacaacaggccccggtgtgtgatgttccccttcctgtgtccatgtgttctcgttgttcagttcccacctatgagtgagaacatgcggtgtttggttttttgtccttgtgatagtttgctgagaatgatggtttccagcttcatccatgtccctataatatttataatattaatctattccgtcaaatgtcactgattatcatcaatacaattattgactaacattcattgaccattaagtaatggtttatatgtgtggagaaaattcagaatatcttatttgtgtgcaagctactaacaaatgaatttcaatgtctttaactggggtaaataatgaatatgtgcatttctacctttgatatgattatatatatttatatgtatacaaatgcatacatacgtatgtatgtgtatatatatgtgtgtgtgtgcccctatattaatatatgtcttattgactattacagtcacttatttgcatctaagaaatcaggggaacatttttctatacttttttttgcaataatattattttctattttacaaaactgatttattttttgtggttaacattccaaagacccatttgatcatgattcctctcatatgaggtacctagaataggcaaattcatagagacagaaaatagagtagagattattaaaggttggggaacaggggaatgggaagttattgttcagtagttagcagagattcagtttgggatgataaaaaaaagttcaagagatggataaaggtgatggtagcacaacattttgaatgtatttaatgccatttaattgtacacttaaaattagttaaaatggtaacttttatcttatatatcttaccacacaaaaaaagattcatttgaaaataaatggctgttcttaatagtttggagcatatttttaaaattatttgccaagtgtggtggcttgcccctgtaaacccatcactttgggaggctgagacgagaggaccacttgagcccaggagtttaagaccagcctgggcaacatggggaaaccctatctctacaaaaaaatacaaagaattagctgggcatggtggtgcatgtctgtagttcctgctactcaggaggctgaggtgggagaatcgcctgagcccaagaggtccaggctatggtaatgagactctcactcaaaaaagaaaaatatcatatcaaagatttttttttaaagatcatcttttctctacttcatgttggctctctactttgacaggtattgatttttctgtaaaacttttgaagctcaaaccattatgtcggcactttatattaactgcttttagttttgacatcagcaaaattgactgaaaactcaatattgcacctgtttcaatacagagtctctggtgtggaaagattagcaagataagctaaagaaacttctattgttcaactttatcttctcagtctcatcaaatcaaagattgaaaatgtactctaggaggatgtatttctggtgaggttagatgactacacatctaaaagtaaaagttttaagagtaaaatataacataataaggatctagaatcttgaagaaagattccaacatattttatgacaattaagtctctaggtaccattaataaagatgactgtaacctcagagctaaaagcatttagttcattattccatgcaaactcgttaaaatatgaagactaaacttagcatctagtgtcaccactaaaaactgtttaaaacttatgtgatattgagtgagatacatttctttatggtttaataagtgaattagatgtctcagtgtgatgatgcctatatctacatgcacgtgaatgtgtgtatacatagatctatataatatatatctataaatatgtattttcattggatagagaattattaaccattttgtttttttttttcttttttgagacagagtctcgctctgttgcccaggctggagtgcagtggtgcaatctcggctcactgcaacctctgcctcccgggttcaagtgattctcctgcctcagcctcccaagtagctgggattacaggcgcgtgccaccacgcccggctaattttttgtatttttagtagaggtggggtttcaccgttttagtcaggacggtcttgaactcctgacgttgtgatccacccactttggcctcccaaagtgctgggattacaggcgtgaaccaccgcgcccagccattaaaccaattttatatatacagctcttatagttttaattttatttttgccacttagtggcaagaaatttgttacttggtataaataaaaccaagttgatttgtttaagcagtaggttcccattagacttaatgatgttgtatcatcccattattaatttgaataaatttctattatgttatttttcaaaatgaacaacagtgcatagaatcaacaattgagtcactgcaatagcagtataaccatgctactccttcaatatgggagtttttgttaacaaactaaactctgacagcttaatgtatgcaagattaagaaaaaaaataaaaccacaagctaatttcttattatactcactttgtgtattatacttaatggggtctcagatttgtttttcttctttcctagacaccagattaccaggaacagtgagaacttaggtagaaatgtggataatggtacactaataactagaggtttacaaaataggaaaggttaaaggaactgagaatattactattatttggattttaaaaaactctgggctgggcgcattggctcactcacgactgtaatcctagcactttgggaggccgaggcaggcagatcacctgagatcaggagttcgagacatggtgacaccttgtttctactaaaaatacaaaaattagctgggtgtggtggcacacacctgtagtcccagctactcgggaagccgaggcatgagaatcacttgaacttgggggggcagaggttgcagtgagccaaaatcgcgccactgcactccagcctgggcgacagagttagactccgtctcaaaacaaacaaacaaacaaacaacaacgaaaacctcaatgatgtgccataataagatgttaagtactggaagtgttcagaataatggaagagcagcaaagggtgactacattaaaaatccagcaggtaatgagtttcatgaggatttacaaattgttttttaaaaaatattgattaaatttattgctctgtgattttagcatttaaggatagttcctggaaaaaacaaacaaacaaaaaacactgctcaataatagggaagacttttggtgctgtattctttggaggttttaaaaatatgacagaaacccatttgaggcatgttcaggcatagacaaattggaggaaggtcactgagactctagtaatttttttattatgttaaaatttttatggttcatttttcctaatattttgtagtttaaaaaatagggagcaatttaaaaaatcaaaacattaggttttgatatgacagtttaataattacataaaggaatttaaaataatgaatgctatttttaaactgttcaaactattttaaagagcttctattactcttacactatgaaaaggtccactaattatatcccagggttagttttcccttgcctttatcacaatattgaaggctctttcttgatgataaaaccaagaggtaactcttaacttgcaattgatgtagatattttgtaacatatatttagaagaatttctaaaaactatttttgagaaaactgcatgaaaatggagttggtttttttcatgtcaaaatatataacttttgcatcataagagatttaatgttttcatttcttaaaatgcttgaccaagtcttttagtcattatattagcatctcttgttccatctggaggacctaaaaatccaatgaactgtaaatgggcagttcaatatgaatatgcaaattaaagacattatgaattctatgtaagatgtaaagaagtagcttactctgtgccttaattagaagaccttactgtatatttctttatcatttgttgggttgatcatcgggttccactccaacatatccaccaggaattctggtatataaatggcatcaaagattgtttacaaatatcgtggacaatgtctcaagtgataattgcaatatgtttctcagggaagaaaaaaatacaacttttgtgaatattatttttaaaacagaaatgctgtatatagtcactactgtcttctgatggtaatgatagaaattttggaacctttaatgagtacttattgttaaagttccattagataattatgttctgtttacatactgccatcatttgaagaacatatttgctttattcaccaaatcttgaagcatactctacacatgaatttaaatgctactatttctattacccaccctcagagtcttctaatttctaatatttacttaaatattttggttttcaaaattttacctatgattataaagcacacactgagcttttattttaaaattgaggcttgtgctgtcaatttaaggatgagagaagcacagagaaacgtgttctttttaaaaaagtaatatatatatatatatatatatatatatatatatatttttttttttttttttgagatggagtcttgctctgtcgcccaggctggagtgcagtggcatgatctcggctcactgcaacctctgcctcccaggtttcaagcgattcttctgcttcagcctcctgagtagctgggattacaggcccacgccaccacgccccactaatttttgtatttttttagtagagatggggtttcaccatgttggtcaggctggactcaaactcctgacctcctgatctgcccacctcagcctcccaaagtgctgggattacaggcgtgagccactgcgcccggccaaaaaaataaaatatattttaaacctttaaaagcaaacttggttatcaatgtatcatgtttctgtgtatcaacttttataagtccactactcaaaatgtaacctgaaaacagaatttttccaattagatattgttgctatggcgtaattgagctagttaatgatataactctttcagaataataagtcaataatagttatcagcaccaaacatgaaggaagtgaagtagaagatatatgaaaaataaccattaatattaaaacaatatattatgggggcagcaaataggtagtaagctatttactattcattagttggttatgacattgctaaaattaaattaaaacaaaaggtgaatacaaatacaatgaagtagtttggatgatgttttccatttggggtatataatcagatcattttatgttaatctaatttgtctttgagttaaataaacccaatagtgttgacctgccttttcatgtgtcattttttcaacattgtcgtttgataaacatttagtaagaaataaaattacactcagagcaataattttatactttcgcaagctatttataaaatctaattgtataaatgaatgtgttctttaaagatctgtatttgttgtttatgatgaagttaagaagttatagctacttctggtgctgttcaaaatgaagattggaaataatacagtgaagtagatctttaacccagatagtttgagatgcactcttctggatggcggatgaaggactgaaacaaaggccaggcagttagtttgcagaaaagaaatatgtaggaagtaagacaaaataattaattacatatacgtaatgacatatacttcttctcattcaaataatctctagtcattaattccaggaaaattactcagataatttttttttttttgagccagagtttcgctcttatcacccaggctggagtgcaatggcatgatctcggctcactgcaacctctgcctcccaggttcaagtgattctccagtctcagcctcccaagtagctgggattacaggtgcccaccaccaggcctggctgatttttgtatttttagtagagatggcgtttcaccatgttggccaagctggtcttgaactcctgacctcaggtgattcacctgcctcggcctcccaaaatgctgggattacaggcatgagccaccgtgcccggcctactcagataatttttaaaatgtgtgctttttttgtttgttcataacattcagagttctagagcataattacagagtatttcaacaatgctcagttagtagtggttaaatcttccacttcagtgcagctgttgctctgtcatgtaaacataccaaatgtaccttcaataggagtttaagattttttttatatgtatttctgtactttggaaatagtttctagtgggtgggtgtggcagaggagactcttgttggttagtatagagctgttgctgtggagcagctgctcagccagaaattcaatttcccagcccctcttgcttctaggtggaaccatgtgactagttcttatcaatgagtataagggaaggaatgtcatttctgagccaatgtaatgacgaagtagatatgctttttccctgtctttctttctccatcaattactggatgcagacaatggcaaggttttaacagatggaaggtgcccaggtctctaaatcacataatggggggaatttggtcactgaccagaaagactgtcattgaatgacttcaggagtgaaaaatgagtctcagttaaattaaatcactgaaatggtgaggtttacttgaatggcagaaagccttaccctaaatagcagtgttaggcaagttttaccaatgcaaagtcatttgaataaaagagaaatttattgtaaagtcacaaatggtctagaactgaaactgctaagctacacagctgccactttcctgtttgaatgcttctttctacacggtttctccatctgctatgcacttaccagatctctgaatgttcagtctatacatttttcaacagccaaatcaaaaacccatctcttctggtcaaccttcagtcctctctcctagatctggacagtcccattttccttagtggtcagtttgctttttgacacttttttctttcccctccacagtgatttggccaattggatatattcctactctttcacactagcctgtaaggccctcgagccacgactttgtcttcagcattatttagcatagagagaaaagatgattaataagtacttttgaaatgtttaataagcaaaagctgagttgggaatgtattttagaaatatatgctattgtagatagctaaatgtgattttagtctttatcacaaacttcttagtaattatttgagagctttcagcatatttataaaaataatttaaaatataactattttacttgaaagtctttgtatattcattgttcttgaattagtaggtaataatcctaatgagccataacaactgttctctcttcaaaataattctgatgatagggttttcttcttaagtcagcacaaaatttattctttatatagggtcaattgaagtgtttttaaaagcatgcacagctctggtaattcattcataaaacacaggaaaatgttttaaagtcaaaagcttcaaaaagattcacaatgtgaaaaacataaattagaacattaaggaaacttgtgttgtaggactttttccttagttcagctagaaaccaggttcttgtcacatgaccaggaaagattaggttcctagacacagtagaagggtgggaaaaatggaatttattgggcaaaaaggaaaaaggaaaaacaacacagcaaagtgagatggggtcctgctaaggggctctccacctcaccaaacgaatcccagggttaccaccccagaacaggagaggccaggctcctccccgctgcaaagggcatgaacttccctcatctccacactcccacacatacccccacccctgttctcccagtttgcaggccagttgtaggttctccaagaacccctttctcctttattacttggctgtctcacttagaagactgatgctagcaaaaaacatacacaggaaaaataagagagtaacagaaaaaaaaatctggcaaagaaggcagaagggaaagagactaagccataagagagagagagaaaaaaaaaatctctggtctgggaagggcatattttctaagcattagtgtgtaagatggagaagcaactcattaagctgtcctttaatgtagtattatccataatagtacaatatgagaaacaactcaaattccccaaaaatgatacagaatggattttataaatcacgtaagccagtgccatagaaaagagtctgaattcgagtggtgtgacttcagttatagtcctgtttgcagcctggtacaggacttaggcaaatattttaattcttacttgtatgtttgggaggcaaggtaaagacttcgccttcaccctctgaagataccctgaaaaatcaactcacagaaagcagattaattggaaaaaagacatatacatttattaacgtgtgcatgaggagaaccagggtggttacccatcttgccagtggagttcagaagcttatatgccatcctggtcaaacaggttatgggagtggagagaagaggaattttggtgagggacaataaaggatccttagggagaacagaacccatctgggagcagagattaattaagttgtaaatagttctctttggaatttgaatgagcctgagagacaggttagtcttccacagaggggaagaaacaacagttatcctttttggtgagtttggactttagacatataaaagaacttcaaagaacagcttcctcctggcttgagagagtcatttgcgggcggggagagggagggaatcagagaggctatgagactgctttttcagttcagcatgttaaagtgccatatttggggtatcggtttttgaaccccatcataggctacagaaccctacagttcctttcaaggctgaaagtttctaatacagtaaagtgtttaaaagtttacactattctgattttagcagatttcccaaatggtatatctcttcatagtgttaggtaaggcagaaagctattctttaaagagcaaatctctgaaagctaatgatgcctgggttgcaatctaaatgatatttttttctttttctaaaatgccaagggcaagttgacttttagagttaatttctttcatttatataaaatggtaatgagagttaaattatatttaggcacctggtacattacctagcctgtaataaactctctgtaaatgctagtttcctccctctgttgcattaaaacaactacaagatgaaaaacctatgtaaaccaaaaataaaagtctaagccccacaaccaacagaatggacccctcctttcggccaagagcattataaaggaaacctgaaatattagttcaggccttgatgaaatggatggttggatatgcctcattatactttcctccctttgatatttaggctaaccagcattagcattaaaacagagacctgaagactgacagaactagactctttaagcctgataagaaacatttacaactgattccctctaaagcctgctacctggaggcttcatctgcataataagaatttgggtctctataatcccttatcttaacccagacattccttctattgattccaagtcttagataaattctttccaccaattgctaatcacagaatctttgaatccacctactacctggaagcacccccacaacacacacacaatggcttcaagttgtcctgcctttctggaccaaaccaaagtacattttccatttatcgatttatgtcttttgtctccctaaaacgtataaagccaagctgtagcccaaccaccttgggcatgtattgtcaggatgtcctgaggttgtgtcatggacatgtcctcaaccttggcaaaagaaacttctaaattgattgagacttgtctcagatactttttggtttacaactgaaaacaatataggttagcgatacatctattctggtgtcaacgccagaatagtttgtcacagtcaaattttattactgtgattcaaaccatggtaaaattataacttaaattttataagatagataaaaacaattcaattaatattccctggttagtttcagtcataatgattatataagttgggtattctcaattacatgagcatctctttaaggcagatgagaatttgatgatgttaatcatgatgatgattactagcatttattgaatgtctactatatgcaccactctaagcaccttgcatatactatctaatttaaactggctcatagatgacatactagtttagagtgtactatttgttgactgcattttaccctgtacttcaatttgatagacagtgtagatgtactaaattcattcttcattccctttacaaaaattgactgagttcttattgatgtgctgtcctggacagtgtgaaaaatcaaaggatgaatcaggcagagacctcttcgagcagatattattgagcagaagaggtaaattatgcacacaatagggtgcaagatgaaaagtggtatgagatgaatgatcataaagggtggtgggaattctgagatgatcatgaaaagtttcctgcccaagtggaatttgaatttgtccttgaaagagagtgaaatctggactgggaatgtcaaattaaaaataaaaatccagactttgtaaggtggggagactattgcaattgggaagctactctaactataagatctacaagcctttcaaagttaggcaaaaggatttttctttcatagggaagagtaaacaaggctggaaagaaaaaaaaaaaaagcagatgtagggaagtgggatgaaaaggagtggcaagatgtgacagtggaccccagaatatttaatcctaaagccagtatagtctctggaagggggctattaagagggattgtatgttgcctcaggctaaggtggtgcaaagctcagggatctagaggaaggacagaatgttaaccgtctttctttaagaagcattatattctgattgatcacttggggcaaaacagttcataattatctatgaggcaaagagtgggaattttgagtctttttgtatggccctgtcataggcaagccaggggaacaactgtgaagcagggtggttctgtgcagtaagccatttcccaaaacacaaaaggatgtggggatttattaaacttcactgttttccaagatcattggtcttgggtaaagttcaacattgtcttgggtatgggaggaaaactcagttaggacttcttaaagaaagagatattcatgggaaggtttcgtttagctgggatgttgacattatgaaggaacgcactaataaatggtgatggttaccctttttgaactgccagttccttttctaaagttaaaaactatcagttcatttaatcttcacagtcatctgatgatacagttacaattatcctccccattttacagacaaagaatctgaatccctcagagtttaagtcacttgatgatactcctagtaagaagtacaacagggactccaacttatgaagccactgtaagcctgacagagccattttagcctcttttcatgacttcagactttccctttataccaaagggaatggaataaaactgcttggacaagagcaagaagacatgcatccatttttcacattccaaaataatggactccaacacatacacataagagaagcagctggacatagaagaacttagaaaaacagaaagtccaagtttggatatggtgcacaagaaacaacagcagccaatggagcttgacaaagcagagtggcgataacaggaaaggttctgagggcagggaacaaaacaatggagctagtcaagacagaagggcccactgtttgtctgctttctgttttttttgagaatgaggatggggtggagattagggttaaatttaacactgttatctttgtaggcccaggtttctctggttcatatctctgtcaatgagactatcacaggtctgtgaagtttttgggggatttggaaaatgcctgctggattagcttttttaaaaaaaagtattattattattttgagacagggtctggttctgtcgcccaggctggagtgcagtggcatgattacggctcactgctacctccgcctcctgggctcaagcaatccgcccacctcagcatcccaagtagctgggactacagttgcacaccaccacaatcagctattttttttttgtagagacagggttttaccatgttgcccaggctaatctcgaactcctgggctcaagtgatccactcgcctcagcctcccaaagtactgggattataggcatgaaccaccgtgcctggcctggattagcttttaagagcaaccctgagctaccctgaagacatctcaactagtacagtttagccctccagagttgaggacagttgctgaatccaacacacattcaactctccttcccttttccctttgccagatacatttgcatttacttctataaatcacagctatcattgtttttcctaataattatcttatgattcaatacactcagtccagtgagcccaggaatacatagtacatggttctaaattttattgaaaatatttataactttgaaatgtaaataattgaactaaattcatcttctataaatcatattttgggaagaaaccctgattgctctaaccaacagagatgttattagaaatgtaatataataataaaagcaattaacctttactgaggccatcctgtgtccctgaactgatggtaggcactttcacatcctttttcatcctcccaggaacctattagtagaagatatggtttctattttacaaacgaaccaattacagttctgagaagttaatctctttgaccaagcagttgtactttaggccttgagccaagttttgaactcagacctctctgactttaaaagtcctctaagccattctacttggaatcaattactcacattttcaagactactcaagggcagctgtgctacctaatacgtgtaatgttgggaacaatatttaactacccgttgacttagtttcttcatctgaaatgtaaaggcaatcagaacttccttagaggattattgtgaagattaaataaattaatacatgtaaactattttaaaggtatacagagctactattttataagtgttagctatgacgattgatgattatgatgacaatgaaatcatactctctttctcaagtgaatagccgtactcaaaatgtcattatgattttgtatgctaaacaaaaactacagaaaattaggagtattagtttgctcttaattaaatttacatgtaagtttcttttaatcataaatttggaaatctcttttgtgcctcccattatacttcttagtctctaaaataaaatttgcattttatttgagaccacagaatggcagttttgataattggattttaaaaacctttttaaaaaaaaaaaaaaaagatttgcatattatttccctggtataaggaatctggatcaccaaaatattaagaacattttctattatttctcatttgtgtggaacatgggggtgttaacattgtcttgacttatttgccccgtatggttgttaggttccagggagcttcagctgagcttaagtgttcctgtctgaaatatctgagtcaaggtgtatgaaccagagatcaaacaaatcagtaaagaagtaacaggcataagactgaagtaaaaaaacaaagatggttccctatcactactaagtatggacagcccagaggtgtgacaaaccctattggttcttcttgcctactgcacagtaaagccaatacactgagacagcagtgttgcagtagaggatgagtttaattctcacaaagcagctgagctgaaggatagtatgcatttctcaaatcgacctccacaagaactcagaaactagggtttttaatgataatttgatggacagggagctagggagtaggtgctactgattggctgggaatcaaaccatagggatgttgaaactgtctttgtgcactgagtcagtttctggtttgaggtcatcacaggaccagtcaagtcagttccttggtatgggtcccaggttcaggtggcatcagtttgtctgccaggatgcaaaaatgtctgaaaattatatccaagaccagtcttgggaagcaactggagaagttataaatcttgtgacctctggccacttgactcctgagcagtaagtaattatagaaaacaagcttgggaccaagggtaggttattgtttaactatgcttgcatcttagcagaattcatgctcctcccataagtctaagcttgtggcctttcattagctttacaaaggtggtttcagtctgaacaaggaggggaagggactgttatcatccttgctttaaatttaaactgtaaactaaattcctcccgtagttatctgggcctacatccaggaatgagcaagggcagttagcttgtgagtttagaagcacaatggagtcacctatgttagatttatttcactgtaataatttcacaaaggcagtttcagtcacaagtatttaagagcagagacaaccacccaggaattcaaatctagattgaagtacaagctgttttaaagcctgcaaggttggtgtgtgtctggatgacaatggcagtgctcatttacctcaacaaaggctttcaacagccatagaagttggtgacaaatttatactctagtaagtatgtggtttacagataaggcaggctgagtttaaaggtttgcagtagggattgcaccggatagtgtgaaaattgtattgaaactgatattaaatatcttaaatataaagcattaaatgacattaatctagatgttccgctatgacttttatactgttatggctttcatctgttgctgccttgaagttgaggagaaaagagcaagcagtggcctctttgtgaggtccatgccgactggaactatcatcacacaaattactactaatatttgctttgttaaaaaaaaactttaggaacaaaaaaaaaatgagtaaaaactttctaagactatgtaaagactatactgacttttttgtattcctgaaacaagaagaactaagatacaaattattcaatcctagacctgaagaaattgtgtcccatggacaaagatgaaggcatttttctgctgccacctgcttcacaccattctctgccctctgaaaccagatgcttaaaagcaatcagtgactcactccacattacccaaaggataaattcccaaatccttagttggtttaccaaaccgtcaatcagtagcccccactcataccccttaccatcatctgtctccatttaccttattacactttaacttcccaaaattgaactttctttagtgtatattgaggaatattctctctgccaagaccactatccaaccacaccatatacattcacttgattaactccaatgtattctttgattctaatttataactccaaggcgaactcttcccttaaccctcaaattaagtgactccccctttgtcctttcataatgtcagggcacatttgtttcaaacacttttatagtgatacctttaaagaaatgtttccaaaacttcagtacacacaggaattatctggagatcttgttaaaatgcagattctgattcagagtgatgccagtgctgctccctgtccccatactacagagtaagtagcagtctgtctgttccactagacctgagagtaggatcctcaaagccccacttatattaggccccgaattaacagctactggaggaatttaagaaaacaatacacaattggcaacacaatttagttttggaatacaagtggtacttacaaatagccatttgagaaaaaccttgttaacttccttccctccttctgtagcttggtatttccaccttttctttccttctctttgcctcagtcttcactcctaaatggaagtggtctctcagttccctccttaatcacggattcttttcatgcccagtagtcaacccttgagatattttcagtggtagcacttcagaaaatgaaaagcaaagggagccaggatagagacatgaagaaaaataaactcctattctcttcctcagtaatcagtgagttactttttctttctccagatctcacctctctggccccatcagactatttattaaagaatcacaagtacatctctagactcctcttcagtgttgcattgctcagaaattcgttgtgtaggtggtgctcagaaatagaaatgaacctcatatcagtcattcatttacataaagacttgtcatatatataattatagtgtatatatatgtgtgtgtgtgtggtgtgtgtgtgtgtgtgtgtgtgtgtgtgtgtatttttttttttaaatagtgatgtggtcttgctctgttgcccaggctgctctgctcttggacttctggcctcaagcagtcctccctcctcagcctcccaaagtgctgggattatagacatgagccactgcatacagtcaagaattgtcttttaacatctaagtagagacttaatcttgttttatgtctctctctgtctgtctctctctctctcccccaacgtgtagtcattttattccaaaggtttgtagttgcatggactataaaaatggaaaaataaaaataacacaaacttcctggggtccccttactacccatatccccataccttgtctcacctacgacaggtaaacagaatcttggagagcaagtgctgtggagtagtcactgcatccaaggtagagagtggtaaaaatgtttcatcgaaaaataatttttctatgaaatggacaggcctcttctccattaggtttaactgtgtttctgactgtgtataggagaaaatgggtcctcagatttccaccacagggtggttctactattagtacatacaaatctttgttaggctttctgtttctttattgttcaaaggcacaatataaggaatagggctagtctgtatttcagtgtaaaatatatgacactttatatatgtgtatatatatatatgtgtgtgtgtgtgtgtgtgtgtatgtgtatgttatgtatataaggttgatttggtctgtatctacataaattacatgatagatatataaatgtgtgtgtgtatatatgtaaataagtctaatgtatacttataatctatatatttgtatttcgtgtgtgtatatgtatatataaacctatattttcatttcttgtaataaaataattaaaataattaacatgaaaaagagatcagaagagaaactcttggtaaatgtataggtttgtctattaataagatgttagatgtgctatagatgtcatagtaaagataacatcccccaaataccaaggagaatagaatgattatactagggtgcgaattctagcaaattaaaataaatatctgcgtgatccatgtttgtaactatctgacagactgtttgctgttaataacttttctggaagccacaaacacagcagtagcactcaattatgatgcggtctacaatataacacaatgcagtttttctgctgccttcaagattacataggcagcagagcctaccataatgaactgtcccgaaaactcaaagtgctgtttgcagcaattttgcatgtgagtattcagattttacagtgtatgaagtctgacttgaatgtgctctacctcagtaattctcatttcaaaatattcacattaaaaacattcacatcttccttttttgattgaagaccatgctaataaaaaagcacatagaatattgcaaataaatagtcatagtgagctaagaactacatggaacactgagattcttcaaggtatgctaatgactttttgtttagtagatttcttgtgctgcagtacgcatgttaataagtatttcatcctcacacaaggtgcttggtgatgaacacactagcccagaattatcagcatacatttattcgattatccgcttgtaatcaagaaaatatattattccttttctcttgatattttggttcatattatctaagtatatgtctaaagcgttaataatattataattcacaaatgtaatgcttaaataggagaaaatattttaaagattctcaaaacctctgtaattttttttcccattaccaacatcattccctttttgctactacatttatcctaattagaaaaagtagcagagggtttgaaagaagaaaaaagaaaaggaaaagtgaagtcttcctaataagaaatattatgttaagtactaccacagcaaattatcattagtgggaattagaaggagcccccttaaatgtgtatataatgctatttttaaaggcttaaaatattttatttcaagttttaacagtatcctatgttactctttaaacattttagaaacttttacaactcagtttgtttcatattaaataagaacttagctgatctcttttggactcactgtggaacattgcattaattgttagccataggacaacaataaaaaaataattttagtaaaccacataacttaggtgactcatgaatgaaagcggtttacagatgtgcttattgaccagaaagccttaatgttcccctcagcttgactaactttagatagatcctttcatgattattggcctccgacctccctttgcttagagcattcactttagaaaatatggaatggtcaattctttctctgcccctttaaggtgtaaatcttctttcagtctcttgccagttttacaccccagaaatgtctttcccaaagatctgggagctagccctttgaaatgtaatcatcaagcaagatagtacccctacctctcaggctctttgggacagtaggagcctaactttgatagataagtgacaatctgcacatatggcctcatctctttgagcaactctccctacacaaagtcctctagtacttttccactagctcaccccaatacttaaaaattatcccaccttttgtactagtggaattgagttctgtctgtgtcacctattgcaagtctttaataaaatctttcttgcctgtttaactctgccttgtgcaatttttctatgacattatttagactccaagtttactgtgcagagtaaaggaatagataagtggagagattttttaaaagggtttaaatgaatgttctaagatatagcaatgactcatttacctgccatcacttgccttacccttttaaaccataatacttctccttctacttttatcattcatgatggaaatattcctaaaatgtagtagcaagccttctgtttctttctcaaaatgaagatttgtttctcaaattgaaagtagttttttgtgtgtgtttaaacaaaaatgtacatgtggaaaataagacactgcaaatcacagattaaagcagtgtttctcaaccttttaaaaatcattactgccccgctaaggagcttttttagttattttttcctgcctcatctccccatgagattttaataccatgaatacatggtatgtctgtttatgtactgctgccttttggggtgccataaacccttacagtatctaagatttgtttgctcccacccaagaaccagtttttgcaccattaggataatattgcctctttgaaaatgcatggtttaaagcacaaagtaaaaatcacttaaaatcccgtaccacagaggtgaccactgtttgcctttagacaaacatccttccagagatctttctaaccatattttatgtgcttttaaaatttgtttttgtgctttaataacaatatggaaatgtttccatattaatatagacatcatccctttcaagtatatataatttatttaaccaatttcctgtgacatacattcttccttcgatttttatattttaagtaatactttgatgaatatcatgtcgtatcacatttgtgcatttgatgtgctgtctttagaaataatttttcaaaatgcaatttctggatagagaggcacatacatttaatttgtttttataaaaatttccaaactatcttcccaaaagattttaccaatatacattctttcatatactgcatgagaatgcctgtttacaacatagggtattatcaatttgtttaatctttgccaaacttatagacacaaagtaagtcttcactattgttttaattctttattcttttatccttaatttgataactaattcattgagtttttaagtaagcatattggctatttgcatatttaaagatttccctcatcttgtaactttttgtcatttttttttactttttttctttgtagtccttattaattacattgcctaaaagataataatcatgtacagtaatgaatgcattttacagttgtgcctttgggaactgtatagggctctgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattatacaataggtgatcttttgttactagcttatgcaatagcgtatttttaaggttcatacgtactgtagcatttatcagcgctctattccttttcatggttaaataatattccattgtaaggatgtaccacattttgtttagacattcatcacattgatgaacatttctgttatttccactttttggctattatgaataatgctcccatgaacatttgtgtacaagttgataatgtgaacatgttttaaatttacttgggtatatacataggtgtgaaattgctaaatcataaggtaactgtttaacttcctgaggaactgccaaattgtttcccccaacagttggacattttatattcaaatactacaatccgtatgtttgtagtgtttgaagtttccaatttctccacattcttatcagcacttcctgttttctgggttttttgtttgttttattattgttgtagccatcctagtgaatgcgaagtggtacctcattgtggttttgtgccgttgtttttaaactgcttgatttatgaatgcatttgtggttttattaatagaattgctaaggtcaaaattatttaaaccattttcaaacatggtatgtgtcttgtgacatactacaaaaagttggcaatggttctctattacatttacgaaagaaaaaacctgctgatgaagttgaggctctgactgtatgtattaaactttaacctaagtcactattgacagcagagtatttcaacctctgaagacccagcctcactaaatttgcaaaaatagttttttaaaaattgtactaatacatttctatgttaatggaatggtcactttttcttttcaagtctagtatctaaagtactctgaaatggggaaaagatcatgcttttatagaaattttcttgacctgagcttccattaggggaaaaaacataacttccgattgaaaaatatatttacataataccaatatataaaccattctttcagggtaagccaaacacatctaaaaattccattaagtccattggactggcagttattatgttaaatatattttcatgaaacattttgcttccctggaagcaaggcaacaaaaaagataaaactaattaaaatgatatggggaagaaggagaaggaaagtcacagtcatagtatgttttagatttttcttactgatgaataaaaataactcctttgatttggattatattatagtaattttcatcacttttcaaaaatcttgttcaaaattgtttagttttagtaacaaaatgagcctctttctaccattttcttaggaattctgctactgggacattttgcaaaagctgcaaatgcagctttgattttactaagtaccgtgattttgcctgcattttcaagtacctagatagaagttagggcttaaattgtatttgctaaagttttgaggacttctgagaaaaaaatacaaaagaatataaacatcttataataattcccatactcccccgccctttttttttgttcccacttgtgtaggagacataacccaggaggtgatggagaggagcaaaaacctttccttttctttaatcacttgagaaagagagtcaatctaggaatagctaaaattactgggttctgagtgatgaagacttaagctatttgagaatgaaataaaaattttatgaagtgactgaaggcaaagtcaaaaataaagagttcacaaaggagaatatacagagtactctaataggtcctaaaggagattttagaaaagatattactttatcatactgtgttatttaaaattgccttcatgtttgtctatttttataaagtacatgtgtgtgtgttacaattttttggagatttttgctctcaattctttatatcttacgtgacagcaattagtaccatgtaatttgggcagaaattcctccaagcgacaagcagaatatttcacagtgacattttaatacatgtataaatatattaaaatttgtctctacaaatgcaaaattttaaagtaagatcaaataagaaaattatttaatttttattacttcctacataaacagagaatattttatttgtgggactttttataaatgctgagatgcctctccacctccaaatcagagtgttttaaattttataattctattatagattcaatcatttgggtaagtttacaatacatagctgttaataattattactgagactgaggtacatacaaatagtggaaagctaagatagtccaatatatgtgagcctctgttagcacaggacagtcattttatctgcagataaggacagttttatttcttcctttcctagctacgtatattttatttcgttttcttgccttattacacagactagatctttcagtactatgttgaataagagtagtgagaacagacatttttttgtcttattcctgattttagggggaaaacattcagacaatttgctctttcaccattaaatagcatcttagctgtaggttttttatagatgctcattatcacattgaagatgtgtcccctaatccctttatatttattcttctaagaattcttatcatgaatgggtgttacattttatcaaattcttttctgtattaattgataataatcatgtgatttttctttagtctgttaatatggtggattacactaattttcaattattgaaccagccttccatcctaagaataaactccactttgctctggtgtatacttctttcatatatcactcaatatgacttgttaatcttttgttaaagatttttgtgtttctgtcaatgaggggtgtttgacgtcagattaatactagcttcataaaattaattggaaggcattccatcttctcttttggagagaagaggtagtataagattgatgctaattcttctttaaatgtttcatagaattttccagcaaaatcatctggacatggagatttctttttttggagtagtgttttaattatgaattcagttttcttgatggttatagggctattcaaataattaaattcatattgagtgagttgtcacagttcatgattttggagaatagatccattttatctaagttgccaaattacaaagtgtagaattgttcacgttagtccgttattgtgcttttggtgtctacagggtctatagcaatagtgcctgtttcattcttcgtattggtaacttgtgtcttttctctttttgtctttgtcagttttgctagaggtttatcagtgttattgatcttttcaaagaaccagttcattgcttcgttaactttctctattgcttttctattttgaatttcattgatttctgctcttgtctttgttgtttcctctgtgcagtgtgctttgggttcatcgtgctttttcttttttcaggtttttgaggtgggagattagaatagtgactagagatttttcttcttctctaagtaagcatttagtactgtaaaattttctcttagcactgctttggctacatcccataaatgttgatatactgtgttttcattttcattcatttcaatgcattttttacattccttgaaacattttttggcttatagattatttactagtcgtttggtgtccaaatgtttggagattttcctgttatcttttttgttactgatttgtagctttactccattgtggccaaagaaaacactttgtatgatttcaattattttaaatcaattgtggtttgttttatcccctatctaggtatatgatccatgggaacttaaaaagaatgggttttctgatgtctttgagtggatttttctataaataatgaccagatgctgttgatttatgatgttgtacccagtcagtagatttggatctctagatcctgaagaatcttgccatgtacacagttggtgcttatgaagggtttgttaaactgtttggacctgccatagtattaccctttttcctgttaccacatatacctctcctgtggtctgttaaaatttccagaagaaaggcaagcagcttaggcagactacagtgatagtgtggcatcactaacaacccaaagttaaaaagtttgcaatagcagtcatttatttcatggtcaagggtctggagtttggcttggttttaattgatcttgtctgtgcttacctgtgctctactggactatcctggattctaggttttgggttagattcaaatctgttccatatatctaaattttaggattcatactgaaggagcaatagctgtctagatcatgttcttttcatgggaaaggatgtaagcctcaggagagctggcagaaacttggaatatctcttaaaggcacaatgtcacttctacctgtattccattgtccaaagccagtcacagtaaagtccaaagctaatgcgttaaaggtatatactctgcctattccagtaggaaacacttcaaaattgcgtggcaaaaggcatggatgtataagtctattacaatgagggagtgaagaactggaagctattattcaattttcctttgactttcaatctttaggactttctactctacacagggatcaggaaaatgaaaattaactctccacaggaaaactaatgctccacatgaaaatccctatttggattgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaattattgaaataagaaaatgaacattgattttatactattaactaatttacagattagttctggtttgtacagtgtaatgttcaactattagtatattcactacatttatccaaagttttgtttttagagcctgcatagccaaagcaaggctaagcaaaaagaacaaatctggaggcatcacactgcctgatttcaaactatactataatgccatagtcaccaaaacagcatggtgctggtacaaaaataggtacatagaccaatggaacagaatagagaacccagaagtaaacccaaatacttacagccaactgatcttcaacaaagcaaacaaaaacataaagtggggaaaggactcccttttcaacaaatggtgctgggataattgggggaaagagtgggaggggggtgagggatagaaggctacaaatatggtgcagtgtatactgctcaggtgatgggtgcaccaaaatctcacaaatcaccactaaagaatttactcctgtaaccaaatgccacctgtaccccaataacttatggaaaaataaaatgaaaacaaaacaaaaacacacaaagttttgcttttacttaatttaaaacaaagaaattttgtaggctgcatgtggtggctcatgcttgtaatcccagcactttgagaggcttaggcaggaagattgcttaaacccaggagtttgaaaccagcttgtgcgatacagggagactcttgtctctgtagaaaatttaaaaaactagctgggtgtgctggtccatgtctgtggtcccagcttctcaggaggctgaggtaggagggtcacttgggcacaggaggtcaaggctgcagtgagccatgatcacaccactgcagtccaacctgggcatcacggcaagaccctaactatctcaaaaaaaaagaaaaaagaaggaaaagaaattttgcacttgaaaatagttactgatctttagatggataagtaaaataataaaatacctaaaatattttttcattttattctcattttcaaaaattttatcttttacttatctaattattattcatcctagttgactattttcattgtacagagcaatccccaccattatacgatgaaaccttagcaagtttttgttctttgcaacctaaagactaagaatccttagtagaatcatatatatggaaactcttgcacaggaaccaaatgtgtaatgtgtctcattcagagtggaagtgggaccaagaaatttattaggaactgaagtgtgtgctctcgcttgctctctctctctctctctctctctctctgtctcaatcttagtgctcacaaattatttaatattaacctactgaatactgaatatgttaataatttattcagtactcagtagttttttcttcttgtctctatataactcttttacaaaacttttttctccccttacaaatggcaacattatgaccatcataatcaaagtaagtcatcttccagctctattattcgccatagcctagaaacttccctttgtgactctgttcataatgcaaaagaggaatttctgaacatcactggttttgggagggcagaccactgatgtgtcactggcttgtatatcgatgcctttcatcccttatgtcaggttcttacctctgactaaaccaaactagctatatcatttagtctttgctacattgcaaccatctaccccaaatatagtaacttatataataatcattcatttgcttacagtatggtggggtcgtcaatttgggctggactcagaatggcttatctctgctctacatgaggtcaacttatgtgtctgcaagttcaagtatcatggctgagcttctctttttatgtgttctcttatcctcaaggagcttagtctaggctcattcttatgttgatgaaaggggtcccagaaacagcaagagagagcaatccacaatacagaagtaccttttatgtctctccttgtgttacttttgccgatgtcccattgaccaaagcaagttacatgggcaagctcagattcaaggtatagagaaatagattttaccttatgttagaagaagttgcaacaacacattgaaaagagacatgtggctgggcgccgtggctcacgcctgtaatcccagcactttgggaggccaaggcgggcggatcacttgagatcaggagttcaagaccaccctggccaatatggtgaaactccatctctactaaaaatacaaaaattagccggatatggtggtgcacacctgtagtcccagctacttgggagtcagaggtgagagaatcgctttaacccaggacgcagaggttgcagtaagcctagatcatgccattgcactctagcctgggcgacagagtaagactctgtctaaaaaaaaaaaaaaaaagaaaagaaagaaaagaaaagagatatgcatacagaaatggaagaatttgtggccttttgaaaaatctgtcattctaggccaggtatggtggctgtaatcccagcactttgggagggtaaagcgggagaatcacttgagccctggaatcagaccatcctggacaacagaaaacagaaaaaacctatcacactaatatagggaacctgggtgttacaacgtagaacataactatttaggacaaaaggggatgtggacaagcatttccccagccagacttgtgaattagtagctccagaatgtggctgatacaatgagatcagcagggtgttatacttcatttatattgatgcagtttattttattaataattataatgatctcaacgagagtcacgaaacaggttgaggaaagtatataaataaaaggcacacctaccatccacagtcagtcctttgattgtagtctaattaagactagataatgattgaatatcattgtccctgatggtggttttgtagtacagacaaattaaaaaggtggtatacttcctgatgtgaaagaacccactttgggagaaaagacaaaaacatcatcaccatgaacattaattggggtcagtgttggaaaaatgggaatttattctagctttcctttcttcacgttagccctgtgggctgaagttgtacattttttaatttctcttgaaaattgcacagttactgcccactttgtgcttttagattgggtaaacagaagcagtaaattcccagtagctaatgctttgctgtgtaaaggtggaaaatccgtttaaaagtagtcatataaacctctattttctggaatgtttctaagatattagaattggacacatccataaaacagatttctctatgaggtcagcaggatgccatacttctttccatgcactaaaaggcacaccttggttctgaaaggcttaatagtctcaaaaagtgaacactccagtcttcactctgtatagattcactcccagggagagaagggattctactagtgagcagaaaatcaattgctgagtttctgtagctgctttaacttttacttaccagtaggacgccattttctctttgggaaccccactggcctaaacattagctcccttttcaccagcagggtcaggcccttgctgtttctgagttaggagttttatacaatatacagaaatgtccttatttttaaacatataattgcatataaaaatgtgttggtattccttagagatagttgttacaagagaaaacctacaaggaagtaaactgtaattgaccactgcctgacccgttatatggctgtatttaagttttatcctccataaaataattatgatggctttgtgtgttaaaaatagctatttatattcatttgagtgcaatacttgttattctctgccctggttcagtcataggagccctgaaaagcttatggcctgaaggttttgagttctgagttgaacaggataaacactcctttgacttaaaggggaagatgacctttaccattgtagaattcctgtaacaaagttgctgttcattaagtatcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctacatgatcttattttgaatgaatatccatctttttattcttactgtggactctcagtgtaagttcctgaaatcaactaaatacatttataaaaataatttatcttaaaaaacatgatccatctatccttgtgcatatttgctattatgtcaaattgtacctcctagttagagtgcccattagtatacatgcatttttattatgccagtgtatgtggaaacccttttgctccccccaaaagacatgctttatcttgcctttgaaaatagaatttccagttgattagtttttattgcaaagctgcctttcacactttcacattgaggtaattatatgcgcctcatattgttttttaaaaaagatgtttcattcattgctttccaaaaaaaaaaaagcaaaataatttatttcctctgaagagggacatgaatttcagtgtttattcatgaagtttacaattgatatatgtattataattgtcctagaaacactttttacaataagatatctttgtaattacgcacctaggataatttggtataaaaagcagtgatattaaagagtgaatagtgtttgcaggtcatagagctttgctctagtattatttgctttactgcaggattcaacataaggcaggtgtcttgtctcatgaagtttattatagaaagagtccttataccatattttcacttatgatgtcgaaacttagaataattttattcaaagaatatcctttgagctccaataacacaaatcaggttataggaagtatcaccctggtacagaattgttcacatactcatttgtcattatttgaagaataaatgaatgaatactaagagcaaaaattagtggcataaatcagaaatccattcattaataaaggagaatacctagcatgtacttgaacagttagggtagacttcattgctttggtaagactttcatgaacatggagtttataagtggaaagacaagaaatgtttttggtagaagaaattgcataagcaagcatgctgaggtataacttcaagtacatttaaagttcagtaaggggccaggatggttgaagccaagattccctgaagttaattctggagagttggaataacattacgtcataggagagactgaaagttaatcctgttggtcatggggaaccactgagattttaccaaaacacttgatttagaaagattcttatattgtgtcaggagtgaaattagagtgggaaaaggaagcgaaagcctggactggttgacttagttccatgagattctctgctatttaaatgtgtcctcagtctccctgctgaaatctaaagaataatctgaaggcaaaattattcccaagtacgaaaatgttttagaccttcttcctaggcaaacatatttctcaattccatgtccatattacagagattgagtatagtagagactcagttttatcacttgtcaacattaatctgttgattgaaatagtaaaaatgtgaagaatttgattcaaaataattttaaacatatacatatactaatatttactaagactctttgacatgcataatacagaatcagagtcatgaaagtaaatgcgtaaaagaaagaaaatacgcaatgggtggttgaggaatacaaagacttttaatagaagtttcaggtatttcagttctcagagggaaatgggaatagctagcatttatccagcagtcctatatagtagtatagaacttgtcatttacagatgtcctagctagggctgctccacaacaataccatagactgggtgacataagcaatagggatttatttctcacagttctggaagctggaaagtccaagatcaaggtgctgatagatttggttccttgtgagggctggcttcctggcttgtagatagactccttctctcttcattctcacatggcggagaaggaggactctggtatcttttcttcttataatggcaccaatcccaccatgaagtcctgcccgcccttatgacatcatgtaaatctaattatctcccaaaggccccacctccaaataccatcacattgggggttagtgcttcaatatatgaattttgagggaacatattcagtccataacaacaggtgttaccatatttaatatttacaacgatccaatgaaaggtactattcttcccatttatacataaggaaaccgcgatagagatagctttaaaactttcccaagattagtggctgcagggtgagggtgttgagaagcagccagggtttgaagccaaacagattcctaggaaaaatattcttaactcattctctgagtttaagtagggtattagcagtttaatgatgatggggtaacagttatatgtaagtatgagtgtgtgaatgtgtttatctgtctatctgagtgaatgagagagtgaagaggcagggagagagagcataagcaataataacagaaggtaggatagtaatttaccactcttactatgaggtgtgggtgtactgttctagatgtgtaactaaaaggaataattttaacctgattattttcatcatacccacttggtggtcattttgtaaactcccacagctcttgtaacagtatatctcaatagtaaaaaagtctttgaaatctatattgggcacgctgagtaaagtgcatcttttttcttccaggaatctctttctaacagtggagaaaccaactggtgaagatcaataaagaatgcttgttttaaacaagagtaacttatgcatacatatgcatacacacacacacacacacacacacacacacacacacacacacagagagagagagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttccttgataatatcagcacttttactattacaatcttaatgacttgggaaatgcaagctggatagaaaatgtcaaactggaaaggaaaatttcaaatgttttgctttgtaattaaggcctgacaaatataagtcaattttagcataatagatagattatcaagtagggacatttagctaatgttagaggtaaaaaaaattataatttatatttgaatacattctgagatggcttcagtgtgctgacatgttttaaaaagtgtaacaagtcttaacaagattccaggaggggatacacacatgtggacacacacatacattcccaactatctgtaaagggccagagagttcatattttaggattttatgggccacacactcttgatcacaactacttatctctgctgttgtagcatgaaagcagtcttagacaatatataatcaaatgagcatggctgtgttccaataaaattttctttacaaaaccaagcaaagagccagattttgcccccaagccatagtttgataagcacttatctaatacatattcatatgtttcatatagagggatagcttttactagcaagcagtagtaataggtgtgtgcatcattttaagcccttaaagagctaaatcatatccaatcattcaacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtcaagttcaaaggaagcacgttcaaaaaagatagtgaagtttctttaggtacaagacggaaaatggttgactctctctatacctaatattaaaaaaaaaaaagaatctatggtaattttcttttcttctattcttttttattatttttatttttttattttttattttattttttttttgagaaggagtcttactctgttgcccagactggagtgcagagtgcagtggtgcgatcttggctcactgcaacctccacttcccaggttcaagcgattcttctgattcagccacacaagtagctgggactacaggcgcctgccaccatgcctggctaatttttttatttttaatagagacggggtttcgccatgttggacaggctggtctcgaacttctggcctcaagagatctgcgtgacttggcctcccaaagtgctgggattacaggcatgagccatcacaccaggcctacagtaaatttttaaaaagcattttaattggtaattttacagtaacctgggatgcagaattgaattgttttatgaattaatctccaaggagttacttgaatttgttctctctctctgtctctctctctgtgtgtatatatgtacacatacatgtatatgcatatatatatgtatattctatgtagctctatatgttttgttccattagacaacctggaatacataaatgttaaaaaattttttgtgaaacagtggcccacattaaaaacggttctcatttttgtttgtcattcctcagaacaaaacagtatttggtggttcaacaaaatagaaaattaattttaaaaatagagaggaaaataaatttaaatatgatttttcccagtagtcctataatttatcttaataagaaaggagtacaggtttcaatgcagcattgttctaagactttttgtgcatatcagaatttggattcatgtttttttaaaaaggaaaagaaacacttgtcgtggaaaaagttattcagttagtcaaagtcaaaataacaaaataagaaacgtcaagtaagtaaatataacctgggagttctgaaataaagataacaaaatgattttatcaagtatctaaagtctatcatttctaaagtgggtaaagctatcataaataaagcagaattatatttacttttctaaatactaaattatatgcagtatatgcatacaatttgctttatttaagaagatggctaacttatctgattctttctttatatgttttagattaattttctagagttgactctcactcaggtctaggcagaaaattattggtgtggaaaatatgcccattccagtgaggtcatctattacatgtgcatgtaatatatggcagcaggtaattgagacaatgtctctttgagatggcagtccccttgaagtcattgccagggaatatatttctctttaattttttatgagacaatttagggaggggattttgtgacttatcagttccagaaattatacctagcaatacagaaaatgatatgttttttcttgtggatggtacagctttgttaatttttgattttgagatgctttagggtagagaccaggcttatcagctcaatgagaacatgtgtttttgtatgtttcattcttggccatatcacaagtgcctataacagtgcctggacaagagtacatgctcaataaatacttttgaatcacaggattaacctttacattgccgattgccagcagaaacttaggagaaagccatggtggataatcaaaaagtacgattaaattaagtggaaagagcaattataaataaataactaccttaccattccccacagtgggtctgggaattcatccttgtaaaaccacggagagtgttcctctgagagtgactacagattttttttttttttttttttttttttgagacggagtcttgctctttcacccatgctggagtacactggcgcaatctcggctcactgcaacctctgcctcctgggttcaagcaattctcctgcctcaacctctcaagtagctgggattacaggcgcccgccaccatgcctggctaatttttgtatttttagtagagacagggtttcaccatgttggccagagctggtctcgaactcctgacctcaagtgatccgccacctcggcctcccaaagtgcagattttgtttctcacataatgagaagctgagtgcaatctatatgctgtaagaatatcccattcctactcaatagtgtctttatgactattactttaaagaaatgaagtaaaaggtagttttacttcacatacaatatgtgaagtaaaatgtagttttggtttacatgtatatatgactatatgataatacttcaggaagtcattaatgaggaaaacgattccaagacacatacataatcggattttttagctattgtgtttgtagcttactttcaacattagtaagcagttgtaagagaacagccattaccaattactgtaaccgcagcattacacagggagaaatatgactgttgaccttgaaatgagtataagatcatccccagtagaagatcacagtccaacaactctcaactctggctgcacattgacatcatctgggggagcttttagaaaattttttttattagatctaggccctaccttcggagactcttcactgtttggacgtctgtacatttttaaagcaacccaagtgattctattgtgcaattatggttgagacgatcgaatgctcttcaaattgttttactcagataaatttaaaggaattttgaaaaaacgtgcactatctcccatatttcaactataaaacatttcagcatatgtttaaacagtttcaaagaatatacattcctctgcatcatctatgtgttctaaatatattttggttgaatctttgaattgggtatttaactcattttgtttgtgggaaaagataacattaagacagaggcttgccctgaatttttttccttagacaaaataaagatctgtacctttcaatattttctttaagatatcttcaatggactatcccaaatgctcagcgcattatttaatggtccttttgtttgatgccctggagggttttactccctggagcaatatgctttgataagatttgccatagtgaggtacgtctttcttcttcaaagtaagaaaagtgtggttagataagagaataggcacattatcagatcaattttagatgtgtctgaaagctgaagatctggaaatagattcccttaaatatgttcatgtctgtgtactccttgaaaagtcctcatattttagtgtatgtacctcagttggaaggtagctggattaaacttggagctggtagttttggggaagacagagacaaggggacaggcatgagaattggccaatccctggtgggatctccaaactgaccagcaggttgataggttggttgggaataaggtgagaactttttaatgagggccatgtgtgcaccacatatcatagcaaaataggagttcaaaactaagcagacaagcaacaatctaagcacaaatttataacagcagaagaaccagagttggagagaaacgagggaggtagccaggaatcaagaggaaaaaattctgaagggcaaataaagatgggagaatgaagtagaaaaattgttcaaaaatcagcaaagctatatggggaataaaataatacaataaacatgactacaccaccaatgagagatgccatcaccaaagaggtgagaatacatgaagctcgcctgtcttccgtttgatttttttttttttctgtgtctgccctttggagtaggaacaacttctcatgcatagtagaggcaaaaaccagcatctgatagttccatgtcttcagtgtggagtagaaagcaggaaagagtgggtagatcccgagtgcacaggaaatgcacttatgttcactgaaaagccatacagcatccaactatagatgacattggctggaaatatagaatcacaaaaattattcacagatcttttttttgctgaaatcattttaaataaagtctgacggggagggagagcatcagcataaatagctaatgcatgcagggcttaatacctaggtgatcagttgatagataaaggaaaccaccatggcacacgtttacctatgtaacaaacctgcacgtcctgcacatgtatcctggaacttaaaattttttaaaaaaagaaagtatgtgggaaaaaaaatatcttacagagaccagagatttttttcttttcaatacatttctttagtttttgttttaaccaaaacagagttccaacagttatctcttcagtaaatgaaagcatctccttaagctttaagtggtacttgaaattttaaaagaggattattttttccaactcagtgaggttataatatacactccaacaactttataaaagcaagagaagtagagtgttaattgttaattatatgaaagtgttcaggcaaaggaacttttaccttgaaagcctttactctttagcatcaaaataagcttgaaagttctatggtatttagggaggatattttaaatttcccctacccaagaaaactggataaggattaatacaaaaccccctccagaatattaatttaattaagtagttatccaaagtgttatcacaaatacatgatgtgagttcacacttcaggcccttacatttttatattgcatggcatttgtctttttaattaaaaaaaccccacagttctattgtattgccatggggtttttcatttaattttccatttaaaagtagttttatttctccttttaatttaattaaaaacgttaaaattgttagggaaaaaaagaagaaaatcctgagtcatcactctttccttccttatttattcacattattgatgaaggtctgtctagaacaaaccactgatagcacattatcctttgaaaggcagtgaaacaccgaaaattggagtttgctcactttgaggatcatcgaaaacaaacagctgaaatatttttttccttttagaaaattaaaaaaaaaactgatatgaaatttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcattaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattcttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgactgcccagtcaagttgcacacacacactgttcagatgggtccttggactatgtcaaatcacattgaagtaaacagtagttggtgattagattaggatgaaatataaaatccataaaagtaatcgcataaaacttttaaatggcaaaactgcaattacttttgcaccaacctaataaatagtttctctttattaggacatgcagatataataattagcctttctctgatcggtatggtctagatcagagatcagagaacgtttttgttttttttttttgagacagggtgtcgctgtgttgcctaggctggtcttgaactcctgggctcaagtgatcctcctacctcagccttctaaagtgctgggattacaggtgtgaactaccattcccagcctcagaaaacttttttacgtaaagggctagattgtaaatgttttcagttttatgggtcatgtggtttctgtcacaactattcacattctgtcacaactattcacagtcatgctttgtagcttgaaagcagtcacaaatactaagtaaataaatgcatatggctgtgtttatataaaacatgaggggatagatttggcgtgtggtccatagtttgccaaacactatctagacaacataaaggttcaaaggaggaggatatgacatcaaattggggcaatgagaaagtatttcattgaagaggtagcacttgctattattcttgaagcctggtagatgaggtaagctgacattgtggggtgatttctggtggacagaatgtggatagtttaagaaattgaatttttatgaacactgagcatttcgttatggcagaaatatagactctgtgtagaggagtgactctagatgagttaggaatgtagatttgttcatgttttagagttttcagtaccaggatgaggaacttgtacctagcttgacaggcaattatagaccattaaatagtttatatcacaatgggatttggtagaaaccacactggaagacagtcattctaggagtggtgtgtggaataaattagagaagtaagggactgtaaacaagcgagcggattggaagagtgtcataatagcttaaaaaggagacaatgagggccccaacatagtcaggtaagaggatttctaaaaaagaggttgttgaggtaaactgtaacattctaaaaattatttctttaattgacaaaaatactgtatataattgtgtacaacatgttttgaaatatatatacattgtgaaatacctaaatctagataattaacataagcattacctcacctacttatcacttttgtggtgagaacacataaagtctactctaagcaattctaaagaatctaatgcattgctattaactctagttatcgtgttgtacagtatgtctcttgaacttatttctcttatctaagtaaaattttgtatcttttgaccaacatattgccccccacagccctggtcgctaccattctattctctgcttctaagaattcaacctttttagattccacatataagtgaggtcatgaggtatttgtctttctttggctgtaacatttaaggatgaacaactgggaacctaaattatttccaagctgtagtcccaccatatgcaccagtacttttaacggagcctgcctagttcctgtttctagaaaactattcagtaaaacagccgtcttctatgtattatgtatttttcctaagtcgttacctagggactagaaccctgcctagatccctgtgcccagtgcttcaagccgccttaactatcttgtaatattggcctctatgaatttttaagtagcagaatcagctcccctgagattagtttatatctccccacctggagtggactgcatcttgggtctttgctcaactatcactggagacattcacatttgctgggcggcattgtgccgacccatcatattgatctgtaacgtttagcctgtggttgggcaatttcttcctgcaactattgtatcccactatgtcaaacaaacatcaggtcccatttctacttactccagcctcttgtaagcaactacccatactacaggcctgaatactgagatttgccatacttcagctttttttaaaaactgaggagtaagaattatagacatttgagctactcctccttgtatgtgtactaataccactatgcaacttgtctattaatattattacatacaatttgaaattatattcaaaatagttaacagcctggtcattgacccatcaaaacacttgccagacataaataactgcttgcttaccagctagaaaaatcagccctgcctgtgacacagaaataaaccttcacaaaaacactaaagagaagagctaaaactatgaaatgtccaaaagaaaacataagagataatctctgtgaccttggagtggaccaatatttcttaaatatgacacaaaaagcatgaacaagataataaatattcatgttaaactttatcaaaattaaacactttttttttcttcaagagatattattaagacaacctaaaaccaagccacagacttgggaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgctttccttctctcttataaaaattttaatgagaacttggagtgaactctcactgaacctattttcattccaaaaatcttatgattttaatcttatgatcctcctgagacctggcactatggtctgtgacagcatgaatacttcataattattcctcctgtttgtagaaaacaccatgggcatccatcattccctctctcccctgctgcctccagggagtcacagcctctagcaaggtcagtaattgcagttttggttgacagttccaggccagctgaagcaaatccagctggtgaagactagccacaatggatattgactgacttcccttccttctttcacctcatagtcagtttggccttaaaactcttccttagtgatgtgatagatggacttaaatcatcccacaagagattccccagtacagagaaaatgaatggtttctctagagccatgtgtatatgtgtctgtcggtatttgggggacaattgatctaaccgtcctggggtaactgaaaggtctttcccttggggataaggaaaagactgtattggagcttgacatttaatattgtttggcatctcacatctctgtagataacctgcatgaaataaaagattcagccatgtgaattaagatggtattttggaagtggatatgcttcatttggctaacatcgaaaattctaataacagatttgccctgtgcatagaaaaaatagatgctttagatgtcaagcaaataattaagcattaattttttactttattttatgacaaatgcatagagagattcacacaagaaataccaaaggaatgccagatgctttatcaaaaaaaaaaaaacccacattatgaatccaaagaaagatagacaaatagccttcatagtatgtaatattggatggtatagctttacgaaaaagaagataaactttcatgtgaattgctggtgaattccagaaaagaaatgactttcgaaagtggtataatacctttaactctctaacttctcaccatgtggtttactcatagtgtagaccatgactaaagtaccggcagaaacaaacccaattaggcatggcctattgtatagatactgaactagtctagtgtctttaggtttgtaataagtcagggtttatttttttcttgcttttttaccctggtcccttgtttctggacttacttggggtttaaaagatgtatttgcttaagaataacttaattacccattctggataaaaatttaatggaatgtgttagaaggcttaagtgagatattaaaattaattgaaatcacgacccccacactctttgacacacctcccattatgaggtagattgtgagcggccttatagttactccacttaatagaataaagttgatgtgatgttatgtaacttccagactaagttagaaaaggtcatttagcttctacttggttctgtctagagacatactctgggggaaaccaacaccatgtaaaaagctgtcccgtgaccaccatgttgtggaggccccgtgtaggaatttcagccgacactaccgaccaacagttagcctccacttccagccctgtgagtgagtcatcttggatatccagcccagtccagtctttatgtaactacaaacctacctgatatttaactccagtcccctgagaggtgccaagtgagaactcctcagccaattccttctcaaatatttgtctcacaaaatttttagaatatctttaatatatgtgtaatagtaaaactactgtcactcagtaattttgatattaactgtatgtttattttggatattcagtttgttatgtgtctatttaaataattattgaatttctattaggaacacttgttcagcctatctaccatgagacttaaaaagcctaaatcacagtccttgccttagaagaatacaattgtcagtggagtagatgcaggatcatcaagtatcaaaactctggagcacaccattcatattatagtctatgtaaatggtctcccttgagttgtgcaatgggatgtcactggaaagataagacataaagtgttattttagtaataaccattcttatactggtaagcttctcaggattggtatatatgagtggtaaggaatactactaaattttatacttttccaaacttctttacagtactctgttgttgacaaaagtgaaaacaatttagttagaatgtaaaagtaacaaagaagttttaaaggaatatataatgttctgtcataaagacacaggcacatgtatgttcatcatggcactattcacaatagcaaagacatggaatcaaactaaatgcccatcaacagtagaatgaataaagaaatgtgctacatatatacaatggaatactatgcagccataaaaaagaatgagatattgtcctttgtagcagcattcatgtagctgtaggccattatcctaagcaaactaacacagcaacagaaaaccaagtacctaatgttctcacttataagtgggagctaaaccttgaggacatatggataaaaagaagggaacaagggcctactttaagatgaagggtggcaggagggtgaggatggaaaaactacctattgggtactatggttattacctgggtgacaaaataatctgtacaccaaacacctgtgacacagaatttacctgtataacaaacctgcaacatgtaccccttatcctaaaataaaagttgaattcaatttaatttaatgcaaaatataatcaaaattttagtctgggagtagtggcttatacctgtaatcccagcactttgggaggtcaaggcaagaggatagattgagctcaagagtttaaggccagcctgggcaacatagtgagtccctgtctctacaaaaaaatacaaaaatcagccaggcatggtgacatgtgcctatggtcctaagtactttggaggctgagatgggcggatcgcttgagcccatgaggttgaggcagcagtgagccatgattgtgccgctgcactccagcctgggtaacagggtgaggccctgtctcaaaaaaattatattgcactgtatgcaatactttgtaaatgcatatgctattcttctaatgcttttagacacttcagtgcgtgtcatgagaatatgccaagttgactaactataaactgatggttcccaaatttggctatacattgaaatcacctggggagttttaacaaccaactgatgtctggttcccactcccagggattcagatttaatggatcgggggtacagaatgggcattgggattttttaaagatctgaaattgttttaatggacagccacaaccgagaacaactgatatgtatttcttcttttaattaggtagttctcaaactcaactgcccattggaatcatctgtggaacttggcaaactattagtgatttggttccatttctagagactctgatttaattgctctggggtaggtcctcttggtacttttaaaaatgctcactagttaattgtgatttgagatccaccaataggatgctcatactgggtttacagattaatgtttttctgcatatatgtgtcactcagcctcagttaccacatcattactattgggacacagctcaggttgccaaattcagcaaataaaaataacttttcctggataagtttgaatttcagataaacaacaaatacttttttagtgtaagtatgtctcatgcaatatttgggacatacactaaaaagtaagtttttttaatttaaaattcaaatttaaccagataccttgtattttatctggcaactctaaacacagtataatttaggcaagagacagagcaaggcccaaataatgcattatatgaagtgtgaccacaatggtgttcaatccatattccaggacagaactaagatattcttattgtcccccagctgccacagagtaaccattctatcccataatactacttttaggcggtctcatctgtagcatccctcttatttattgagcaaaagcaatggacagatgtaggagacagacagaaaaaacctgaaacctcctgtcccatcagtgttaaatcttttggcaacagagagtgttaaatctattggcagcataagctgaaatcatgggactgaaacttatgacttaaaaaaagacaaacaaacaaaaatcctgtgggtttctattgtttttacttatgcaatttctcaaatattttcatgtaattatagaagagaaaaaaaaacagattagtgctgaagttctgatcactggctgaacttcatagccttagcagccactgttaaacttcgaggttctgtcgcatttatagtgacagccaattccctcagagttacacagcagttgctggcaagtataatctcacatttggcaaatgcttgcatttctgaagctcactttttcattggttcttctcaacaatgctgtgaagtaggcagggaagttatgatatccattatataactaaggaaaattagaatcaggaaagtgttgccttgacctagagtagtatttcttaacgtgtggtcctggacaaactgcctcagcattacctgggaacctgttagagacaaaaattctgaaaccctaccccaaacctactgacttagaaactgcaggataggcccagtaatttgtgtttttataagccttctagtgattctgttgcatggtcaagcttgaaaacccctgccttcaggggtatgtggtcccagctcaaacattactaatactaatgtttatttatttaatttatagtttatttgtccccctggagtttaaaggctgtgaggtcagggatggtgtcacactgcctaggtatataatagatatgcagcaaatattgcaaaataaattaatgaagactagaacgagtgaatgcatgaatcccacatatgggggcttccattgccatgccttgccttaaaagaagtgtcctgtgcttagaaaattccattgcttcgctcattctctcttttgaagaatctcagctaatgggaagaaaaatggttgactgcatgaatttatccacaggcatattgagactagatatttcccttgaccccttagtgggacttgcgaaggggtcgctcacttactcagcctgcagcactcaaaccccttgagggagggggagcacacaggtgagcggatgtgggagagccagggccaagtgcctttgggcaccggcaggaatgaaccttgtactggcctgtggcagagtaccacgtagtacctggaaggcaccttagtttatctagttcagtcctctcattgtatacataaagaaggtaaatttgtgagtggtaaagtctgtatctacgcaataaaatacttcaatagctggggctagaactctgatgcctttattccctttaatatgcaaaggttttgagtacagtgtcctgtgaagaatgcttgaaatctcaccatggggaatgtcaccagtgcaattctgctgtcttttatttttatttttatttattttatttttttagatgcagttttgctcttgtcggcccaggctggagtgcagtggcacaacctccgctcactgcaacctctgcctcctgggttcaagcaattctactgcctcagcctcctgagtagctgggattacaggtgcctgccaccacgcctggctaatttttgtgtttttgttagagacagggtttcactatgttgcccaggctggtctcgaactcctgacctcaagtgatccagcgcctcggcctcccaaagtgctgggattacaggcgagagccactacgtctggccaattctgctgtctttatttctgcttaattattacttttaatttcattattttattacaaaactttaactttttatattgaatggtattattaatatggaattttgtatttataaagtaaagattgaaggaagcgtatttactgctaatggaaagtatcgcttactttttccttcaaagcaggaaaagcaatgtgcaaacatgtaagtgaaggaaaaatccaaccaaatctcttacccgagtatctacattaatattgtttggtgggtgagatatttctgcaattctgcagtattaatccatccttctttattatgtccaccgaaggtgtaacactgattacagtatgttttagggaaaacaatcctcctaggcatagtggcgataattcttcgacttttttactttgctgtcttggctcatcacggtgacctttaattcattttctcttgtctggtcttctttgcagacactacgaagccactctgtggtgtctattgagctaaagtcaattaatcacagggtgacttttaaaaaatcaagattaataataggttatttcatagccagaatgcttgattaagatgggcacatttgtggttcccctcatggctagaaataatttagccaagttacaatatcttgggcaaatttttctctcttataattttcccaatgagaactgctcagtttaaatggacttccctaagcttccatcaggggttctcagaagggttatacaaaatcactttcgttagctactgggtactcctaaatggaagcatctttgtaaagccatgtagcattggcacctcttcacaaaaacttggggggagtccgtgaaaaaaataacgggaagtctgtctttaaagataataacgtctgcctccaacattttacacatctcagtcatgccctgtggtgggagcaaaagaattctcttttctctttagtcttgtgccaaattttcttttcctgttggcctgaatccactaatgtccttggtaggtggatcctggtgtattaaaagattcatagcatttcatatttatattctgcttaacaatatgatggtacaccttagcagtttagcaaaatggcaaatctgtttgcataataaaccatataatgtgctgcatcatcaatttgactttgctggatgaacgaagagaaccagttggctctgatgaagttgagttttacaggtcaatgcaccatccatattaaggaaatccaggacaactatgtacatatatattgtagctagaggctgaatacattttgtacaatatttcatttgctgttataaaagaaaaaaatataagcttgggtacagctaccatagaaatcaatttttaggttttatattattactgcctttctattccccaggtgtgctttttcatagcatctccatcctaaacacaattgcctttgaagtaccaatatatctcttagtggatgacaatttccaaactctactcagaaaatacagtgcaaatcctggtataatataatggaactaccaagagttgttatggggctacatattttctgttctctactctcttgagatcttagcaaaatcccttcttggtaaccttggcttattgaaaagggctaatttatttggcattaatcagaagacatataccatctctcaactagactctctccacaacgttcctttaaaatttttaatctagtgaaaacagggggtagctttattctgtaatagtaatatggttcatgatatggagactgcagaaagaagactgtaaagctgaatttcactgcaagaaaatcgtgacttcaatacttcaggagaaaatcttgttgttcagtttgctggaattaatagttattttacctgtcaaactgtagtaccatcgaagtttcaccagactgtctagaacagactaatttgaagaagtacaatttcccaagtaatgttttattctgcagtccctctcttcagggcaacacacccatgtaggacctctcccactgctagtttagtcatgtgaaagagaatacctcttgttgttgcaagttatttcatcatcatcttgctaaagaaatgtctcactctcctaagtctccaagatcttttattggccagattccatataaggctttgtgttctacatttgtgatctagggaatttaaagcttttcacttctagcttaccagaggcttctgtatgtggtaaatcatacattgatataaaaagtaaataataataatcataataatagttatggcttatgtaacctatctttctcaatagttattggaccatgataagtgatacctcaataccacataccccttcacccaccatccactatctctcatacccttcataaccaagcatctttttttcttatacaattttattaatggagatacaattcacataccataaatctaccattttatttatttttaaaatactttaagtttaaagtttattttatttaatttattttagagatagggtctcactctgtcatggagactagagtgcactggcatgatcatagctcattgcagcctcaaactcctgggcccaagagatcctcctgccccagcctccagaatagatgggactacaagtatgcatcgtgtctggttaatttttttatttcttggcatagacagggtcttctctatgttgcccactctggttttgaactcctggcctcaagcaatccttttgctttggtctcccaaagtgcctggtttattgacatgagccactgtgcctggcctaccattttaaattgtacaatttattgtttttgatatatttacaaagttatgcaactatcactactgtctaattccagaacattttatcacccccaaaacaaaccatgcacctgttcaccaaaaagtgactgaagcaggtatcaatcaatagaagtttatttacccaaagtcgagaaagtaccttggaaaatatacaaatcacaggagcatctgtgatctgggctttttccaaaggagggggtgggggaacttcagtatttgaaggggaaagagcaaataggagggaaaagaaagggagagagggtagcccctgaggtaaatggctaaattctagtgaggctctgtttagcttcagtaaatctacattttacatgtgaaaagaagaactagaggaaaaagtcaattaggcatttgtctcagggtaggcagagggttgataagctggcaattgacattgtcagggttagatttcatagaactgggttttagggctagtatatataggaagggtatgtatcctggaagatttaggtgctcacgaggcaattccttgtgagggaggccatctggggagacatgtgcccttctatagttatgggaaactggcttagagatgaggctatgacacggtgttgctgaattacagctatctgggaacaaaaaggaaggcagcattgtgattccgttcccaagcttaactttgcctttggcatagtaagtttggagtcccaagattctattttctttcacatatccattagcagtcactcctctttccccctccccctaggccctggcaagcacgaatctactttctgtctctatgaatttgcccattttgaatatttcatataaatggaatcatccaatatgtgactttttgcgtctggtttctttcacttatcatcaggatttcatggctcatccatgaaatgtctcagtactttattaccttttatagatgaataatattccattgggtataccaaattttgttatgcacacatcagttgatggaaatttacaattgctttcattttgaggctactatgaataatggtgcatagccagtcatcttgatagagttgtctatactcactttctttttctcctcatttcctatttactcttcagcctactccagtttgatttctgctccagtcacttccctaaaatggctttctctggtgtcaccagtgatggctatacaactaaatcctacccatttttcagtgtatgttgctacctatatctcacagctctaatttgacactgtagtgtagaccatgtcctgtcttcccttgatatgtatgaaagtacactcttctggttttcctcctgtcaccatggctgttgcttctctgtctcttttgcagactcactttttctccttggctagtaaatgtgggatttactcaagactgagtccttgggcaccttttcttttcactcacaagacccattctaggtaatttgacctccacctatgccttcaacaatcatgtatgtgcttttaactacaaatttatgtttataagttagattttggaactgtatacctgtcaaggccagactaatttatttaccctgaatatataaccatcttacatttttttattttcttagaggatgatttccattactcactcagcttgacaaggcacaacatttttaaaaaatctttctgatggataataatcaaatagttaacagctctggacactggctgcctgggttcagatccaaagtctacacatactccccgtgtgaacttggagaagtcacttaacctttctgtgtctgttacctcgtcagtaagatgggtacttttcagggttgatgagatgataacatgaaatgtaaatacgctgaagattttagaatcatgcctggcgtgaactaaatactttaaatgttcaccattttccctctgcctcatctcccatctctaattcttttctttatgtctaaagccagccagacacacagcttcccggtgctttagatataaaggctaaaatgtgtagcctggcctgttgtattagcttcgtagggctgctataccaaaataccacagactgggtggcttcaacaatatcagttaattttctcacagttttggagactagaagtgtgagatcaaggtgttggtggggttggttctttttgagggccatgagggaaggatatgttctaggcttctgtctttggcttgtagaaagccattgttatcttcttgttgtgtcttttcacatcttcttccctctatgtgtgtctctttgtgcaaatttttgttttataataaggacatgagtcagattagattagaggcccaccgtactccagcatgacctcatcttaactaattacatctgtaatgacgttatttccaaataagatcacattctgaggtactaggggttaaagctgcaatatataaatttgagagggatgggacacaattcagcctgtcacgtttggttagtcttctgccagcctctccaggtacatttttactctatgctttctcagcctctcagctagccatccacacagtagccttcttttaaatgggccacaatcttccagcctttccagacctctttctaaaagatatttcttcagctagaacactcttaattccatctcactgccccgccccccaccccccacgacccctcagaacacaggccattttgcatggcttatttctgttcatcattcagatttcaggtcaagatcacttagtgaggaattctctcatcttctaggctggatcaattggattatgaatctatcaaagaatgtaacccctaaagcatttatcttgcttcgtaattgtacatccattacatgtctttttttcaccctgcctatttcaccctgaatgatttgtcttaccctttgatctacagatccttttgagtatataacaggaactcaatcagtatttcttaaatccaaacattacttaagtattgctattttgacaaatcaagatctttactattcactgtaaacagctacttttttcccctcatttttaacacctcatttcctctaataatattgcatgtactttgacatcctttcacttgactgcatccttttgcttgagggaaggtttaagaaaggacgcatttttcatcaggtgttctattcccaacacagaaaagttgactgaatagttcttctttgtttgatatttataatgtcaactgattattatgttcaaggtgatttccaagaataacagacaattagagtcaagccatgtttctgtcccctgaaatcctgaacctatgtgtgttggctaatgtgtgtctttgtatgtacatttttacttactctccaaaaatgtaattgaatgtgaaatttttaactagagccagaattccgtagtaggaatcccaacttctacacttactagctatgcaacctggagtaaactgcctcaggaagtaatagtatttgccctgtagggtgatagtaaaaattaaaggagctaatatttgtgtctggcacggggtatgttaggccattcttgtgttgctataaagaaatacctgaggctgggtaatttataaacaaaagaggtttaattggctcacagttctgcatgctgtacaagcatggcatcaacatcgaagctcaaaatcatggcaagaaggtgaaggaggaagcctgtttatcgcatggtcagagagggaataagagagaaagaagggagaggtcccagactcttttaaacaaccagatctcatgtgaaactaactgaatgagaaagaactcatcaccaagaggatgttgctaaactattcatgagacatctgcccccatgatccaatcatctttcagcaggccccacctccaacactgggaattacatttcaacatgaggtttggagggaatacacatccaaaccatatcgggtagtaagcaccaggtgagtgttatctagtagaaggaggaggagaatacatagaattaacaggactagaagtagtaatatatgtaaagaaatatttcagcacttagaatgacatggtttatccttttatatgcctcacaagaaagaagtctcttttgctcacctttgcatcctcaggacatggcaccatgcctgttagatgctccagaaatatttgttacgtgaatattcattaatttattctttcatttcttaattcatttacaaagagttgctttcattgttttagatttagttgtttatgcttattgtaccagtgcctatttatactacactgcaggtctggaaaaatattacattttaaatttaatttgggtgttgatttggactcactgagcctctgaatacaagcctacttgagacaagtatgtaggatgttcattagttctcaaatacagttgatttatattttataacttgaagtactcctgctttttagcatctatgtgtgaattagcatataaagatatgagtaattgttttaatgaaaatttcacctctgcaccactctactgtgactttattgtgaatgcaattaggtttaccatagcgttctccctgtgagcctgtagataaggcatggaaaaattatttcttttactataatcctcctgcttaaatatgataggaaggcaccaatgaatctaataccattaatgttctctctgaactgaaactccttaaatcataaaatatcacataatgtctttttattaaaatattgacattgtttcaaaatgtgcatttcagagcaagttttatatgcgttcctacaacatatgggcatgttcttcatttggtctttcaattaacatgatgattaagacgaagcgcttatttctgtttctgatgtgttatgtccctaccactagtcacgtttcctataataattcatcacacgttatgaagttttttttttttatgtagtttcttttaagctttcctttaatatatatctgatgatggagacttacatataacagagaagttttcttttggaaacttagcatgactatattttagtttcattagaaagaaagagaattaaaggatggatttttaagaataattcattgtagagttgctatactcaagtactgaagcactttaggactcataagggcatccgtgtcttgcataataaagcagccaagatggagtaaaacgtaaaagcagacatcgaggtcattacctaatctggatggattagccatccagatgcctgaaggtcaaggactgaacaagatatctcaaggtacctacaaattctatgatttcatgttattaggctactgagtataaccagagacaagatggccatgtggttggaaatcatgtagaattacaggttagctcataataaaggcaaaaacaatatgtcggttagaaatttcaagtataagtgaggctaaaagtattttgtgaatggcatcactccatcttttataagataaccctatacatttttctctgtgtacttctattgtaaatgtatagttctattatcacacttgccattttacattattgtcgtgtatttatgtgatgtaaatagttataggtaagtcttatttatctgttctctgtaggacctagcagggtatctggtacagtatgtatcaataatcattagattaatgaactaataaattaaaagtgttataccccattagtaacaaatgacaagtcccaaaatattattttattcaaagtatttgatgccttaatattaactgatttgtacagcccattatacattccaagagggcaagggcagtattaaactgcatccctgaacttaacacgttacctgaaacatagcaggcactcaaaaatactcgaaaaaacaaaccaataatagctttcatttatatagcacttcctatgtgccacacattgttctaggcactttaaatacagtgactcatttactttttacccatattctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcccatattcttaactaatacaaaatatgggctctctacatggtatagatcagctgtactttcagtaaatctgtgacttgatttgaaaatggaaaaaataggattcatctcctaagatgttctgtgaatattatataaggcagtgtttgaagcatgcttggcctagcgtctggcatagcagaagttttcaagatatttttactattaagactattattattgctgctattattaaccatctcctccaatagttggcataagagaggttatacaattcagaagacaagaatagagaaagcgaatgctatttgtgtcatcagctatttgttgtgtttacatttctgcccctcatctctatatcctcgtaagcacactccatcttccaagtattcctaggttaggtggcatttaatggtatgtgtagaccctgaagatttgattacattgaaaacagcaatagctaacacttctttagtgcatctctatgtcagtcactcttttaagtactttatatatattaacataaaaacccaaagaggtaaatgcactattattatccccattttatagaagagaaacttgagatactgagtagttatgagaagttacgtgacctgtccagggtcaataagctggtaagcagagcagctggtaggtgaacccaggcagtctggctacaaagttcctatgccatgttgctcagtacatttaaaacttctgtaccaaaaaaatcataaacaaaattttaaaaacagatggcagagtaggaagttgaatttaatagaaaaatatctatgcaaaatacataaagacttgcagcaaaccaaaagaacaaaccacaagtaattcacagaagaaatacaaatagttaaaaataaccaaacaacctcactagcctttaaagatatgcaaattaaaacaagataattttaccctcacaagcaaaaataaaacagaaagaaaagagagcaaaacaaaaaaggaaagtaaaaataggactttgttagtattacctactcaatgtctgcttggtatctccacagggatatgcaatagttatcataagtttaacacacccagaattgagcatctgattccccttcacacctgctccttttacagacttctctatttcagaaaacgtcagctccattcaactagttgcttaggcaaaaatatttagagccctctttgactcctgtcttcctcacaactcacgtgaacccatgagcaaatcctctcagctccattttcaaaatttatccaaaattctgccgtgtagttcagcacctccactcttgcctctgtcatcctgtggctggatggctgtgtccccctgttacatctccccctgcttcagcccttgccctcctatagtcttccgttcaacagccaatcggccagtcgttcctttatgtctcaagacagatcatcactagtccctggtcagaacacccccagggtctttccatctcactaaaagtaaatatagagtccttattaccgtggtcttggagactctgcagacttaaccccatccccttctttcagccccaactcctgcctctctcatcacattttccagccctcttctcccaggtccttctctccactgcgatgactgccttgatctttcttatagttggtttctcatctgctttttctctctgccgggagtgttctttctcttagagctccatgcagttcacatcactgcctccccgtctcaggtcaccgcctgagtagagctccccctactgactgttcctgaagatagcatcctgtcctcacacccttcactgtccgccattccctgcattattttgcttcatcctacttaatattttatatattaaattgttaatttgtttattctcttcttaccccttaaactccttcattgactataatatctgaaagcagaagtttttttttttctttttctctgtctctcactaatgcattcctagcattagcccttagcatgtagtatcttttaaatgaacaaaagaatattcagcatcagctgggctctgtggctcacgtctgtaatcccagcacttggagaggccaaggtgggacaatcacttgagcccaggagtttgagactagcctaggcaacatagggagaccatgtctctacgaaatacaaataaaaataattagcaggtgtggtggcacgtgccttgtggtcccagctactcgggaggctgaagtgggaggatcgcttgagcctgggaggcagaggtagcagtgagtcatggttgcgtcactgcactccagcctgggtgacagagcgagaccctgtctcaaaaaaaaaaaaaaaaattagcattgtaagtgttgcaaaatgtataggaaagtaaattttcacaactttcttggaggattatttgacactacctatagcaatttatttatttatttttaagtttcaatagtttgagaggtacaggttttttttggttacaaggattagttccatagtggtgaattctgaaattttagtgcacccatcacctgcgcagtgtacgctataatgtagtcttttatccctcacccgcctcccaacgttcccccccagtccccagagtccattatatcactctgtgtgtctttgcatcctcatagcttagctcccacctataagtgagaacatatggtatttggttttccattcctgagttacatcacttagaataatggcctccagctccatccaagttgctgcaaaagacactatttcattcctttttatggctaagtagtattccatggtgtatatataccgcattttctttattcactcgctggcccatgggcacttaagttggttctatatctttgcaattgcgaattgtgctgctataaacatgcacatgcatgtgtctttttcatataatgacttttttttttcctttgggtagacacttttacccctctcttgtttggcttcaagccaacaacttcacagaaatcaatctttctttgtcctcgtatgttccctcaatccctaacaaatgttcgatgaccacttcttgtccaaattcaatggctttattgctgttctatatatttctgaccataaaactccatttagtactgtcaatatcaatatttacttttgggggcaataaattagacagtttattaattgaagcatgatatatgtatacacacacatatacatatatatatatatatatatatatatgcatacctttgaatggatctatttatgtacaaactaccaatggaatttggactcacaacatcggttataaccaaaagaatgtgccatcttggcctgatctacccctcctcttttgatatccttctatgcctattcttattaaaaagaataaaattgttttaaaagaaagacaattccactcattatatcacttaatgtaatccttgtgttggcacttttgcctttcattgatatagtttcaaccataataatatatgtaatgaaagtttcaaacttttcagaactgcctatttttggcggggagaggtaatgtgtactaaaggtaatccatattttatgtaaaaagtaaacacaaagaagtaaaaatcagttgcaatctcatcatctctacacatctcttattagtttgatgtttattatctccttttttccattttttcatctaatggagtctgttttacaagctgattttttatatagtacataatagttaatgttattaacataatagtttgctattatgtatactttcatgctatcattttatggctgaatgaaaatgccatttttaaccttgaaaaaaatcttttacttgttctagcagctttcttagttatgttttctttattgcaaaagtaaatattaatagcatccatccttaatacaaattatacttggtgactcagtcaatttaatatataatccaattttaaattttgttgttgttgaattattagatgtttaatgataaataacaaactaaaatattctaaaatcagccaataatttaagtttgtctttacattctctgcttcatttggctaaaatgaatacatctttaaaatgactagataaaatgatagtcatttgtcaattaatgataacctttgaggcttagtatagaagatatattgacaaatgggaggcatgtgccaaagctttttgcattaattgcatcagtatgataactttagtcactacggttccttcaaaatgtattcacataggccaacaaaccttcagtcattttaaaaaagcagtagcatctaatagtccaaggcaatagcaatccatgcacttctgtgacagagagggtgtttcaagaattttggcaaagactcacacttgaggaccaaggcactaaaggtattctaagctcagagagccaacggccattgcctgcttagctgaaatgaggtgctggtgtggagaatctgccctaggttgtataagccttgcacagcctgcttcaaaagagagaactggaggagatctagaggtgttctgagggatgtggtgttataaagagagtccattttaactctgcctcacccctttgtgggcagagctgttaaatggcctggttgctcctgtttttcctgcctcgtggaaactaaccaccacttaagaagtgcaactaccctgatgtgagaagtctacttgcatggtcatgacagaagataactaaatcacaacatctttgtaaattatcacatcatggcctctaactataggttggtgcaaatgtaattgaggtttttgccattggaagtaatggcaaagtaatatttgcaggcaaattgactcacaaaaggctgggcttctgggacacaggaacaattaaatgaagagggaggaaaaggaaaacatttatatgtatatgcttcacctttttaaaaaacaaccgagaatttgttaacattcatattatacttttaaagcattttaatttttcctattctataatacctgaaggatatggaacaattacacataaacatacagaaaattagtttaaaaaaccatccatgttccttctactcatcattaaccactatgaacttggaatataaccttcaaggcatctttctgttcaatttatgtaaatatgtctgattatacacaggtgattagcacagaggcagcataacatattaatgaagaccaaagctctcaagacctattgttcaggttcaagtctcagcatcctctcccccaccatcccttaccagctgtgtgaccttgattcattttcttaacctccctgtatcttatacatatgggtatgatactggtgtttactaatcatggggttgttatgaggatatttaatcacttagacttaagctttctaaagaacttaaaatgttcctggtacatagtatgcacaaagttagtgtttattaaatagaataattacatttcaaaagaaaaatcaaagaataggataaacagtattttaaaacatgctttcttaagaatgtggaataaacattcctcatcagtaaatacacatctatgctattgatttttaaaagctgcatagaatttcattttgtggataaagcatagttcctgattttcatacatttatgtcattccattttttgtttataatacatttcaacttttattacgggactttccaaacatacaaaggtagatcatacagtataatgaaccttcctgtacccatcacccaggtacaataattaccaacacatggtcattccttgtaatatattttaaatactcattttattccatcgattctgataagactaagataatggtcttaaagtgaagagcttccacatcttaagcaacaatattagggtatttgtgtttacgttagaaagacatgccttactctgtcctcaagataatggcttttatctgatgccaaagttaaaaagatcagttcctttattcaactccagtgaacatccttcattatatcttgtttccttctgatatatctgagaagaaaatggaataatttagaagatgccagtgggataaaacactatattcctaaatatagtgcagttttcagagctattttagccactgtaattgaaatcctcttgttctccactgacatattttggaagcccatatgtttagagtctgaaatttcattccaaaaatgatagaaagcctcttgatctcagaatggagagttactgaactgaattaaaatgggcaaaggcttcagtaaacttgaggaagtaatgtatggccttccacgtggattaatttcactctctatcctgggaagtatggtacccaggtagcccgtgtgaaaaatatcatgttggtgatgtccgtatgctaccatattagagacaaagtcatacgttctgcgatgctattttctaggcggtttgtttctttgcattacagtagtatattcggcaccacacagaagttaaaattataagagggaagtaaccttccttagtgagactacaactgtgaagctataactaatagacactaagatagaaataaattattcttatgatatataacataagcatgagcatgtaatattgttgggagctctagcagaaagtactacagtagtagtagttttttttttttttaagacagggcccggctctgtcactcagcaggctggagtgcagtggcacgatctcagctcactgcaacctctacctcctgggctcaagccatccttccacctcagcctcttgagtagctgggactacaggcacacgccaccatacgtggctgatttttgtattttttagtaaagactgtgttttgccatgttgcccaggctgctcttgaactcctggcctcgagcaatccacccgctttggcttcccaaagtgatagtactgcaggcgtgagccactgcacctggcccagtagtccattaaaaaaaaaaaaaaaaaaaaactcattgagcacctactttgtaacaggtactgttgtaggtgctagggataaaatatacttgtttctcctactggatcttgcttttcttggagaaagaaagaaacacaatgtcttagtccattttctgttactataacaaaataccacagacagggtaatttattttcaaaaaagtttattcagctcatagtctggaggatgggaattttaacagcatagtgctggcatctggtgagagccatcttgctatgtgataatatgtcgaagggtatcacatggtgacagggcaagatctttcttcttcctataaagccaccagtcccatcatgggggctcacccttttgactttatctaatcctaattacctcccaaaatccccgcctccaaatacgatcaacatatgaatttgggaattaagtttccaacacataaagtttggggaacacattcacaccatagcacacaataaacgagcaaaaaatactatattagatcataataagtgacatgaagactgatgcaacaaaataaaggaggtaggaggtaccagaggggaagaatggttattgttatttcagatacagtgttccaggaagaaactggtatctgagtagagagttaaaggaagtgagaaagtgcatgttgaaatcggtgacagaggtaaagacaggtgcaaatgtcctgaggcaggaacatatatcatgggcatattctagataaggctttggcttccttatgcttcctttttagtggggaagacagaacgcaaagcaaatgcaaaataaataatatgcagtcaggttgagattagtgttatggaataaaagaagagagagtaaacaatgggggaaggaacaacattaagtaggataatcaggagacttctctggagagatgacccttaccctcagacctaaatgatacactacaaaataaatgcctgtacaatcactaaaggattaacacaaactgaaggtaaaaaccattgtgtaagcgttttcctgaattcaagaattagattattattctgaagctattttaatattgggaaaatcttgttagcatttttttctgacaaagttcaaataatgatttctgaaatttaattctacctaatactaggtgtactttagaaaaataaccaaaatgagctgcagaagtattttactttattataataaatattacagtatgcatcatgaaatgaaagaaaaataatcctttgcctatagttttattatctccaaatgagtagaaactgaatgatgcatttggcaaagcacataaaacttcacttaagagatgtctgttaatacttgctgagtggaaaataatagctagcatttgtttgaacgcttgatgtgtgccaggtgggacactagggattttacaaacactaatccatttaagactcatacacctctgcaaggtatgtagtactattcttcctcctaggtagcctgagtcagtgtcaaagaggattctgtcttgggtctatgtgatttcaagtactgtgctcctttaaccccactcttaattgtgaaaatctttatcacaggactctgaaacttcctgtgattcactttctccatggtgtccacagtcctttcatgctatatgtaccacaaatagcatgaaaggacttccttttaacctaaagcctttttacaattaacccttgcaatttacgctttttgatttttgtggttagtgtctgttcttgtcaaaattgtgaattagagcaagtttctccttgatgtcatcacacttctttgaagtcatcaagcatttagttctcattaggcagaacaggccctggcgactcaaagtgtgagcaggagccagcagcatcagcagcatccccaaatctgctcaacaagagtattaacaagatccccatggaatctgtaggcacattaaagtttgagaagcgcagcgttaggccagcatcagcaacacttgggaccttgctaaaaatgcattatttgtacccgaagctccaggaatgtggcccaagaatctttgttttaacaagccctgcaggtgattctaatgcatgctcctagagagttactctttctcgggattgacatcagcaataccgacctgttgcaataaatcagtcattctcaagtctgtctgcatatgagaatgccctggaaagcttgtagatcccaggttccattccaatatagttggtctcaactatattccaatctgcaggatgggaccatggcattagtgtgttgttcgtttgtgtttgtttgttttcctgtgggctcctcagtgttaaaaatcattgccatagaattagaagatcagtattttaccactctcaagggatttactttttaggagaaattcgaatctccccaaaatagtgcccaaaggactaatctaaacacctgagttaccttcactgactatataactgccacttctgcccttcagcatgacactatgtctctttcctcattgaaaaatacataaaaggggaaattgtaacctctctattcccattggactattgttgagatgaacaaatgagtgtgagagtaggcacttgagaattctcaagtgctatacaaaaaaaaaaaaaaaaaaaaaaaaagctcgtggtctatctgagggtgggatgcagctctgctctgatgtgtaattatggataagtgatcagaagttcagaagttctcagacatcacagggactgcagctttttatttgtttgtggtgtcagctgaaaaagtgctaatgagatacactggggacagcctatggaaaataatctcatgaaatttttagaaaaagggagtatctatgatgatagttctgaaactccaaagctgtgctcctcagactttaatgtacacatgaaactcttggggatcttgttaaacaatactgaatcacaacaacaaattgtgattcagtaagtctagggtgagggctgacagtctgcctttccaacaagctcccaggtgatggcaacaatgctgattcgtagaccacacttttgagtagcgaggggctaaaacatacacaataattaggcctgttattttgcagatgccagtgtgattaatgaatcctgcctatgataacattcacgagtctgccctgaacatttttctgttcttttaaccctgattgcctttgccctgtagctcacatatgatctgtacctcctctttcttgcttacatataatagagcatattttatatatactcatatccagttataattctctaactatgagcaattgttttgttgagttttgttgtcagtgttcatatcataaattgcctcccccaaccttctttcatctctacaattcctttcactcttctttttgaactggcctgtgagtgtgctgttcttgccagattaaatgaatcagtcaatgggaatcttattcttaagtgtattggatcagatatgtacaagtgttgctcatgaggagagaaaagaagatgggcgtgcatgctattgattaatgtagtcacagaaatgcactggtcaatatgatacaagctgtttgcaaccgtaatagtcctgtgctgaggactattaaaaaactgaattggttaccactataaccactacagttatgcttttatttgggtaaaaataatctagcatgttgtggtttagcaacagaatgctgaagaacaccccgatgtgatgtttgaaggagaaaatccaatctattcagcctaatggtttgctacagtagttgaaaaaggcataaaaaatccaatctcctgggtagatgtagctcattgagtggggcatgggctggatttccatacccatcattccttggctagttctcttctgcaggacgtgaccttcacatctcatactgagtattgtgtaatcatcttctggtatctttcttctcttatgtccctttactcattattctttgttccccttttcatctttagtcttcctaagggcttctcagtttttttcacaggggtatatagatcagaaccaagtcctttcctaagcctgtgtctttatttcacaattcaacaaggaaggacactacagatcacatagctcacctccatacatcagagtataggccttactgatacatgcacacatagaaacaacagaagctggcggagcatggtggctcacgcctgtaatcccagcactttgggaggctgaggcgggcggatcatgaggtcaggagatcaagaccatcctggcgaacatggtgaaaccccgtctctactaaaaatacaaaaattagccgggtgtgggggcgtgcgcctgtagtcccagctactcgggaggctgaggcaggagaatcacttgaacccaggaggcagaggttgcagtgagctgagatcatgctactgcactccagtctggtgacagagcaagactccatctcaacaacaacaacaacaaaaaaacagaagccaataaataaattctgcagatctattgtgcagcatggtgactatagttaataataatgtgttgtgtattggaaaattgacaagacagatcttaaatgttctcaccacaaacataactatgagaggtggtgcatatgtaactatgagaggtggtgcatatataactatgagaggtggtgcacatataactatgagaggtggtgcatatataactatgagaggtggtgcatatataactatgagaggtggtgcacatataactatgagaggtggtgcatatataattggcttgattgtggtcattatttcacaatgcatactgttaacaaaagatcatgaaatttgcaggggcaaaaaggagagctttactttcctaaagaaatttgtaggtgggggagacgcccctttgggacagagcaaaagtgtgctccaaggagacactggagagttaaagattataatggcaaaaactgcaagactggggagagggatcagagtcttgattagatgacatttaagcctaaaaccacaaatctctctttgttttctgactctaggtggtcagtggttggtcacatgaggattttccagctgtagtctattttgagattgataacaggaactggtttagcttgattgcagaaaggggagtctcgtgacatttctgcaacattttttgagaacacagtgtatgtgactacctcctcatcttgctgtggcctcccagttctgctttaacttgagcatctcagccacagggggtttattttatctatatgttggggcataatttgacaatacatacttcaaaacattacattgtacactgtacattatacaatttttgtccattacattttggtaaagctggagataagaagaaaggcaagggggtaaaaggagaaacggaatacaagacaagtattaatgaatattttactacatgtaatgtttggttaattataagatgctaagctaaacaaaaaatgattttaaaaatgtcatacacaaaaattattaaaagttttattagatttccattaattcatctttaatgattttacagaatgacaaatgtgatgttttcttcattttaacccagtgtacaagtaatacattttttcttcaaagagtagtttcttataaaaatgtatagttttgttttaattagtaatccaccgaattacatcattataatgttctttataaggggatttattttctattatttaaatttcctctgataaatttttattgtgatatctgccaccaacatcttatagttaaaatagtatgcaaactaatggtcgtgcagatagttactagtataggcttaatactatgcaatacaaggagatgctttcattaggccaatggtttcttatataaaaattacttctttaaaggtctgtacagctagcagaatggcatttgaggggatttaggtctcagcctaattattacctttttagagctaacttctgtgaccaacacagttaaagaagttcaaagatcaccttatttaattttctacataggacttattaatctctgataccatgtggtggtttcatccttgtttaacagtttttctgactctcaatttcaagagggtaggacacttctcattttattattgtatctttaatgtctgtgacaattccaggcagcatggtacataggaactctataaaaattattgaataaatgcatgaatacatggtcaatatattaaaataaaattaaaatttaaaaaaaaagccataaaaaggtaatttgagactgggcacggggcagtggctcacacctgtaatcccagcactttgggaggccgaggtgggcggatcacttgaggccaggagttcaagaccagcccaggcaacatggcaaaaccccgtgtctacaaaaaaatacaaaaattagtcatgtgtggtgacacatgccagtaatcccagctacatgggtggctgatacaggagaatcccttgaactggggaggcagaggttacagtgagccgagattgtgccactgcactccaacctgggtgacagagggagaccgtctcaaaaacaaaaacaaaaaaagataatttgacaaaaatggaagtcgctcaccaaatactttgaataatgtacctactgtgattttgtatttcaagctacaaaataggaaagacattgttcttccttatttttgtttcttttctaacctttttcttttattattctataatatattggcatttcctttagcaaagggagttgtttggccttgcatccttcatacaaatagcaaatatttacacatacacacactcatcgctatgtaagtcccttgaagttcaagtacacagttactcatctgaggtatgtgtgtgtgtgtgtgtgtatatatatatattctgagtgtgtattttgcagctctagttttttataaatgtgtttctcacccctcgtagtcatttgtatgcacttaatgtaattgtcagaagttataaataaatatgtggttgttgtattttcatcattaggttgtaaattccttgtgggcaacaagcatcatataatgaagaaattaaagaaatcagaaccattacattgaaaacatgatgctttcaaatacacttttgaatgttcacctcagtgttctaattaaattctaatttcggtatacatatctccttatctgaatgcctttagcaatttgaagtgactgagtattctgattcatcccatattcaatggaagcatatcaaaattgtctgccatttaactgtgctatcacaagctataaataggacactactctctgccaaaggtgaattaattgtgataaagctatcttgataaaacttattcctcacttaagtgaaacatgcagtacctgattaatttctgcaacagctgtgttaaaagctctgcacttaatatcaaacttctacttcagtatatgtcaccatttttacagaaacagaaagtcccttgcatttgattagcctcaaattatggctcattgatgaatgcaaataatcaaacaaaaaaggactaattgtatagaacaagtaaatattatacatacagtgctcatttgcctacaattacacaggtaatgtctctatttagtttcttaatttctcattatgagacaattgcatctcatctagcagtatttaattgcattgtttctattgctagaataatagcatattcctttttttaagatgttgaatgacaaataaatttagattgtaatcacttattgttccttctctaagcaaaatcgcccaggcgtttcagttgcaatgaaaagttttattttctactaatgatggccaaaatgggagcattctagataagtctgtatcctgtctatcaccttcttcttcagttgtggtcataaccatgatcttaataagtctacttgactaataactttactattttctaaaggtgtcactataaaatcttacaatatttaacctcacataccaaacccctacaataatctttgtttctatttgtaactttacgtgtctgcattggtaaatgtcaggtacatttggaatgacaaacatgcagttacactgagtctagtttgtagtttcttatcctaattctcattctgaccttaacatcaaatcctctactatgagacagcagtattaaataaaactatcacctagcttctgagttatcttgtaagcataagtgaaatcttattcacaaccgtaagtgaagtcttgtaaccgtaagtgaagtcttatttacatgtttacatgtgttttttatgcttcgtgtattttctaaatgattcacttgctcttagccttttgcaaaaagtataattttttattgctgccgtaataaatacaacaaacagtggcttaaactacacaaatttattatcctatagttccataggtcagaaacctggcacaggtctcacttggctaaaatcaaggtatcagtagggcctcatttatttctggaggctctaggaaagaatctatttctttatctttgtcagcttccagaagtttctcacattccttggctcatggtcccttctgctatctttaaaggcagcagttatcagttgagtccttcttacgtggcatcactctgactcttctttcattgtcccttttctccctaactgcagctagaaaagattattcatctttaaagactcatgtgatcagtttgggaccatctgtataattcaggataacctccccactttaaagtctatagccttaatcacattttcaaagtccctttgccatgtacaaggaaatattcatatattttagtgatgaggatgtgggcatctacagggggccattattctgcctactacatatggtctcttattatttagcatgtctagtgcagttgtgtggggatgctggacttcttaacatgtgacattagttaggcttatgaagtcaagcattatagacattgcctgttaatgttgaagcaagcttgaacagagccacgcttcatctctagccttggtttgcttgtttttcctttcatttattattatttttcagtgaaaattgataatagagctgccttttctttttgcactggcattattgcattgcactactgaagaaatcactaaatctgtttattttacagaaaaagattgagggtccagttaaatttgtgtttattcaggacaatgagctctgtttttctcacttgggaattctccctcttgagacagatttcccaggtacgaccaagagttaagagatcaaagttttgtctggtgagaacagaacccaaatctctaggcaactcttgttaactaattttggggataccacagatacagattggagaacttttagaaattcatatcaagtttgatttatttaatattcatatttaatatgttacatgaatgtataatccaatgtaaatacgatttatttattatggaattgtttaatacatgacatgcttatagttataccgttaaggaatatctcttattttgcaacattttacttttttcctctcccaagtgctttgtgaatttcactaaataaatcagggtaaaatgcatgtagtttagtctaaaaatacttaataatccacccagagggaaaatatattttaatgcttgctgcataaccttaataaacagagaatactaatgtgcacttataggttaaagtaatatgtttaaaaatcatttcaacttttattttagagtcaggggatacatgtgcaggtttgttacatgggtatattgcataatgctgaggtttggggtgtgaatgatcccgtcacccaagtagcgagcatagtacccactaggtagtttttcagcccttgtccccttcccccactccccacactagaagtccctagtgtcttctttgtccatctttatgtccttgcgaattcaatgcttagtatcatttttttgaaacagagtctcgctctgttgcccaggctggagtgcagtggcacaatctcagctcacggcaacctctgcctcccaggttcaagtgactcctctgcctcagcctcccgagtagctgggactacaggcacgcaccatcaggcccggctactttttgtatttttttttttttagtggagacggggtttcaccatattggtcaggctcgtctcaaacccctgacctcatgatcttcccgctttggcctcccaaagtgctgggattacaggcgtaagccaccgcgtccggctgcttagtatcatttataagtgagaacatgcaacatttgatttttttgttcatgcattagtttgcctctagttgcatctatgttgctgtaaaggatatgatttaattcttttttatggatgtataatattccatgatgtatgtgtaccacattttctttatccagtccactgttgatgggcacctgggttgattctatgtctttgctattatgaatagcaagatgctggacatttccttaggttttagatggtttcttttgaaatgtatattgttaggtttaatcagtcctttgtatatagttgccttttgtgagaaatacagtaccaggtagcttgatataccattaaaattaagcatatagatttacctgctgtctctaatgccgttatgtgtgacaattcccatatgaggtaaatttaatgagttcgtttcttttaatatctagactaactaatgccttcaggaaagtatgaaagtatattgtgtctctttagtgaattccctttagataggcttaagatagccatatggctctaaacttactaaatgcagaaaatttaacttagctttacttctttcattcttaggaaaacagtcttcattttgttgattaacttccatttaaatgcttattttatactgtctttatttggactatgcttcattaagcctcaatttccatttaattttgcttgtgtcttattgttcgagttcctatgtctcagttcactaatgaaatgttttctaacctgtgaaaattcagaagagcacaaagatccatataaaagtacatttccagtttctaaaagaaaaattaaggtctactgggactctggtacactgcaaaacataaacactattcttactccaaattatagtcattgaggtctttcaattcccagctcccatatgttaaatctacctatctgataatgatattagttgcaaatgctttattgcttccctttgtatcctgtttcagtagctgttccttgtaaccttatcttgacattttcaaattcggtttgaaaatacaactagagtttaccattatttatggaaggtaaatgttaactgacattatatttacatttaggatgaaataggtgaatgctcaggtacaaataaaactaagtttatttatttctctgcttaattcaaaaggtgtataggttcaggtcatagcatagtttagggcaaagaaagtagaaatgagaacacagaacgcaggaatttgtcagttttgtgcatctatctcgtaatctaatctcagctaatgggactttacatttaatcacctttccagaccaagtctccagacccagctgaagttgctgttcatccatgcccaaatctcttttgctgacctcctaatcaagattctagtgtgttagcgataaggtgtggcaggcaataacccagtgatcactattgcttgtttcccccgacagttgtgccctgtttacacacttgagtttctctccttagttctgatttagagccctcggccaggttctcgaaatcactagtgatcttgaattcaaccacatggcttgcattctagcccttgtgcccaaacaacatgatcgaatcatttcaattgaaatacatactatcgctattgcactcagtctccatccctactgtctctgtctctgtccctgtctctgtcttcctctctctctctctctctgtctgtctgtctctccccttgaacaacctggtccttaattccaggcctattctctacaataagttcagacatttttctgcagtccctaagtaggcaaatctgaagacctcctagaacatccagcaagctttgcagttatatcatactgcagctatgaccatgcataacctttatttgacttttatttgaaaccatattttaatatactgtatttattatagagaagtttcttacattcaatgtttctaaatttacctttcacctatatatggtagctccctacatatagaatattaaaatttactgaagtaaaaatgtatttttttctcttttaaagccaccataatttgatacaattaaattatacggtgatatagtttgcatatttatccccatccaaatctcatgttgagttgtaatctccaatgctggaggtgggacctaatgggaggtgtttggatcgtggagacagatccctcatggcttggtgttgtctttgcatcagtgaatgagatctcacaagatccagtcacttaaaagtgtatggcatctccctccacactctttcttattccttttttttttttttttttttgccatgtgatgtacctgctcccccttcaccttctgccatgattgtaaacttccagaagcctccccagaaggtgagcagatgccagcaccacgctccctgtaaagtctgcagaaccatgagccaattaaatccgttttcagtataaattacccagtctccagtatttgtttattaaaatgcaagaatggcctcatacctgtggtttaactgagcacttaattcctttattattttagtgcagatgtctccatttttttcctttgttcatgaaacttttattgggaaaatgctaaatgagagttttactactatgaccacggagagtaggatgcacttgtgcaaagtctgggacctccagaagcttgcaatttaatcagtgaaacagactggacataaacaactctcttaacttctcagtgattggaaatgcaaacagtattctatttaaaaatgccatctggctttcataaggtttggaaaatacttactacttttaaacagcaaatcctccaatatttgaggtttgcaatgctaagcccatagggcatgaggcaacataaccctgatatgagtaattttgatgaattctccatatttagaagtaaattgtgtatcttgataataaattttataatttcattattgagtttcttcatacattttggaaaaaccccacggccctctgatttatttatagctgatttgtcagttagatgtaaaatttcctgcatgttgatcacataacttgcttttcctgtttgatttttttgtcctctataatttttttcagctcctaggtttatagatatttttaatgtagcccatattataataattcaacaattttcaacatctttaaactatgatttaagtatattttgctcattaagaattgctacctcctaaatttaataagaagattgaaagaagaatagctgttgacagtaattaataatattcttccatgtaggagctacatggcaattaattatttttcaggaaattcttttcacttttttgttaagaatatttcattatattatttttcagcactgtcagttttctaacattcatgtagctgttaatttattcataacttgaattcattttcagtgtcattcatgcagctttggctttttttcagcttgcttatattattttgtatatgaaaaatggataactttttgactaatttccttccacattaaaactgtgtagcattcttttctggttctggagaaaatataataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaatgtgatttctgtaaaggctcctgccatttactttgcctgttacattgtctggcatttgcttcatttctatttcatttcttttcattgccctcttcattgtctcttactctcctttcttgtttttgcctcttaatctttattgatttttttctttatttgattccttacgcttagtcctcttcttctgtcattcttaatgaattcattcattttctattgtttcaattgttttctttttttttgttttttaaattgtggttttttcttttttaaaaaaaattttctctttagttttcatcatttaaaaattagcacagatagaatattccttagattaggtgcacacaaatattgaatatgtcattaaataacccgttattttatattatttgtactgattaacaccataccattctgtcccataaattcagaataaacatattgttttttgtatgttgtatgtcgtgtatgtataaagccatcttataagtttcactctgcatatgcctaggttacatattttggcattaagaatatcattaaaagccaactgtttttgagaaaacttttaatgttgggatgtaaaaaataaaccttattgaattcatcataattaaacagatgaatagcagcaataaattcagatcctgaataagaatcaaaccacaaaggttctttgttgactgaaacacaaaaatatgtgtgcattaattttattcttttgtaaagtgttactctaaataaaattactggagataatatcttgggtctcaacaatatcatgctttgcaaagtatttgtcactgctaattgaattttgtgtgtgaatataatgcatatctatacaaatagaacagcctctaattgaatctgggaggatttgaatattgtttgagtgttggccagtctactgacagatttaatcaagaaatggatatttatataaaagaattgtgcttaggagtaataacccatttagtcacagattcagtgttaacggattgaaaggtttgtggtatactctggctctatgagttttaatgaggcttcgtttcctcactttttttttcttttattcaggaagtgttaatgtagcatgcatttcagccttatgattttgtcaaatataatgtttatgttttattcattttggatcccctcctagaactgttattcacatatttgctactacacacatatcagatgagattcattgcagaacacacaactttaggctatatgtcaaatacgaatataaaatacaaatacataggtcagttcatttgtcattcacatttaaaagtggaaggtttaatataatcaattctctaatcccggtacaactgttcccccaaatctgttgaacccagccctctttctgtttgcttcctcaaagtaatgtaatggattttaaaacctatggtaaataaaccagtagaaattgaacttgtctattgaattataatctttgctgtttatttccttctaaacaagtttttattgatatataatatctgtacatattttgggggcatatgtgataatttaatatattcatataatttgtaaagatcaaatcagtgtaattgagatacagtcaccttaaatatttgatctttctttatgctagaaacattagaattcttcttttttctttttctttttcttttttttttgagatggagtctcactctcttgcccagacctggagtgcagtggcacgatcttggctcactgcaacctctgcctcctgggtccaagcaattctccctgcctcagcctcctgagtagctgggattacaggtgcatgccaccacacctggctaattttttttgtatttttagtagagacagggtttcaccatgttggccaggctggtctcaaacacctgatctcaggtgatcctcccatctcggcctcccaaagtgttgggattacaggcgtgagccatcgtgcccagccagaattattcttttgtagttattttgaaatatacaatagattattgttaactatagtcaccctactgatttatcaaacactaagtcttatttcttttatcaaactgtgtgtttgtacccattactcaacttatctttatcccctctttcccttacccctcctggcctcaggtaactgccaatctactctgtatctttatgagatctactttttcagctcccacatatgaatgagaatatgtgatatttatctttctgtgcctggttaatttcacttactaatgacctccatgttcatccatgctgctgaaaatgatttaattattttttatggcggaataatattatataatatgtacacacaatacatggctgaataatatttcattatattatgtatatgtatatatgtcacattttatttatccattcatctattgatgggtacctacactgattccatatttgggctgttttgaatagtgctgcaataaacatggaagtgtagatctctctttgatatatttgtcttttttcttttggatatatacccagtagtgggattgctagataatatggtagctctatttttagttttttttgagaaccctccatacagttttccataatggctatgctaacttacattcccaccttcctctacatccttgccagtgtttgttagtccctgtcattttttaaagaccattttaacatgggtgaaatgatatctcattgttgttttggtttgcatttatttgatgaataatgatattgaaaatttttcatatatctgttggccatttgtatgtcttcttgtgaggaatgtctattctgatcttttgctcatttcttaatcagattatttgtttttttgcggttgaattgtttaaactcctcatgtattctgactattaatcccttgtcagatgggtagtttgcacatattttctcccattctatgtgttgtctctttactttgttgattgttttctttgctgtgcagagctttttaggcggaggtaatcccatttgtctacttttgctacttttgctttggttgcctgggcttttgaggtctcacacaaaaaattctttgcccagagctatgtcctggagcatttccccaatgatttttttttctagtagttttatagctttaggtcttagatttaagtttttaatccattttgatttgatgtttgtgtatggtgagagttagaaatcttttttcattcttctggatgtgattggttatccggttttcccagcgctatttattgaagagactctcctttccccattggatgttcttgttgcgtttgtcaaaaatgagttgtctttaaatgtgtggattaatgcctgtgttctctattttgtaccattgatctgtgtctatctttatgtcagcaccatgctgatttggttactatgtctttgtagtatattttgaagtcaggtaatgtgatgcgtacacctttgttcattttgctcaggattgctttgcttatttgagtttttttttttttttttgtagttccatgtgaattttaagtttttttctatttctgtgaagaatgtgattgatattttgatagggattacattgaatctgtaaatagctttgagtagcattgtcattttaacaatattaacaatattaattcttccaatcaatgagcatgaaaaatctttcattttttatgctttttcaatttatttcgtcagggttttatagttctctttgtgtagaactttcactcctttggctaaattgattcctagatattttatattctttgtagctattataaatgagatttctttcttgatttctttttgagattgcttgctgttggtgtatataaatgctattcatatttatttggtttttttgtatcctgcaaatttactgaatttaccaattctaacagttttttggtgaactctagttttttctaagtataagatcatattgcttgcaaaaaggctaatttgatatcttcctttccaattttgatgcctcttatttctttctcttgcctagttgctctgtctaggacttccattattatatcgaataaaggtagtgaaagtgcgcatccttgtcttgttacagatcttagagaaaatttcaattttttctcacttagtacaatattagctgtgggtttagcatatatgcattttattattttgaggaatgttccttctatacccagtttgatgagaatcttttttatcataaagatatgttggattttatctaatactttttcagtatctattgaaatgatcatgtggtttttgttctcatgtccttgtatcgtatttattgatttgtatatgttgaatcatccttgcatcccaaggatgaatcacacttgatcatggtgaatgatcttttaaatatgttgttgaatttgatttgctagtgctttcttaatgatttttgcatctgttttcatcagcgatattggcctatagttttctttttttgttgtgtccttgtcttgtttttgtattcaggtcttacagaatgagtttggaagtattttctttttgtcaatttttttgaagaatgtaaatagaattagtattggttcttcttcaaatgtttggtagaattcagcagtaaagccattgggtcctgggctattccttggtgggagacatttgattatggctttgatctcattaccagtttcttcacattttctatttcttcatagttcaatattcataggttttatgtgtcccagaatttatccatttcttctaagttttccaatttcttggcatatggttgttcataatagtctctaatgattctttgtatttttgtggtctcaattgttatgttttctttttggttcctgattttatttatttgggccttctgtctttttttcttagtctagctaaaggtttgtcaattttgtttcttttcaaaaagccaactttttgttttgtcgatcttctgtacttttttgccttatgtcctaccattaccagagggtctcctatattccagggttttgtttgtttgtttgtttgtttcaatttcgtttgtttctgcttagatctttattatttctttccttctactaattttgtttttggtttgttattgcttttctagttccgtgaggtgcattgttaagttgtttatttgaagtctttctacttttttgatataggcacttattactatgaactttgctagtagtactgcttttgctgtgtcgcatagattttggtgttgtatttctattttcaatcatttcaagaaagttttcagttgcccttttaatttctttattcattcattgatcattccagagcatgttgctaaattatttttatttttatttttattttattatttgagacagggtttcactctgtcacccaagctggagtgcagtggcacaattacagctcactctagccctgacatcctgggctcaagcaatcctctcacctcagcctcccaagtagctgggactagtggcatgtgccagcatgcccaaccaatttttaaaaatttttgtagagacttatatttcccatcttgcccaggctgctcttgaactcctgggctcaagcagtcttcctgcctcagcctctcaaagtgctaggataataagcaggagccaccaagcccagcctgaatcctttttttttttttttggtatagagtcttgctctgtcaagtgcagacttgacagagtgcagtggcgtgatctcgactcactgcaacctctgcctcctgggttcaagtgattctcctgcctcagtctcctgagttgctgggattacaggcaccccgagcctgaatttttacgtgcttgtgtagtttccaaggttcttcttgttattgatttctagttttattccattgttgtcagaaaatatactgatgtgatttctacttttctgaatttgttgaggcttgttttgtggcctaagagatggtctaccctggctactgtttcatgcactgataataaagaatgtgtacttggtaacagttgggtgaaataatttttcaattctagatagccctatttggtttagtgtgtagtttaactgtgatatttctttgtcgattttctgtctggatgatctgtccattacttatattgaagtgttgaatcccatacttttgttttattgcagtccatctctccttttaaatctattaatgtttgttttatatacttgggagctctggtgttgggtaaataggtatttataattgttccattctcttgctgaacagaaccctttatcatgatgtagtgaccttcttagtctctttttacagtcttttattttcagtctactttatttgatgtaattatagctactgctactcttttttgtttaccagttgcatggaatatcttttcccaacacttcaatttcagtctatgtgtatctttataaatgaagtggaattcttgaaggcagcatatgggtaggacttgtttctttatccattcagcagctttatgccttttaattggataatttagtccatttacgttcaatgttattattgataagtaaggacttactactgccattttgttgcttgtgttctggttgttttagaactcctctctgttcctttcctattgtcttcctttatggttaagtgatttttctctggtagtatgttttaatttgttgctttttcttttcggtgaatgtattattggtttttgctttatagttactatgaggcttatgaaacataattataacattcttttgaagagacgacaacttatcttagataaaaaagaaaagaatagaaacaaataatgaaaatataaaaataaactctacattttagctacatccccccacagtttgactctgttttctcaatttacatagatttatattgcctatctcttaacagcttgctgtaggtattattattatgaaagatttgtcttttgggcttcatactacagttatgtatggtttacacaccaaaattacagtattagagtattctggatttgtttttgtacttaattttaccagtgggttttacaccttcaaatattttctttttgcatgttagttttttttcagatcgaagaactctcttttgcatttcttattaaacagatcgggtcatggttaattctctcaacttttgtttttctgggaaaaacattatttctcattcatacttgatggacagttttgccagataaagtgtttttgaatggcagttttttttttctttcagctctttgaaaaatgtcatcccaccccttcctgtccttattgagaagtctgttgcttatgaacttggaactcctttatgtgttatttgcttcttttctcttgctgcttttaggatctggtatttgtctttgacttttgagagtttgttgattatacaactttgagtaatcttatttgggtcgaatgtattttgtgttctctggccttctcatatgtggatatttgtctcttctcatattttagaaagttttctgttattatttctttgaataagctttctaccccttgaccgactccctcttgaacacaaatagtttttagatttggtctttttaagtaattttctatattttgtgggtgagctatgcttctttttattatgttttctcctctggttattttcaaatactctgtcttcaagctcactgattctttcctctacttgattcattctgctcttgagagcttctcatgaatttttcagtccagcagatatatttctcagtgccagtatttttgtttgatttttaaaattatttctctttgctcaatttttctaataagtttctgaattcactagaaatttttctgtgttatcttggaaatcagtgaatttccttacaactaccattgtgtattcttgttcagagagttcacatatcaccatctcattaaggtcggttactggttccttgcattgtccatttgaggaggtcatagttccctatttgttgtttcttgtggatgtatatctatgtttttggatttaaggatcagttatttattccagtgttccttgttttaatttttattggatgtgtttgcttaaagattcttttaatttacctgttgatttgattttctcttcttcttcttctccttctccttctcctcctcctcctcctcctcctcctccttctcattcttcttcttctttgtgcgtgcgtgcatgtatgctacttccttttcagcaccaggtggttccttaagcacaggtttgctttggttctagtaaaccatcagagtgcttcctgtcctgaatgagggaggtatccaaggggatattgcagtactatgggaaggctatcttgggtttcatgcccagggacctgtggaacaaacttcctacagtatagtactgctgaatggccacctaatttgttgtcttttttttttttgctgagttacagagtagtttccagggctgagaatggtagtctcacctcccctttgtatctctggctgtcctcggggatatttctgtcttcaggtactcctgatgtttccagtgggctgaggcagagacagttctgcccagaaacccaagatggtggggaaagtcattgctcacctcaatctcactttcactagtttggaaaccatgagttgtggggacatttttttttgcatacttggtgccaggtagattagaggagagggagtgtcatggatgtgaaagactgattctcttattctctgtcagagtttcttcacttctctatggccctaagaactgtctcatcctcatatttgagttctgggatattgctggtaataatctcagtgttgtgcatttgtttttggttttctgttgaggggaggaagtaaagccagcttagctctgcatcaccattatgaaaccagaagtctgtgcttatttattattattattttatattttattttttctttctttctttcttttttccttccttccttccttctttccttcctttctttctctctccttccttccttccttcctctctctctctccttccttcatttctcccttctcttccctccccttctctcccctcccttccctccccttcccttccctttccctcccctccccttcccttcccttcccttccttcatcttgctctgtttcccaggctggaatgcagtggctcaatcatggctcactgcacccttgacctcccgggctcaggcagtcctcccatctcagtctcccaagtatcagggactaaaatcgtctctacaattaaaaaaaatgtagagacatagccttgctatgttgcctaggctggatgtgcatctttattcttaaaaaaacaacttacggaaggactcaaaacatatgataccctcaaaagcttccattttagatagtacctatagtgtgttcaagaagctagctaacattctgttgttttctttactgacaaatttaagccaaagtttctaaatatggcattttacatgaggaataagtaggatttagctgtgcctattccagtattgataatacttataatctttaaaaaatagagaaaagtctattgaaaattgtaatagctgggattttcatttactttttttttggacttagcttttgtggtagaaaccacatgacaattagtctgcacaaaatcactgtaaactctatagtatgtacttggagagaacttgtttccttagaaatgctataagatttagggactttaagaaacattttcccacatgacagataacaattttggtggcaaatcttcattgtgaaatcaatctcctccttctactgttttttttaatacttaaaaacattatctggatttatatctctgtcctatagaaagtatgtcaagtgtacctgtggttgtcactcattaatgcacataagaaacacatgaaataagtggattcctgatcccagctcaaatacacttaataagagtatccgactttaggaagcaggatttttccagtttgtggatctgagtctcatgtgaactgttaggtaagaataattgtgatgtatgcaatttgtggacttaactgttcccaaaaagaagggtgtctgtctgaaaggctagcttaaattcaatggttactgaatgaaaataattatttttgtaagatattttctaaaatgtgattggtttatatttgacaactatataaaacaggatttctgaggctaaaattgaattgcatatttggttccaagcctcctaatacccaaagaaaaaaaacaatgaatattatgtgctttacattgtctatataaatttttgaagacatccaggatcatttacaatttctccaagaatattgagccttcataaacttgaaggattgaaacattagaggtgagtcagccctcactaatcccttaagatcaaccagtatgatatggaataagtctttatgtgagaaaaaataaaaataaaaatagaattgatggaggactagagattttgatgctgtaactccttggcagtgtcctacaggtttctaggtacagtcttgcctttctttgattgctaaatgatatttatgtgttattagtcttaccacttttttatatggagaagtcaaaaattagtactctacaaattctaagagtaacttataattctttaaattctttaacatttttgttctgttacaataacatttactaagtacttgcaataccactttatgccagtcacttggttcatatcctcataaaaatgttatagggcagaatatcagtcagagttctaccagggaaacagaacttgtagaagctatatattaagagatttattgcaaggaattgtaccacacagtgatggtggctgataagacaagttcaaaatctgtacggcaggctgtcagaaaatgtagtctggaattctcaggtacaaactgaagctgcagtctacagatggaatttcttcttcagaaaagcctcagctctgctcttaagcccttttactagattgaatcaggcccacccagattatccaggctaatcttccttacttaaactgattatggactttaatctggtctacaaatattttctcagcagcacctagattagtgtttggttgaattaatgggattgtagcctagccacattggcatgtaaaactgaccatcacaggtatgaacttttattgttctaattttacaaaatcaggaaactgactttgaaaaagttaaagtaaattgctacaattgagaaatgatggaacattgaacctaagtttgtccaaacccagaacccatattataaaacccagatggaaagttggcatttgactactaaactattaaagaaatgaatgctgtgtgtgctctggtgcacacacatgcacacacacgcatgcgcccacacgcacacacacacacaccactaccactgccatacagctattcaggaaaaaattataaagggatatttagtacatttgaatgcatgtattaatattgcggagattgaccagcgttttcattaattccgctaggttaattttccttttggaagccatgaaaaatgatctgttcgttataaattagagtaatcttggaagtaatttgacagtcaatcatcatttaataaaattgaaataaaatgtcaagagtaaactgtaaaagacaatgggatcactcatagtaattactgtcagtttaaactgaggaaaacagaatctgatttttaccgttatcagaatgaggtagttagtaatgaaccacaaatgtgaatctgtaaagtattgcatttaatttgttggatttctgcatattggcttaatggatgagtggcataaatttgtaaaaacagttactctcaaacacattatacaatagcacctaaggaaatatttattattctgagattactgattgaatttgtgatacattttattctgctgtgtatgttcagagatagctgtaaagtatgtatctactttgaaaaacaggaaagcctagatggaggacattggctgtcaacagagtgctagaataagcagaaagaaaaataaagcggaaacagaggtacaaacactaaaaaattctttgaaaggtggcatttgttctagagtttcacattttccaatgacacattattttaacttgtccatgaagttgaaatcatttgtgcaagccttgtttcataatttcactattttacttttgttcaaatatcaaaatatttcccaattagaccatacatatacttgcatagcctccctcctttcattatcttctttgtaaaaccaaccatttataatgagcaagacaatatcctcccttgaaaatgttcactttccttatactgtgtctctactcagcatgtgacattgcccatagactgcaaaaaccattctatctcttctagatcacaaactaccatgccatccttaggtcttactaccctccaatacaaacactttcttctagtcatacggggcctttcattcccaccatacttatcctacatatttccagaccaaccaacacctctgctcacattgtgggcctaacagtacactcctgacttcttgccatatatgtgaatactgtcgatctagaagcccagatcctgtaagatttctttattaagcctggtctctttctctactgaactcagataggagatcaaatctgaaagaagcttgaagacaacaggcatctgctgcttgaactccttctttatagtcgagtgagatgatctctacccatggatattatgtttgaaaacctctagtaaaggagaactcattacttttccatcaggttcagtctttggatagttttagaaagtagaaagttcttgtatgtaactattatcatttcttctttacttagctgttcctagatactagactataaacctctttatagcaagagtgtgttttttatttcccaatacttaacacaatactgggcatgcagtagatgttaaaaatactttaaaaaataaataaacctcatttggggttctttcactttcttaaccattcatctctgtataaaccctggtttgcgtatgtgcctcagagcaaatgcacaggtatagtctgacctttctaatccacaatggtctgcacagcctacttcttactcttttctagaaaagcagcctatgttcacattttccaattttccatagcttcataattgctgacaaaaatttctttatacacaattaaatccaaacccaagtattactacttataagacttatttttatttttaccccaagccatatatttcttaccaagtttttgtaacattggtgttttaggatccacatgtagaatacattttattcttattaaatgtatgctattaggcctatgagtctccccatcaagtcctttttgcattttgactctattcttccttattcagtaaacgagccagatttacattactgacaaattgtataataatttctggtgtgaccatattcattttattgacttaaaatattgaatagaagatgaaaacggctggagacctagcattacaagtcagtctctcaatcttggtctgtctttctctctccctctttctcttaaaattgagccattaacatattttagagtcccttagccagttcctatcacataaataaaaattggtgggatgagattcatgataggaatataatgaaatgacatgcactattaaaaataaatggattgatactagaaatgtagcatgtccaatgtaatcatacaacatttcgggggttacatagcacaggcatgttcaaattgttagttatctttattatatatatatataatctctctttctatttagcttcttaattatttaattacaaaatcgagtcttacataaatctgtatatccgtaacatgtaatggtgtaccttatgcataacaggtaaccaactgattgtggtttaatgtgaaaggactcaattgcaatgaaaaagaaagttatttagctacagttttcaagagtaactcccaggaaagaaaaataggtaggataagtactaagaaactctttccgaagctgagtgtaagatttcaagaaaaacgttcaaaaatattattacttcgttctaaaataaaatacattctgaaaaatattaggagccatataaaataatgtaatgatgaatcatactctcaacataaaacaaatgatcagtactttctaattttctataatttgtatgtcaaatctcgttaatatttttttaggtgtgttgtactgttgctgaggttgttttattatttgttttggagaaaaagactgtttagaaggttaaactgatgaattcacagacaattatacaagcttgtgctattaatattgttaaataattgcatacaacttagcacttgagcaagaacaagtgttatttgttactgagtctcttcctgtgatcaggtgattagcattacatattcccaagaataaatgattccacacctcagggatcaggaaaataaccacactttcacagtcagaatgtagataagcgctgtcttgtaaactgtagtaaagccaaacatttatagcatcttttaaagacagtcttatgatctctgaatggttttcatctattagaaattctgtactgtttgtctgacttaatgactcatgaaaatataacctaaaagtgaaaatactgagaacataaaataaataatggttttaaatcagtagtgatattgtcaatttgtgttagtggtctgtacttgcagacaagtaattgggctctcttgtcttaattttgtttcagttaccaatatcactatccaatttcagcagaaaatgtcagcattaaaatatgttatttattacaaagtaatagtttttattgaggaaaatttcaaaaacacagagaggtgtgaaaagaggaaaaaatatgctgtcattctatcaccttgaccactaagtagaatgaaaataaatggttgttattagcatctatagagtgtctttttgcaaaattttgattatcacctacataatgcttggtaacatcacttttaacaatgcattctgaacacttttatgccattagaaagtctcctatcatattatattatttttaagtaataaaattatatgctacagcagaatttatttaaccaatctccaattgatgggcatttaagttgcttttggtctcttgatgaagtaaaaagattgttttaaaaattcctttttaaaatgattgcatacagttctgagcctggtttcgtgtaaggagtgtatatttgttacataggcattcaaaagagcacacttctgttatctatttaaaattgtagaatcatgttaatgtaatgaaacaaatggctagctagaataagatggaaacttgtagatgcctgcattaaatcatagatttggactttgaaagaattgctattgcatatgactaatgtttcttagcatgaaagttgcttattttagaatagctggaactatttatcagtgcatttgtaaagcacaggtaccttaaaatggatccaatatctgttcatatcctcaattaatgtaatacatttttgactaaattttatttaaaaagaatcaacagaattgatacaaacaatgggtaaagatgacaaacttttttaggtcaaaggtagtcttttacaatttctggaagcttctttaaaatgttatctatcttgcctggtttgatttgacatatgaaatatatttctctatatattttctatgttttggggcataggtgatgtgcagggttacgttggttcataatattatcacaattttaatcaaacccaattacaaaagaaaaatgataatgatcaccttataatttatcgtaaaaattatacatatatatttgtgtgatgtttgatagatttgctcttatgtaagagaattatgaaagttagatagaaacagccttctgaaatataaaatatttgtcctaacttttcctgaatagcagaaactaagtatactaaaataaatgtcttcaagattttcttcacacgttcctcagactttgttttaaatcagacactttcagataacatatgtttaatgaaaacacaatgatgtgctgagttttcattttaaaatgtttttacttaaaaatagaaaagaatttggagaaagtcaagttgtattgttttgttttgtttgagacagagtttcaccctgtcgccaaggctggagtgcagtggcactatctcggctcactgcaacctctgcctcctgggttcaagcaattttcatgcctcagcatccccagtagctgggatcacaggtgcgcaccaccacgcccggctaatttttgtgtttttagtagagacagggttttgccatgttggccaggcttgtcttgaactcctgaccttgagtgatccgcctgccttggcctcccaaaagtgctgggattacaggcgtgagccaccgcacctggcaagttgaattgttatatgcagctatatttatccaagttgcacatatttaatataagcacaatctgattaaaaaaaatcaaagttcctgtctaaaacctaaagaattgtagtgaaatcaatcaagttgttgagcttaactgaacttctttaatgccataaccttgatattcactatttcctttgaaatataatattcccttttgcattatttatgcaaatgccatgccagtgtagtggaaggtgtcacctcagtgcagctatagccagtaacatttcctgttctagtcatagaaactttcatttattcatgttgatttgtaataattctcagtcaatttttcctgggtgaagacatgaatttgatgaaacagtagcagcagaattattgttttggatgtattcattaattttttagttaaactttctactttgagataattgtagatttacatgcaattgcaaaagacattacagagatctcatatatcctttaatcagtttccctcaatggaaacatcttccaaaaatttcttacagtggtaacatcttgatagtacaatatcaaacctggatattgaaattgacatagtcaagatagaaaacattttcatcaccacaaggattcctcctgttgccaattagtagccataccacttcccttctgctgtcactctctccttatctctggcaaccactaatctgttctccatttctattattgtgccaagtcaagaatgttccataaatggaatcatacagtttgtaacctttttcactcagcataattctctggagattcacctaggttgttgaatatatcaatagtttgttcctctttattgttggtagtattctctggtatggatatatcacaatttgtttaaccacttacctgatgaagtatatctggattgtttccaatttttgagtgttacaaataaatttgctaaaacagagcctcactctgtctcccaggctgtagaacagtgttgtcagtggtgtgatttggctcactgcaacctccaccccctggattcaagcgatcctcctacctcagcctcccatgaagctgggactacaggcatgtaccaccacgcctggatgagttttgtatttttgtagagatagggtttcgccatgttgcccaggctggtcttgaattcctgagctcaaacaatctgcccaccttggcctcgcaaagtgctgggattataggtgtgagccactgtgcctggccaaatcaattaattttaaattcaaaggtgatatgatgccctctttgtccttctgattttcagtgttttatgaattgattttagttgtttcagtggattaattctacagtatttgcaacagaaagtataacaaagatctctgacaaggtcatgcctatattgggctgtaggaaatacttacttagctacgtattttatacaaaatactggctactagaaaatgtagacatattaattggttgtgaaaaaattatcttgatttactgtaatggcttttatttacctatgtattcttaaaaatctatggaatgtgttctagatacaaaatagtatatatgccatatagagagaacttacagaattagagaaatgaactcctatgtatcagttatgagtttcaaaaatagagtagtacatcaccatattgaaacaccttggagcatggccttctggatgttatctcccattcttcttttggaggtcaccactattctcaatttgatatggtttggttttgcccaattttgttatataaatgtactaatctgattatattcactgttctatgacttattttttttacttatttcacagattatactatgatggtggcagtatcattatttattaatttccattgctatataatattttattgtatgaatatactccaatttaatgtatctcttgtattcttgatggacatttgggctgtttccattttttttctattattaacagtgttgctatgactatccttatacttgtttcctggtgtagatgtggaaaaatgtctccaggttccatatatatctagcagttgaacagctgagtctatatgcatattttaaagtatattaggtaatactaaattattcttcaaaagtggtgtaccaatttacatagccacaagcatgtgttctctcacatctgtaatcaggccctcagcatttgtttgctcacttttatattattggtcttaagcttattgattcaaaagagtacttcgcatattttggatactaggtgtttgacagtaatacatattgcaaatgttttctcccaacttatggcttatctttttactctctttatggtacctatgatcaaacgaagcccttaatttaatcacatttattatctttttcctttctagtttgtactttggaaagctttttgaattttactagggtttatagcttaagttttatatcagtaaaatgcttaccagaataatgttctttatcttgaatagtagcttgcatttatctaaaaattattaggatatatatttcataataatttctatttatagacatatatccttatgatttttatataaacacataccaaatgtatatatatatatatatgtaacaaagtttcttttaaggtttttaatttcagctatcgacctaaacatgcataaactaccttttcttttaaaatacattgctgtagttagctcctgaaaacacttctacttcactgaagcggtgatgatttttgtgaattttcagccatttgtctttgagttttctctttgaaagaccctgagactttattcagtgatatgagagaaactatggaattgttaatattttaagacatcatcatattcatgatttattgttctttgcacaattgattccaacccaaatgtcccatgaaataaaataacacactcagtgtgatttgttttactaattattatatgtagcaatcacttgactgtatagatcaaattttactttctaaaagctccttccattagtgctaatgtgtttgtccctttcaaaaaatacatctagtaatcattgggcaggtggtgaggaggaacagattagaaaatggttcctctctattttttaaatgatgaagtagaaattctgtcttttatgaacttctgctgtttggtttctaggaaagtatatgcttaattgttaaaatattgaagatcttactgttaactctaatttttccagagagaagaggaagaggaaccgtcattggttaaacgctcaatataggttaggcaatattctggccatatgacctctaatattcttcattcatgcattaattcattcaacaaattttttttgagtatgttctatgtgccaagctgtgttctaggaatcgaggtaaagcagtgaataaaacagacaaagaggcaaaaatcatgattttggtagagcttaagcaataaatatgacagattactgccttagaggtatctagaaattgagaaatgctatacaaaatagcatatggctctgcttgtaaaattttaatgtgcatgtgagtcacctggggatctcgttacaatgcagattgtgattccataggtcttgggtggagtcctaagatgctgcatttctagcaagcttctgagtgatgccaatgttgctggtttgggagcacagtttgagtagcaaagagtatatggcaagtgaggtgggggtcgagcgtggagagtgggagagaaactggctgcactttaaaatatgatgattagggtgtgccttattgaaaaggttataagtgagcaaagatatgaagaaggtgggggaatttagctatacacttatctaggtcaatgaaaccagccagtgcagaagggtgttacatgggagtgtgcctgacaaggaggtcagtgtggatggaatggcatgaatgagaagagtagtagtagatcggatttgagagacagtgggaataaagtagatcttgcagggcttcggacaccattataagttctttggcatttacgctgagatgcggaaccactccagaattcggagcagggaggtgacatgctccaacgtacgtatttaaaaaatcactctaactgctgtatagaaaatagactattataaaacaggatagaagcagtgagaccagttaggagtctgcaaaatatatggtagctcagacttaagtttatagcaggtgagatggtgagaagtgctaatattcagaacacattttgaaggtagagcctagtgaacttattgatgtcttaaaatatgcatatacacagatgtaggctgtgaaagaaagaaaggagtcaaggatgactgcaaggtttgtttgttttttgacctgagtttctagaaggatgaagttggcatcacctgaaatggggaagggctaggttttcaggagcatgtcagaggttcattctctgtatgtgttgaatcccatgtagccattagatcttcaaatagagatgtggagtaggcaattgtatatgagagcctggaattcagcgaaaggaccgtgcgagaggtccaaattttctcttatatcattcttaaaacaatcccttgctgctcatcttttatccacattttataattggggaaacatgttcagaggatatagcaaacattcagtttgtaagaggtggagcagagccccaggacaatctgtagctccaaaggccacactgctgttctgcttcaatagtaaaaagaatcaacactggtcactgcagctggttatgtgtttacttagagcaagtcgaaaatatttttaggcagaaaaattgagttggcagttcatctttttaacttccctacttggctactatagacagattttgttaagtcaatgcttggcagctttccatatgttctagagatgcgtgttcatctgggtgtgacagttttttctaagtcacttctgccatagcttgttaaaggtaagaaaaccatgtcttcactgatcttggggtcctagcgaagaaatgtgtgctttctcagtgttggaagggtagagaatggtaaaatgaacattggtggcctccctgtcccccagtggaattccaaggcatagcctaaatgatttctcagaggtccccagcagggttgattcccggttgctcacagcagtaacctgttcattaataccatttattggcttttcatgcatccttgcctcacattcctcattgttcacttcttaggatcacctcccaagtgaattgtctgaacctaagtccatgtctctggctaatctaagaaaggtgataatgtgaaatgtgcttaactggtctatccatgatagttctttctaatttctacaacagtgcctggcaagcagtctcaataagtatttgccacaccagtgaaggactgttattttccttaatgtttattaagtaatagtagtagttgttactattattttaggcaaatatatttttaataggacacagataaattcccctttgtcactaacactgccaatcttagttctttccttacgttcccagaaacaagagttcttaaaactttggtatgtatgcttctgctattttgacttttacctaaatcacatcattttatacatgtgattatgtaatttgcttttttcactcaaatttatgattttgagttctatcgatgctacatattttctgccttctatctgattaaaaatttcccattctgttttcttcctttatggtatttagcgtttttaaattctatttctattttttagtggttccttgtaagtctttaacacaaatatttgaatttacattttaagaggtactaccagtaatgagctaagatttttatcattgcttaaattaatgagcctttctgttcttaatggccaaatgtaggccatagtttaccttgtctcctagctatccctgtttacttccgtgttttctaggattttagtttgttcttgctcccaaataacaaaaggcttattattattattattatctttattggatcttataattaagttttatttctttcatttgcttattgaactcctttctttaaatatacttttcatgttggggaagtgtctgctttagtcactaggctatgatacttaatctaggtcttaacaagtagggttttgccatgaagagggagaaaggatcagtatgcaagggagtagtgtctgaatttgctttgtatgtgccggaatgtctatgagttaccctttgaacacagctttgtgttgctctcatggtttgtaatgtaatccatggtatggtaaatatgtacatcaaaaataaactaataggaaaagatatgaatatcaaattagaaagtgacccaaaatgaagtgttatctaagacaatacatttaatatgtaaaaatacacatagattcatttgaaaatatttgtcgtatttctttcaaacctcatccaatgtcagcataaacaaatataacaaactagttttcaaattaaatttaaaaatataattcttcatacctggagcctcggtgagtaggcattatgcctgaaattttcaatgtcgatggaccatagatctgcctaattactcctagagtcattggagccaaattgctgggatgagccatcattcccccatccccctttcacaccaatgtgattgtatgccttaattggttctctagttattcatgttatatgatctcaccactaccagtgcttctctattagtacctcagtcttcttgttagcattcttaccaaaagattatcagaaaatccaagttactaaaaacatatctaaaacacaaagcccgtgaacagcacatgaaagctggaagcccttgcacttccagaatcctgcttgcatgcctttcagatcacttacagtagcagaaaaggtgtgcaccatcacgctcagctctaacttgctctcttttgtatatgatgcggtaatcctggctcttagtgctttgggattttggtgatagatgtcatcaccagtaattccacagtccccaaagagttcaactctctcaatcaaatcttaagccatattgttggctccctataatactttaaattctactgtacatttcttatagtgtaatcatgttaaagagggggaaataggcttttttcctcttctcaatgcataatctttttaaagttatctattctgatttctcttgaggtctctttccaattacctgcaagtttgcttttactgtggtgttccctgtattgtgtgtgtcttattccttctgcaagaaggaagtggccaagctgacagattgctaatattaccattgtctaattacagctctattatgtctgtacaacagaattgcatatcatttaagaggccactacagcatttatcagtcgttgtggattctagcctaacttgaccattcatttatttttaatttatttttatttttgccttttttgagacagtatctcactctctctctctcacccagggtggaatgcagtggtgtgatctctgctcactgcaacttctgcctcccaggctcaggcaatcctcccatctcagtgtcccgagtggctgggactacaggtgcataccaccacacttggaaaaaattttaaggtttttgtagctacgaggtcgcattatattgcccagactggtctcgaactcctgggctcaagtaatcctcccacctcagtctcccaaagtgctgagattacaggtttgagccactgtgcctggccttgatcattcatttagacttgcagtctgtgccatgggaaatccaaaagctccaccatgacaaattaactccctgttacagacgtagctgttgtctctccgtatctggagaccctcagagcatttttaaaagcatgacattttaaatgttaatttttattgcccagcaaagttaatcacacctatctatgaagagttaatttccaattaaacagttctctgttcactatctataattccctcaaaggaaccaatcatacttaaagggattcagagcctgttatatttcttatcgtctattttcatgagagtatgtacttattataccagatttctggcatttagtgttatagatatgcaaattccattttaactccccttaagatttccaacacccaaatgaacaattaagttttaacttttcatctgtgttctctctctctctcatctgtgttctctctctctctctctctctcagcacatgctgttaaaactttagtttatgctataggtccttgtagcgacaattttagaaacacccctttcttgtgtttatactattataactttggggtctctaaaccaattctaaatatgcattataattataactttatatgttacattcttatcctacttttgtcttaagataatttatgactgaatatttttgtggcatcataatttaagctttaattttactaaaatgtgctttttggttaacagtaaacagttaatatgctatagtctcctggaaacacacgttcacatagctttttatgagccaggtttttggtaattcagcatatactttactattgaacttgcattcttaatgtgcaatctgatcaagaaaaatatcctctaatatttcttttgggttccaagagcactgtcccctttcccaagtactacattttacctgaaaaatatatgagaaagtatgagaattcttgagcctaaagcatttaaatttgattattttcaaaatttgttaagtcatttcaaactgaaattgaaaataaaattaatttccaaatagtaaaaggataaatgaaactaaatactgttactgagaaaattagtccatctttagggcttcaaaaaacacactgaatgtagctttcactgattatatacacttttaaggttgcactttttctaggtgctaggcagaaaatggagcctgaaaaatatcaaattgcagcatagtaaatcacgtttgaatccaagttttaagttatttgaccagtactttattctttgatgagccctgaatatatttttctcagccataaggtaggcatcatgcattcctaaaattggagttgattttctatgatagtttaatttactagctgctcagttcttctaactgtgcatgttatatgggaagattatttttttatttctttgtaaattcatgtcagatctacccatgggaggaaaatgattcctaactcttctccatttcttttagtgtttattcatatgctgtttctgtcttttctttttgcctttcccctagctgaaacaaggatgaatctataaactaaaaaaaaatctttttctttgtaatattagatagacatattatcaataatattatataatctattgcaacaatcaagtcaccattaaaatgtgtagttttctgagtgtttccaagtatgtaatgtaggacaatgctttaagtctggtttattctcatttcacttggcttttttttttttttttgcatactttgagtatatgttcttaagaatattcttaaaatattttccaagacacatttatgtaagctaatcaaaccatgcaatagataagaactcaatgttttagaactctgtcataagaagagatatatttgtgtatgtgtagatacacacatacatttagcacattttcagagacatatacattatggatttttattattgatttaaattctttataatatgcaattacagatatattttatatcagcttaagcattttaattgcaagatttctgtttaatttgtctgcaaagtactcttttttttctggtcatggtaaatttcatattctttgacaatagcttttgtttattactagaaacacttctcttgggctaggttgttaattaactgtcatttttgtacagggtgtaaaagagatatggaaagaagggtacatgagcaaatggaatttcacacattattaactgttttagtgtcttcaaacttcaaaaacatatattaatatttttgtaccacgtaagttcatcagaagcctgactttaatctctgatttattatatttgaacactgtgaagaagcagtttaacactgaacgaaagtgtcgtaatgcagctttcaaagtggccattaaagacagatctctgcttttctattagtacattttctaagatgactatcattgccattgtagtcagctttgtgtacctttatagagattccagtataaacccagaaacatagagcactgagagaaataatatcagaagtgtttcacctttggctactattgtaaattgacaaatgacattattgcttttagatttttaaaacaaacacactaagtagaacatatgcatccaaatcagtagggtcatttcaaataagtcatactttttgttccagtgattcattagcccaagtacacttgaagttcccattttagaattgctttcacaggccagtttatgaagcagaaaataaagattcatttctttctggttaacacctcatttttggccaaaagtgatatagcccaatataccacgaataccttactgaatctgatgcccaatgaattttaactgtttttaaagttcaaagcaatctttaaaagaatgaagactttcagccattgaaactgtctagaagctgagctatgatatttgaaggttcagtatttacaaatggcatcattactttttctttctagagaaggcactagaaggggggctttcatcagaaatacctggaggttttagagaaggcagattctgtctggaaagtcatgggaactagaggcagggtgccatgctatgatcagtcaagtctctaatctctaaaatgtatttcgaagacacagtttgagcaggttgaataagctttttgtcttgtaggcccaggatatactgcgttaccaaagtccaagccccacaaggaggttattcacctgcccataggtccattagaagtcatctgctgatgtgactgtattggtgatgtggaatattaacgtggaacagaaaactccatgggaaggcttagtgctgggggagagatataggcaaaagagatggaggaaagggttgaaataaggatttgtttagacagttcactggtggtgatttattgggtgtgttttactgctaacccacacatgaagcccctgacatcttggctgaggctggtaatttttttctgacaaggatcagcagaaatgaaggtgccatagcttccagtgctagatatagtagctaaacattatcttcagcagagatgggagttcagagtgtcattgtaaaatacatggaaatacctaatgtaaaggagtctaatgaatgaaagaaataccaaatgaatcttcacagagggaggtaaaagaaaagaagataaaatcaaggctggtgacaaggaattattaaaatagaatatgttattgtatatatttgcctcagagtttataattaggagtccgttgaactctgtttcaggatgtcttcatcatttctttaaggatttaaaatatactgcatctagaaataatccaaattaaaattgatttaatacactccaacaccacattataaaaatcattcactatgaccacctgggtttgatattggaaaatctattaatatcaatcactatattaatagatctaagaaaaaaatatacccttactccagtaatgctaaagcctggaataagacaggaatgaaattagaaaagataaattagaggcataagaactagaaaagaagaagtaaaattccctctatttgcagataacatgatagtatacctggaaaaccctagagaataaatggcaaatgtagctcaaacaatgaaataattcaacaagctagcaatatgtaaatttgacagacaaaattcgacagctaccatatgcaaaattaataatgttaaaatagttggagattagttagaataaattacaaaaatctcacaaaataaacagaaaagataaaataggaataaaattaacagaaaatgtgtaaaacatataagaaattataaagcctttctgaaagacacacagaagtagacttgaacaaatagaaagacattccttgttcttcaataggacatcacaacatcattaagatgccacttctctctgaattaatttaaatttaatgtgatgccaataaaaataccaacatgctttgctatatggagctaggcaagttgaaactaaggttaaaatgaaaaaataatgaacaaaaatatctgggaaaaacactaaaaaggaaaagctatgactagccctaccagatattagcatgtactacaaagcctcaacaaataacagtgtcaatagcacatgaatggacagaccaatggaataaaatcaaaagtcctgaaatagaaccaaatacatatagaattgtaatatataatagaggtgacatctcaaataactggggcaaagttgaacttaataataaatggtttcgtataaaagaggaaattagatgtcttcctcaagccatacacgagaataaacttcaaatgaatcagaaaactaaatgtaccaaggaaaactatacaggtactagaagaaaatattggtgaattattttaggacttgcatgtagggaaggactcttttttttttttttttttttttttttttttgagacggagtcttgctttctcaccaggctagagtacagtggtgcgatctcagctcactgcaacctccgcatcccgggttcaagtgatttccctgcctcagcctctcaagtagctgggattacaggcacgtgccaccacgcccagctaattttttgtatttgggtttcaccgtgttggccaagatggtctcgatctcctgacctcgtgatctgcccgcctcatcctcccaaagtgctgggattacaggcgtgagccgctgtgcctggctgggaaggactttctaagtatgactaaaaattcaaatgccacaaataaaaagattaatacattttactatattaaaaacttcgcatgacaaaatcaaaagccaaaagaaaactggaaaaaatgcatatattgtaatgtatatcacagataaagagttaatgtccttaatatataaagaacttttaaaaattaagtgggaacacagatcctgtagaaagatggacaaaaatataaatagacaatttacaaaaaatatataaatgatccttaagcatatgagaagatgattgctttcactaacaataagtaaaagcaaattaaagctattttgaggtacagttctcacccatcagattggcaataatatgaacatttcacaatatactctgttgagaagctgtagagaaacaagcattctcatacagtgttggaatttcgaaatgttctgaaacaaatggagggggaaatagaaatatctaataaaattacatatgcaatcccactttgacctagcaatctcatttctagaaattagcctgaagatatatctcctacaatgcaaatatatgtacatataaagttattcattgcagcattatttgtaattgcaaaatattggaaactacgtaatagtcaaacctaagatatcagctggataaactatagtacatatacacaataaagtactaggcaactaaagcaataatgaggatctcttgatgaactaatattgagtaatttctaagtgaaagcgaagtaaaagaatgtttttctactatgctgcctttgtgtgtaaaagaaactgaaataagaaactgggcatcactttagccaagtgctcaaaattagtatgtttgttttctgtgctgtgtaaaaaattaccacaaatttagcaacttaacatagcatttattttttctttcagtttctgttggacagaagtctgggtatgacataactggaatctctctcagatccttaacacttgacctcctccataaactctctcacacttacaatgtctgatctctggaagggcttggcccctttgaagccagattgggtaaagttcacccaggatacgctccttttttattaacgcaaaggaaaccaatatgggactttatttatactgcaaaacctcttcacctttgttatataacataacttgatcaagggagtgaaatccaccatctacccgttattcctagagtagggattttacagggtttatgtacaaaggcatggggatcttggagcccctctttgaattgggcctatgacagttaatatcaccaaaaaggggcaaacagacatcttgtgtgtgcctccagatgcaatactcttggcaggatataacaccactgagaaggatatgacagcactgatacagtattcccacccaaactgtataacctgaatttagtcataagagagcatcaggcaacacaaatcgaggtacattttataatataattggtctgtagttttaaaaaaatttcatggtcataaatgatatagaaataatgagaagggattccagattaagagaaactaaagagacatgacacccaaatgtagtctataatactggattggataccaaactgaaaaaaagatattgttataaagaatattatttgatcaattaacaaaattagaatatgaactacagttgaaagtatttgggccgggtacaatggctcatgcctgtaatcccagcactttgggggtctgaggtgggcggatcacctgatgtcaggagtttgagaccagcctggccaacatggtgaaaccctgttgctactaaaaatacaaaaattagccgggtgtggtgatgcgcgcctgtaatcccagctacttgggagcttgggaggctgaggcaggagaatggcttgaacccgggaagcagaggttgcagtgagccgagatcgtgccactgcactccagcctgggagacagagtgcctctgtctcaaaaaaaaaaaaaaaacccaacaacaacaaagaaaatattctattagtgttattagtgttagatttcctgagtttgatcactgaactgtggttatataagagaatatcttttgttcttaggaaatacatactgaaatattaaggggtaaaggaatataatatgtacaacatactctcgtggttcagaaaaaaatactatatgtgattgtgtgtgaaagagagagaaagggaagagagaatgataaagcaaatgtggcagaattttgaagattggtgaatatttgtgaagtgttctttggattgttcttgtaacttttctgtaattttgaagttatttcaaaataaaaatcaaattaacaaaaaacaaaaaataaactacacctaaacatcttagcagagggcctgcctggcatataagttctcagtaaatggcagttaataataatatcactattattacctaattcttgcttacaacttgaatccaatcaaatgaacctatttattgccactaccttgggggtttttattgtatttttggtttaagaatacttagtatttttgtttaaagtctaaaataattttataatataaatgtgtagagtaactggtaaccagaattcctgcaaatttaatgccactgcattaattgattgttttagttttggttccccagaagctgacccctagaacccaagacaaggtttcaagttcacatagtttatgtgagaggaaataccaggagatgttagatgtggggagatgagaaagtgaggagaaggaattgaataaagggttcattattaaccaagttaccactgtaggcaaaagggacttaatcctggtggggaaatctaggagacagtgtaatacatgcttcagactttgcctgcccaaggagggatggaggtagggtatttgtacactgacccccatcggtcattgactgagggcttctggagcatgcaaattaaattctaagcacttccagactgctacagtatcatatcagattcctttaggcaatgggttgcaagagctgacatgtgggagacagggctggatgcatgcaaatgatgaattctgagggtatactggtaagtgtctcacagaatctgctgctttggtgaggcagaaatctgctgaatcagtctccctggtattccaggaagcatgtggagtgattgcagctataattatggtgaaatctacactggaactaggtttctaggaacaaacagatctgaactgaattattattttttccagttgctagctgagcgactttggatgagttatttgttcgaacctttggtttcctcatctgtaaaataggggcagtaacagtttgtcttcataaatttactttagaattaaagacattatgcatttgaaaggttgggcctagaaaatactcagtaagtgctagttttattatgtttgcatctcttatagttactattacttttcacttttaatcagtctgttagagatgattgttcttatcttgaactataagatgcactccaatctgctagattaatttgtaccttggctttaaaaaaatctgttttttttttaatagccattgaagactcagaacaatagggactccaatttgctacctgttcttgaaaatgacaatcagttacttaggaaagcaactttgaaaaatacaaaggaaagtcagagagattggaaccaaataatgaaggtcaagcatcatcaaaaacacaagttgtgagtgacacataaagggaagaaaaataagcatcgtaaggactggattagccatgtttagtatgcttttgaaatatttatgaaataatcacagtttaactgtttaattgcatgagctagatttggttgagtacaagcagaacactgcctattctttctcacttcctctttaaatcaagtcatggtcttgtcctttcctacccatgaatgaaaccgaacgcagagtccatagcttaccagtctcaaagtgtatttgtttcctagggttgtcataagaagataccatgaaccgagtggtttaaaacaacagaaatgtattctcacagttttggaagtccagaagtccaaaatcaaagtgttggcacagccatgctctctcttaaggctcttgagggatgattcttccttgcctcttcttaacttctggtggttgccagcagtccttcactttgttagcttatagctgctttactccagcctctgcctttatcttcacatagcattctccctgtatctctgtgtcttcacatggttattttgttaaaaggactccagtcttattggattaggggcttaccccactctagtatgacctcattttaacctaatggactatatttgcaatgaccttatatctgaagatcacattctgatgttcttggaattaggatttcaacatatcttcgcggggagagggggggcgcataattcaaccaataacacatagataattacagtctaagcccatcagtattcaaaccctaaatcttctccaaaataaacatcccccctttcttagctgaggaccactttgtgcctgaaaggctgcattggagtgagagtgacccgagtgtttatttccctgccccaccttgttctgtccctcctcctctctctctgacaaggatatgactgagtcttccaagattagagtaggtagaaagcgtgagctaaggttgggaggaaatgagaagggagaaaaggatgaagagttattttgattgatggaattattttggctttggtgtcctctgaggcagcagattccaaattctgattcttactctcattaggttgttcccttgcctcctcagaagcccacttactctctactctaaatatctctcacttgtagctaaattgatgcaggtagggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgatggcctttcaggtttactttttaaactcttcaagcatttcttatggaagttctcttacttaacttgcagtaaggtgaagcacctctcttccctaccccattgactcccaagaagcgatgggcaaatatggagaggagattgtaggtattacaggaatgcagagcactaacaactccctctaaagaaagccactctgttgaacatcttcatctgtccaaagatttcttaaactcctatgaacagcctagcctagagacataacagtctaataaaaacctggcagaacttgtcagaactcatcttttaatattttctaaatgcattgtttttaaagtgcttcactgagatataattcatacacttcaccactcacccatttaaagtacacagcacactgttttttagtatattcagagagttatgcaaacatcactacaacctaattttagaaggttttcatcattacaaaaagaaactccattcccattagctgtcactcctcatatctccctcttcctagccgtgggcaaacattactctactttctgttcctgaagatttacttattggggacattttatataaatggaatcatataccatgtggattttttgtgactgatattttagcataatatttgcagggtcatccattgattgtagcatatatcaacatttattttgatttctaaataatattccattgtatggatatatcacattttattcatccatcagttgatagacatatcaattgtttctgctttgagctagtagaaataatgctgctatgaatgtttttgcacactttttatgtggacatatgttatttctcttgggtatttatccaggagtggaattgttgggtcatatgttaactctatatttaactcttgaggaactgctagattgtattctaaagtgactgtaccactttacatccccatcagccatgtgtgaggtttcctaattttcaacattctcaccaacactcgttttcgttttttatttatcatatccactctattgggtgtaaattgattgtttcatactatcttagcttattttcatagataatccatttgctagagttggaatgtgttcccacaaagttcatgttttggaaacttggttgtcattctggtgatggtgggaagtggggcctttgggaggggattaggtcttggaggctccaccctcataaatagattaaggttgttattgcaaaagttgctttgctataaaagcaaactctcttgcatgtactctcttattctcctgcccttccaccatgagatgaccttcaccaaaagctggtctcatgttcttgtactttccagccttcagaaattgagccaaataaacttattttctctgtaaattacagagaaatttacagtgtgtgatattctgtaatagcaagagaaaatggactaagacaccattgcttctctttaggatgtgcaaatagtttgtgcttgctttatttttctgacttacgagccctctgttaaaactcaaaaatcataagaacagtgacatttaacattcagttaaaatgacaacaatttgaccaaaaggcattagaactctatgcctagagttatcgtaataccatgtgcacaataaaatatgtatatgtcataaggaataaaaagtggagtaaacatgagataatctgactatattctgagtgctagatgtctatgagggctttcaggttagttgcttgttttttagtaataaacacaacagtaataatgatgataatacatagcctatattgctccagccaggtgtggtgactcatgcctataatcccagcactttgggaggccaaggcaggaggatggcttgagttcaggagttcaagaccagcctgggcaacatggcaaaacctcatctcgacaaaaaagagaaattaggccgggcgcggtggctcatgcctgtaatcccagcactttgggaggccgaagcgggcagatcacaaggtcaggagatcgagaccatcctggctaacacggtgaaaccccatctctactaaaaatacaaaaaaattagccgggcgtggtggcgggcgcctgtagtcccagctgctcgggaggctgaggcaggagaatggcgtgaacccgggaggcggagcttgcagtgagccgagattgtgccactgcactccagcctgggcgacgagggagactccgtctcaaaaaaaaaaagagaaattaaccgagtgtggtggcccatgcctgtagtccctgctacatgggaagctgaagtgggaggatggcttgggcccaggaggtggaggttgcagtgagtcaagattatggcactgaactccagcctgggcaatggagtcagactctgtctccaaaaaaaaaaaaaaaaaaaaaaaaaaaattaactccctttattcctatgagaaccccactgaatagacactattatctttaccagttgtcagatgagcaaacttcccccagataataagattaatactacctttttacagattaagtaaaactagggggagattgagaggatactaaaaatatctaatgcataaaaatgtataaggttaaggacaattgttttgcctatctctgcccagatcttctcagatcccttttgaagatttttgttgtctaccctctctctggtttctgtgctctcacttttatcaactagcactaaaggctctttgtggggtaccatcctagggctactgaagctgtacccactcctccaggtgggagatcaaaagcctgggaatttcctgtaaattgttggaaattttcctactgataaatcctttcatgtttttactggctttccctggaagcattctttgtttggaatgagtcacttgtacacaaatcttgatctcagggttagcttaaggagaacacaagaaacagagaaaggaggatctcgataaaatattgaactagtacttagtatgtgaagaaaatgagtgatagtatcaaggtaaaaacaagaacagtagaaaattatcttaaaccagggggaattgacattagaaacaaatggattgtcatgatttgaaaatgttagaatgggctatttactcagaaaaagcttcaaacttgctttctgagaagactttataaatgtgcatagctattttcctgggttagtttaaatgtactgcagtccttctggaactgaataactaaatcagtggcttcccagagcctctacagctctaatagttgtataagagcacaacctatggttgtaaccaatggttaacaatcattaacctaaaaagtaaagcctttttgattatgcattgtgctaagggctttagaattattgttaaatggattcagtccctgctttttaggaacttaagagaaaaatttttaaaagtaaataaaagaaatctaccgtttatggtgtactactaagaagcattaaaacaagtatgagaatcacttcagagaaacattaatgaatttacaaatatcagtatttcagaaaagtaatatctactttgattttacaaatgagatatgtatggacaagaaaaatctattcatgacatgtctactccaaatagcttcattagtatttttcaggcgaaaagaagtaacaaaatgaaaaagaaaaagaaacattacactgcattgaggcaaaagattaagaaataagtttgtcagaaaaatgtgaaggtttgatgcttatctttgcagtaattttaagtaaaatgatgaagaaagaaaaatgtttgtggtgagaatattaaaaaaaattgtaggataaaatcccattatatcactggggaaacaaattaatatttcctggtaaagagcttgatgctaggatctagtgtcagaaacttttcttaaataaatactttttcttcttgaacctttaaacatattttgaactaagcaattttgaaacaaattttattcaagtttcttcaagtaataataaaaggaaatagttatcaagtatacaaataactgatctttaaatatatatatatatatggatattaggaaaatatttgagtaggtgggtaggtgttagaggaagcaggaaagataaaatacacacccttgataaaattgtattatataagcaactgcatatattgctttttattgcttcatacaattttattatataagcaatggctttattatataaacaatggcttatataataaaattatataaacaaaggcttagataataaaattatataaacaaattttataattttaaaattggcatgtagagtacacatataatttccttaaaactgtgttattactttccatcaatcacatggatcatgaagttgttttcagttcttctaaacatgctagaaatgtggtcagagactaaaaaacaggtacaaatatattgttttcaaactttacctgtgcgagtacagaataaagacatatttggatatgcagaaacactgaatattttctttcatggcaccctttcttagaatattatttaatgatattgtctatcagaactaaagagtaaaccaaaaaagaggagagcagtgaagagaagcttcacaattatagctatttgttgggtcccaatactgagcaatctgtcccagttaaaaaaggaaggaagacttcagaatagaaatatctgggtgattttattctaccctttattatttggaacaatataaggaaggaataaatgcagaaaataaaaggataatagaataacaagcatacaagatctcagcacccccttttattggagtaaaaggactacctgatgataaaatgcaaacaattaagatcaaatcaagagaaaacagatcaaaacaaaaagttggggaatgatgaatatttggtaaaaaaaaaaaaaacaacctggtgaagagctgtgaatacaaaaaatacaaaattgaaaataaagactatgagggttgtagttgtagaacagaatgtaaatattataaactttgaaaaagtgaatcaatataataaaaatgggaacatgttgaaggaggcaagaagcttattttctctcctttcacagcaggaaataaatcagtctgacttaaaattgaaatactcattttagaatatcataattgtagcaaaaccgatttcttaatgctgttccatattaatttttcctaaacttctaaaacatgtaaactgaccattaagaaactagtaattatttcacttcatattatttcttaatttatttgcagatacaattacattaactatatttcattcagaatatatgaccgtgtttactaaaatcatattttatctttatctctctgtatggattttagagatagctgggaaaatagttacctgatctttattgtttcttgtccatactttaatatcactttaatattgatttttatattaaaaatatattattttgtaaaataaaccattaaaaaaaaagccaattactaaaagtaacttgaaagtcagtacaactttgtataaagtccctagaaaaccacaaagtaaatttgatttatattatagcaaaatgtgtaatatatataatcttaaaggtttttcttttcttttctttttttttttttttttggagacggaatctcgctctttcacctcaggctggagtgaagtggtgatctcggctcactgcaacctccgcctcctgggttcaagcaattctcctgcctcagcctcccgagtagctgggattacaggcgcctgctaccactcccagctaatttttgtatttttagtagagacagggtttcaccattttggccaggctggttttgaactcctgacctcaggtgatacacccacctcggcctcccaaagtgctaggattatagggataagccactgctcctggccaaggttttttttttttttaaagcaatttagtaacctcccaaattaccactatttcttattttacaaatgtgtagtcttcacccctcttttcagctagaaaacaatttaccttaagtgtatgatcactgtcaaaaatgttagttaactaatagaacttcaacataaaagattataaattaaaagcacaaaatacaattttggcaagatataggtcactcggggatgaagttcagtctaaatagctgcctttcttttgcaagatgcttcagattttgtaaactccttttgctcttaaaagaatatctggtggattcatagccaaaaatctaccagacatgaaaagagagactggtaccaatttcaccgaaactattccaaaaaatcaaggaggaagcattcctccgtaactcattctatgaagcaagcatcatcctgataccaaaacctggcaaggacacaatgaataaaacacccaaaaaactacggaccaatatccctgactaatatagacgcagaaatcctcaacagaatactagcaaactgaattcaatagcacatcaaaaagttaattcaccaagatcaagtagatttcattcctgggatgcaacgttggtttaacatactcaaatcaataaatgtgactcactcataaacagaattaaaaacagaaaccatgtgatcatctcaatagatgtgaaaaaagctttcaataaaacccaatattgcttcacgttaaaaaccctcaagaaactagacattgaaggaacatacctcaaaatactatgagggtcaaaaattggatgcatttcccttgagaatttgaacaagacaaggatgccccctctcactgatatggtttggatctatgtccccacccaaatctcatgttcaattgtaattcccaatattgggggtgggtcctgttgggaggtgattggatcatgggggtggagttctcatgaatggtttagcaccgtccccccttaggactgtatagtgagtgggttttcaggagatctggttatttaaaaatgcgtagcacctccccgtctctttcttcttcctgctctgccatgtgaagtaccttactcccctcttgcgttccaccatgattataagtttcctgaggcctccccagaagcagaagccactatgcttcctgtacagcctgcagaactatgagccaattaaacctcttttccttataaattaccaagtcccaggtatttttttatagcagtgcaagaatggactaatatactcactactccaatgtagtactggtgctagccagagcaattaggcaagtaaaagaaataaaaggcatccagattggaaaagaaggagtcaaactatatctcctcatggatgatattattctacacctataaaaccctaaagactttgccaaaaggctcctggaactgattgacttcaataaagttttaagatacaaaaccagtgtacaaaaattagtagcatttctgtacaccaataatattcaagttgagagccaaatcaaggaggcaaccccattttcaatagtgacaaaaaataaaatacataggaacacatctaaccaagaagatgaaagatctctacaaggagaactgtaaaatattgcaaaaaaaaaaaatcatagatgtcacaaacaagtggtgaaacatcccatgctcatgggttggaatagtcaatatcattaaaatggtcatattgtccaaagcaatctacagattccacactattcctatcaaactaccaacatcgtttttcacagaactagaaaaaaactattctaaaatgtatttggaaaccaaaaacagcctgaatagttaaagcaatactaagcaaaaagaacaaagccagaggcatcacactacccaacttcaaattaactataaggctgcagtagcttaaactgcatggtactggtacaagatcagacacatagaccaatggaacagaatagaggaccctgaaataaagccgcatacctacagtcatctgatctttgacaaagttgacaaaaataagcaatggggaaaggactccctattcaataaatggtgctggggtaattggctagccatatgcagaataataatactggacccctgcctttcaccatgtacaaaaattaactcaaaatgggcaaaatatttaaatataagagctcatactctaataatccaaaaagaaaaactaggaaacaccattctggacattggccttggcaaagaatctatgactaagttctgaaaagcaattgcaacaaaaacaaaaattgacaagtgggacctaattaaactcaagagcttctgcacagcagaagaaactgtcagcagagtaaacagacaacctacagaatgggagaaaatatttgcaaatatgcctctgacaaaggtctaatatttagaatccataaggaatgtaaaaagttggacaaactaaaaacaaataaccccattaaaactaggcaaaagacgtgaacagacacttctcaaaagaagacatataagtgaccaataaacacatgaaaaaatgctcaaaatcgctcttagtcagagaaatgcaaatcaaaaccacaatgagacaccatgtcacaccagtcagaatggctgttattaaaaactcaaaaagccacagatgctagtgaggctgtggagaaaagggaatgcttataaactgttagtgggaatgtaaattagttcaaccactgggcaaagtgctttgacggtttctcaaagaacttaaaatggaactaccttgctccccagcaatcctattactaggtatatagccaaaagaaaataagtcattctcccagaaagtcatatgcacccacatgttcatcccagcactattggtaatagcaaagacatggaaacaacctaggtgcccatcaaaggtggattggataaagaaagtataatatatattatctacgctatggaatactacacagccataaaaagaattaaatgttgtcctttgcaacaacgtgggtgccgctggaggccattatcctaagttgattagtgcagtaacagaaaaccaaataccacatgttctcacttgcaagtgggagctaaccattggatacttatggatataaagaaggcaacaatagaaactggggactactaaaggatggaggggttcaagttttgaaaaacgattgggtactatgctcagtacctgtgtgagaggatcgttaaaaccccaaacctgagcctcacgcaatatacccaggtaacaaacccacacgtgtagcccctgaatctaacataaaagttgaaaaaaatgacataaaattaaaaaataattttgatacagaaaagaacatctgggaatggaatatatttgcttttaatatatatctacaaaagtaagcaatgatctctggtaaagtcatgaggcacggtatccttactggctgggataagagcatgcatcagaaaacaccaacatccaaaacatccaagctcaaaacactaatttatagccatctagatgcttttatattcagaattattatagaaagaaagcctaactgaaatcaggtgttctacatgcttttcattcaccagtgaaattagtccaaatagtgtgagactgaaaccagggatatcagctttcatcatcctgggaaagctcgtgctgcttcatttccttccacttcttgctttccagtcaggtctctggttagcagtccatgcagcccataattatgaccaggggtactaagcatgactttttcactttcaataggcctgcactttacagcaagtagttctgagattattatccaaaaatatctaataaccttatacttggaccaatgggcttgtggaataatttgggttcagataaaactacttcttctatctaaccatatgtcagaatacatagcccaccaaaatctttctaactctctgaatccctatggagagtaacacatagtttagcacttaatctttctctaattatttcctacatgctaattttatctccacaactgaaaagtaaattccctgtgtgcagtaacatgccctaatctttatgaggcagtaccataaacagtgttgagcatatttgatgcctgtttaataaatagttgtttatgattatccgatattaagacttagactcctgattgggagctgctttcagttaacataatacagaaatgaaacctcatgtcttttaggaaacatttctagattcctctccagcctcctctgaattactttaacgcttgatttgaatgactaaaactggaacatctttagaaggaaactagagttgtaaatccctgggaatgacttagggtaaataaacaaagacataactcaggtccagaggccaaaaactcagagttcatgttttcaaatattggccagtctgtctttcatacagctgtgtcagctaattgcccaatagcaacctttttgtttgaccatagcaatctgttcgtttctctctctctctctctctctctctctctctctcagcatttactgatgactgtaagtatctttaggtatatttatcttttctctgagtctgcagggtcccttatgatactcagtaactgtgctctcttctccattgcattcttattgctgagtataatgcccagcacttagtaggtgtttaatatatacgttggaagaatgaataattggatggatgaatggatggatgagagatgaaaatactgcctaatgaaagaaggtatcccatcttattaaaataagtagccctccttccttggattgtctggtgttctaaagcgttttttaaaagacatatatgagattaaacctaatctaggctctctccctgtgcgaacacaataattgaaacacatgactttagagaacaaaatgtgacttgactagctgtctgaatcatttcagggtggcatttaatatctttttaaacaaaagacatatatatatatatataactcaacagtcatttaactttctctgtttctcaattctcttatctctaaaatgatgataatatttgcttctttgtacctgtttcgtagttgaattaaaattttgacccctgccatatgattctgcagcccttccacatctttctgcagatactgacataaggtagagaggtcagggaaaggaccattgtagtgacctagtgaggtgtcagcaatgggacgataaggagtagacaatgtaagaaattcatgccagagtgtgggggtgggaatctatagaacttaatgcagatctcaaaggaaacagaagagtccaaatgattaacattgggtttcaaaatccacaccaaaaaaagattttaaaagttgattctttgttcacatgtctcatatatgcttatacaatagcagcattcaaaagtattttgagtcttatagttacatagatatttttacctaaatttctcctgtagcaagggttcagggactttgttaattttatactttttagcttgtcacccagccctttgtttcctctctctggatgtgcagaaagattttaaaatctatccctgccaaacaattctctttcgtgggaatttggtttaaaccagttctgttgctatggtacctagttttcagttaatggaaaaatacaaaaccaaaataatactgaatttgcagtatatatgtccccactcattgcatatcgacttattcatgttgattggattcgtaaacgatcaaaagttgctcagtgctataaaaaaagtatctaacctacttagaattcacatactgacacttatacctttcaagtgttgtgtgtatctgtgtgcatataaatggtagaagagatggcatggagcagtaagagtttttggaggtgaagaaacctgacattgaatttcagcttagccagctaaaagctaattgactttggacaatcacttattgctctggaccttttttccaatctacagagtgggtattcgtaatataactacttttcaggaatgttattaaaattaaagcaatatgttttaattgcctagaacaatgcctggtacttagcaggtttgcagaagcctactagtgttttcaaatgtggagatgatgtgtgtgtgtgtgtgtgtgtgtgtgtatgtgtgtgtgtttgtgtgcatttgtgtgatagggtgaattgtaaccccttaagactcaaatattgaagccctacccccaatacctcagaatgtgactgtatttggagagattgcttttaaagaggtaattacgttaaaaatgaggtccttaggttaggctctaattcagtctgactgtcatccttataagaagatgaaattaggatacttggaggaagcaccaggaggaggcatgcacccaggagagaccatataaagacacaacagaaaggggaccatctgcaagtcaaggagagaggccttagaggaaaccaaacttgctggcaccttgatattggactcctagcctccagaactatgagaaatttccattgcttaagccactcagtctgttgtactttgttactgcagccctggaaaactaatcctatctatctatctatctatctatctatctatctatctatctatctatctatctatctatctattggacaacaaatgttcgtaaaatagaagtgaaaataacatgctagttttcctgagtctttttctcttcatttactgcctccagtgtatagtttgttattatttactttttactaataccttacatggtataaagaaacacaagtcttaaatgtatatcccaatgaatttttgcatatgtgcacatccatgcatccactacccaaatcaagacttagagcattccttgttccctagcagcctctctcatgctcctccaggtaaagagccattcctcttccccacagtaaatacttgtgacttcttgtgttttatatattttgaacttcatataaatgagtcatacatcactcttttgattctggcttctttcacatagcgtcatgtatgtgaaatccattcattttgctctgcgttaaatgttcactttattcattgctgagagcagtattccattgtatgtacatcctccaatttatttattcattttggtgtcgagcatttttgtagtttccattatttataattatgaataaagttgctatgaacattcttgtaactatttttggtggacaaaaccactcttttctcttgggtaagaagtacatgggaattctataaaatgtttctatcttaatgttacttacaggataaagtctatttttctcccttctgagtattgctttttaatctccctactagaaattctcagtgcttcttaacccggggcaggcatttttgctccccaggggatatttggcaatgtctggagacacttttggttgtgacatcttcggggaggatgctactggtagtgggtaaaggccaggattgcagcaatatcctccaatgtgcaggacagccaccaccaacaaagtcaattatctggccccaaatgtcaatagtgctgctgttgagaaaccctgtatctagaccaatagaatttaattttgtatttttactgagtaggtattcattgcttgaccaacccacatattctttctgatacatcttttttagaacccttaggaagaaagagtaatggcagcagcattttccacccttttctattggggttattaattctcaaaaactatacagcctgactttagtgagttcaaggcatcagagcttgtctttatcaataaatatttccagaaaagggaaatagcatgtgtcctttttaagatggtgatgttgcattctgcgaagaaatatatatataaatatgacataaaaatatacatacatatattgcaaatgccatttctttgcctctatttagaaccagctaagatagccaggcacatggatacttgttctatttcaaaatgtctacagaagattcttgaaattcttcctgtcatttttcccagtctctaaaaactgtgatcaatccattcccctgaccgcatgtcatccattgttttctcaggcaacctcttctcaccttcagagtaactgaaggtatattatattcactttagttatcagaagtacctaaaagaaaaaaatgatcaagttatttccatttccatgagcctgagccttctcctctcccatattcctgccagttcttgcttttgaaaactgagcttaagggcaatattgtaacttgcactttttgctgattttatatcattcatctagctataggtctgacagaggtgattacttagctctccaaataggcaatgatgtgattgccttcatttatttcagtgacattgaaatggaggaatgatatttgttggctttgggctttaaagacatgtggtctgctatatttttggctgacagctggaactagtagtgcctgacactagaaaaccaaaaaagtcagcatttgcccttttcattttgaaaattgaaaatcacaggtaattaatcatattaaatgtgaatgtaacccatttcattgctataaaatcacctcttcaattaaaatttttttataaataattatatttgtgcagcttttagcatactaactttttcgtgagttgttttgtaacttacatattaatatgttttaactctgcttccttaactgcattactcattgttattgatatttgatgtctaaggtccgtgatgcccaaagtcttactatgtttgggagagtcttataaaatgaaggactgtctatattaaaataacaatgagaacctcattgatgataagtgatgtaaaaagagagaataactaatttttcaaaatgattctcaaagaaaaaggtactttctatgattatagaatcatggaaaaatgctggaaaagcttagttctacacttaagctcttgggaaatattttatttaagctgataaccaatattatagagaaatgacaattttggcctattttaaaaatactttcatcttcggtagcattatctaaactctaaatctataatatgtcattggaaagaaaagggttccgtgctttcttaaagacaatttgcattttagtaaagagcactatatcaatcagttcactaaataaggttccaaatatgaagaaaagcaagcataacgtgaagccataacagtcattgtttttaattgtgatcaataatctgtgtcgagaacaagtttttgttaattctagaaaaaagatatgacagacaagttgtccttaaacataagagaaacaagatcgatttcatattcactgtcactgtgggtgacattcttctgaataagatttcaaaataaatgctgcaaaatttcaggataaaaaatagaacattagcattaatcatattcatgctcacttctctattttctccacctttgccttctacagtcttcagctatacaggtgatacgcttgttccatttcaagtcaaatgacaccattagttaattagtgttgcaagtctggcaaatgagatctgaaacgaaacacctgtcctttgaccctaacttgttccttgcttatgcaaatgaagagagcagtttaagcattttaaatgttttatttctcgtattatgctgcaggttttatgctgacaaggaacacttaatgtgtgtgaaactagttctgatcatctggtttcagctttttatttattgaatggattttcagtgctgtcattttctttttacctgaagatcacataaaggttgcacaggtttacgtttgcgcataaggaccagtttggttttaagtttagctgtttgagtaacttcatgaaataaattagaaatatatctgttaaatttacccatatgttaaaatagcttttcggtttatgcattatgactattgcaatatgccacactaatatatgaacatttctataactaatatatgtttttaaaatagaaaattaaacgtgaaaggttttttatgaaatatatttatcagcatgaatctttactcactgagcaccatttaataagcatactgattgtaatgattgcattttctccactaaagttctcaataacaacccttggatataaaaataaattcactttcgttattttaaagcaagtcaacaaaataaaattattttggataaattgtataactgaattttcataatgatttatctcagtaagaatagaaaatattattactgtgcagataaggtggcaatggaaatccaatgagaaataaaggctatgaacattgaatgcaatattgttatctgtttgccttgattcatcaaggggtttccaaaatgtttttacaaagttcttattttcaataaatcacatcataaataaaacctcattaacatgaatagagggttattgccttgaaaactgtctattggaattcttggcgggaaagtgagactagtagttatttatttatgtataggtttttctttgcatatacagtagtctctcctggtccctggtttctctttctgtggtttcagttacctgaagtcaactataatctgaaatattaagtggaaaattacagaaatgatttctaaaatgtaaattgcacatcattgtgagtagcatgataaaatcttgcattgtcctgcttgtcctacccgggacataaatcatctctctgtctagtcaccatattcaagctgtacatgctacccactctttcatcatttagtagccttcatggtatcacagtgcttttgttcaaatgaccctttttttacttcataatggcctcaaagcacaagtacagtgatgccggcatactgttgtaattgatctattttattattagttatcgttgttaatatcttactgtgcctgatttataaatttgattttatcatatgtacatatgtataggaaaaacatagtatatataggcttcaatactgtctgcagtttcaggcattgactgggggtcttggaacatatatcctgtgaatagggagggactactgtgttttatggaaaaatggaaattatttttattagaaaagttttaacaaaaggagagcagagcaaatatttcctgtaacagtgggaaacttgttttgttatgcatatggctttctaggtagaaagaatgcttttggggaattttaaataagttgggatgaaaacttgacttctttaactctaaaagatgctttgaagttttagtttttagtttttgtaatgccaatcgtgtaagataaacaactttgaaaccccatatttcagcttatcaaaaatatttaaaatgttcaatcccaccatttaagaattattatatacagaagtatgcattatacagtaattcctactgggaagcttagagcctttagatatttccctctcttaaagagtgggagaaattccaagttataattttttagtattacatatttcagtgtcaaaaaattctcatgaacaactaaatgtacagaattctctttgatataccaagatatgattttacaacttcttttaatgtaatacattttagtgtctaaaaagcatcactaatttaattttagaaattcttttcttttcttttcttttcttttttttgagatggattctcactctgtcgcccaggctggagtgcagtggcgggatctcggctcactgcaagctccgcctcccgggttcacgccattctcctgcctcagcctcccgagtagctgggactacaggcgcccgccaccacgcccggctaattcttttttgtatttttagtagagacggggtttcaccgtggtcttgatctgacctcgtgatccgcccgcctcggcctcccaaagtgctaggattgcaggcgtgagccactgcgcccggcctaattttagaaattctactcaatccaagtaaagtatatgtattccagacctctgccctattaaaaatggagaatcatattcccaattaaaaaaattataagcacaaaggtttctttaaaaatccttaacttttttttttctgttgacttcttcacttaactaaataaataccaattaaaagtttgctctcatggcattgtacagttgatggaagtgggtcaaatgagtgggagctattttactggtccagggaaaagatgatgatcacttaaatttagatggtgcaaaaggaaaacaagaaaagtgcacagattttgtttgtgggtgattgtttttactgtggtaaataatcgcataacataaaatgtaccatttttgccatttccaagtttacagttcagtggtataaagaatattcacatggttgtacaaccattactaccgtcatatcttcaaaactgaaactctgcacccattcaacgtcttcccacttccactccttctagccccaggcaacaaccattctattttctgtctctatgaatttgatttctgtcggtacctcatacaagtggaattatacactatttgtctttttgggtactggcatattttacttatcataatgtcttcaaggcccatgcatgttgtagcatgtatcagatttgcttctttttgaagctgaacaatattccattgcgtatatatacaacattttgttcacccattcatccataaatgagcccttgggttgtttccatgtcttggctattgtgaatagtgctactaggaccgtgggagtagtggacagagttgaaatatattttgttacgtgctgatgaattgaatatgaagactaataaattgtcagaaatacctatccaaaagtatagaatatgatttaaaatttttttcttctgaatatcatatgatcttttaggatactaactattacataatggaagctcaataaatataattttataaattagtccatgaaaggcatctttaaaaactgctttaaatgtctgttaatccgttagggtatcaattttattggccttatttctgcagtttcaaatttgctttatttaattttctcattaaaattgtttatatttaaggtatatagcatgatgttttgatattcatgtacgtaatgaactgattactacaatcaagctcattaatatattcatctctttaaaagatgctttcttggggttcaaaaaccggtaccccacaatatggcactttgacatgttggactaaagaaacattctcaaggtctctctttcaccccaccccacccctcccagcatctctcaaccttctgtctctctcaaagcacaggatgaaggttttctctgaagttcccttatcagcctgaagcctggacccaccaaagaagaaaacagttacctctggtcccttccctgagtttcattaacttaacacatattgcaggaagaaagacaagtctgtcagcacacctggacagactttcaaaaaactatcgtcttctatttcattcccattcaggatttcaaagagaatcatttaccagctattgtctgctctgcaggcccaataggctttgttccaggccattgtatgttttccaggttcactcattttcccttaaaaatatttactatccctcaaattgccacatttcctccacctcccctccccttatgaagaagaatatataaacatttttaccccactgtgttgttgggtcattctcctgtgattcccctttgccatgcacattaaaatacattttatatgccatttctcctattaatatgccttttgtcagttaattttcagcaaaccttcacaggtgaagggtcaatattacccttggcccctacagttttaacttatttttcaggagacgcacatttgtttttttgtgcatgggtacgtaggtttctgtgatgattttactaactaaatgggacaactatatcgttacataccatggtttcactcattcttttaaaattatttttactactctagttaaatataaataccataaaatttgttattttaaccattttaaaatgtatacttcggtggcattagatacattcacattgttgtgcaacagtttcactcgttttaccaaattgaatgttttgtctactggccaggatttattgattgttgtaatgaaaatcttttcactcatagtttagcaatccttttgtaaatgccctaaatctgtatttattgtataattaaataccttagcaaatacttttaaactgaaaatcccggtgtactaagttcattcatgtttttcactctcctttttttttttttttttttttttttgcatttcagtttggcaagtttctattgattaagtgtcaatagacttttcttggttgtgtcaagcctactgatgagctcatcaaaggcattctttatttctgtcataatgtatttgatctctagcatttccttttgagtctttcttagagcctctatctccttttaattactcatttgttcttgaatcttgcctactttttcctatagccatcaacacattaatcacacttattttaaattctctagtaattccaacatcaatgtcatacctgagtctgattctgatgctcgctttgtcttttcagacaatgttttatctttcttttttgtgtgccttgcactttttgttgaaagccagacattttgtcttgggtcataggagctgaataggcctttagtgttaggatttatgttaatatggctaggagttgggctgtatttaatgatttctgtagctgttaggtgcccatggcttccgtttcctctagtgtgtttgtttttagcttcccagttttcttttgtcttccctaagaagtttttctcagatagagtctgtaacttttggttctttcagctgtaatccactgtcattatactggggccccgttagtttggttgtagagtgttgaggagaggaagcattctatcatcataaattaaatcacagtcttttagtgggcctgtgtccctggactgtgaaacacactcataaacgtttcttagctttttgcttcccctcttaggtgagacaggaaaaccagagggagctggagttgggaaaatattcttctttcagatgggataaggctctgataaagctttttcctcctggaaaataggactgtattatggagaacactcatactctgggcatagttcacaatgttttctcatcctgtccccctgccagaaccaccagaggatcaatcttggctcttcactgtgagaacaggaggggtggggttcttagaggtaaagtacagataactgtagaggccaccaggaaatttctgactctcatactaatccacattcagtttccagcaattcataaaaattacggtttaaggattcttacaagtttatggatccagtggccttttttttttttttattcgagggaaactaattgctgctttgactctgtatttgcctgtatctctgcatttcagtgtggaagtttgctttgtgacctcaattttctgatggatccaagaaaagtcaatgatttttagtttctttggctttttcttgtaagcatgacttcctagctctttacatgttggagctcttgggtggccttttaaactactaactagtagaatggaatgcagtaaaaccaacaaaaacgatggaacaacagagcctggaccattaatcgcgccatccaatctagagtagaaaagacaatgtaagtaaggcaagtgaccttttaggtcctaaaagcaactttatcaccagcccctgtaaacttttaggaaaaaaagattcaaaattataataaataatattcatacatatttgagtgagatcaatgatctggcttcttaaattcttcatggaatatcaattttgacatttctttggctcatttccacagtggctgaatctgttctcagtcagaaaggaaactcgtattttcttttttcaaactttgtaattttccaactttctaatgaaacattgtaggccttcattagaaagattacctcagactaacttactgctagccatgtccttcaacagtgcacctaagataatttattgaagtatcttctctcagatggcaaatgtttcttcattcactctcttagcattttaagttccacagtaggagctatgtaagtctcctaaagcccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaagcccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttataacactgaaacctacctgtgtgcacatctgtctctttcagttctttaaatggtatgagaacatgttaagattagctctataatgagtcatttctgcatccctcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggaggctgcagtgagctgagatcgtgccactgcactccagcctgggcaacaaagcaagactctgcctcaaaaaaaaaaaaaaaagaaaatcatagtttaagatcaaagttgaatgtatattgtgatgagtctacagtgtgggaacaactttttgaaaagtgtaataggtttgagaaaaatggcttaatttaaaatatgtattttctattatatgtgcatgatttttatgaagatatattctcagaattctttaaattagtggttctcaattcagtctatgtatcagaattgcttgtgaagctttcaattaatacatatggatacctaaacctaacccttgattctgattcatttagtctggagaaaggttggacattttttagcaactttgtttttgatttaggattgaatatcactgccccaggattatgaagaaattcatcatcatcctaaaaatattatagtacttcagccctttattatagtcatttttccataagtggcaaataataagaatccaaagaaacatgttgtgtatgcgtggggccatctcgatacagctgatgacaattaagttgttggctgtctggttttaaagatatttggaaagacaattccttttataagaaaaccaaacaaattccagccaatgaatggtcttaggcggtcaagaattttattctggcttactgacatcctcaagatctcaagacacagattagactatgagaagacacagtaaaatactccatctttattcttagagattctattctgaatcccacttttttcagttttattgagatgtagtgacaaaaaattgtatgtatttaaagtgtacaacacgatgtttcgatgtaagcatacattgtgaagtgattgccataatcaagccaattaacatattgatcatcttacatagtagccatattttgtgtgtgtgtggtgagaacacttaagatctattttcttagcaaatttcaggtgcacaatacagtattattaactatagttactagctgtacattaaattgagataacttattcatactgcatcactgaaactttgtacactttgatcaacatctccccattttccctactctcagccactggtaacctccattctactttctgctcttaggagttttaatttttagattccagatataagtgagattatgcagtgtttgtttttctatgtttggcttattttacttagcataatgtcttccaggttaatctgtgttgtcacaaatggcatgatatccttttttttaaaaaaaaatgctaaataatattttattgtgtgtgtgcatgtgtgtgtatatatatcattttctttacgcatttatctgtgaatgacacttctattgtttatgtatatttgctgttgtgaataatactgtaatgaacatgggagtgcagatatctctcccaatcactgatctcatttcctttggatatacacccagaagtaagatgctgaatcatatgataattctattttttcattttttgaggaacctccattatgttttttgtaatagttgtacaaattttcattcccaccatcagtgcacagaggtctctattctccacatccttgccaatacttcttctcttttcacatttgataatagccattgtaacagttgtgcagtgatatctcattgtggttttatttgcatttctctgatgattagtgatattgagcaccttttcatctacctgttgatcacttgtatgtcttcttttgagaaacatatattaaattctttagccaattttaagtaggcttatttgttgttgttgtttgctattgagttgtttgagttccatatatatttggatattaaccttttatcagatgcatggtttggaaataaatttttcctgtttcataggtagtctcttcactctgctaattgtttcctttgctatgcagaaacattttagtttcacacaatcccacctgtttatttttgctcatgttgcctatatttttggagttatgtccaaaaagtaattacccagaccaatgtcaaaaagcatttcccttatgttttcttccagtagttttaaagcttcaggtattaagtatttaatcaattttgagttggttgttgtatgtggtgtaagataagggtccaattttatttttttgagtgtggatatacaattttcccagcatcacttgttgaacagactgccctttccccattgtttcttagcatgcttgttgaagatcagttgactataaatatgtggatttattgctgagatctttattgtgtttcattgctctgtatgtctgtttttatgtcagtatcatactgttttgtttactatagccttgtagtgtattttgagatcaggaaatgtgatgcctccaagtttgttcttgctcaaggttattatggctattcaaagtcctttgtagttacatatgaatttggggaaatgctattgcaaatttgataggcattacattaaatctgtatgtggctttaggtagtatggacatttcaacaatattaattcttccaattgatgaacatggaatatctttccacttatttgcgtccctggaatagatccaactcagtcatgttttaatttgctggtaaattcagtttgctagtattctgttgtggaattttgcatctatgttcattaggaattttggcctgtacctttcttttcttgtagtgtatttctctggcttttgtatcagggtaaggctggccttgtgaaatgattttgtaagtattacccgcttttcaagtttttggaaaagttaacattaacaaaaaattggcattaattcttctttaaaagtttggtagaattccgcagtgaagccatttgatcctgggcttttctttattggaaggtttactttattactgattcagtctccttacttgttagtgttctgctcagattctgtatttcttaatgattcagtcttggtaggctatatgcttttaggaatttattcattccttctgttagacagtctactttgtgatttgacaatgtattttcagtagtatgctttgattcctttctcttagattttgtgtatctactaattttttttttcattgtggttaccatgaggtttacataaaacatctaatagttagttatgtctattttaagctgacaacttaattttgactttgtacaaaagctctatacttttatttccacctttcacattttatgtaattgatgtgacaatttatatctttttatatcatatattcattaagaaattattaaggctctagttatttttaaaacttttctcttttaacttttatattggagttacaagtgacttatgcaccactattacagtattattctgaatttggctatgtacttacctttaccagtgagttttatatttttatatgtcttgatgttactaacaagtgtccttttatttatatttgaataagtatttttcgcatttcttgtaaggcaggtgttgtgatgatgaactccctcagcttttgtttatcttacaaagtctatctcctcttcatttctgaagaattgctttgctggcatagtattcttggttgacatttttttcctcttgtactccggatatataatcccattctcttatggcctggaaggtttctgctgagaaatctgctgatagccttataaagaatccctagtatgtgatgaatcatttccccttattactttcaaaattctttgacttttgataatttgattataatgtcttgatgtaatctttgagtttttgtatttgtgtacttttgagcttcatgaatctaaatatctatatctatctcaatatttgggaagttttcaacaattatttctttaaataaactttctgcccctttctatatctttctggaactcccgtagtgaatgtatcggttctcttcatgggaagctctaaattctgtaggccttctgtactattttttatttctatgtttgtttctcctctgactgtgtaatttcaaataatctttcttaagttcttatatattttcttctgctttatcacgtctgctatttatgctgttcattgtattcattatattcttcagctccagaatttctatttggttctttttttatgatttccatattcattgaactttttttgtgaattgtttttctgattttgttcatttgcctatctgtgttagtttgtacctcactgagctttttgtaaagagttactttgaattatttgtcaggcagttcttagatctttatttatttggtgtcagttactaccaaaattgtgagttgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctatctatctatctaatctatctgtctatctatctatctatctatctaatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttactaaaaaaaaaaaacacaaacatttagagtcgctaaaaatctcaaaagaacacaactagtgagtgtgtaaaagaaattctagtcaatatgtataaaacaaaagatcactattcggaatatgcagatacctcttatttattaataatgaacaaatgacctaatagaaaaatggagaaaatatttaagcagataatcaaagcagccaataagcacatgtagtttttcagcttcactgttaatcatgaaaatgtcaattaaatatatatgtactattttctactcaccagattgcgtaaattctaaattgtcagacaattgaaaggttgatgaaaaatggctacaattttgcatattgattaaatctaaaaactaatcacccagaaattaaaacttttggtatttacccttgagaaatactaatacatgtatataaaaagacgtgcacagagatattatttatttttatggttgtttgtggtagggaaaaattaacatcaaaacaaacataaaggccatcaaaatggagtaaataaataaaatgtggtaagacatgtaatgaagaaatactattctgaaattaaatgaaatgcactaaatgtatgtttcaatatgtggggaaattttttgttgttgttttttttttttgagacggagtctcgctctgtcgcccaggctagagtgcagcgtcgcgatttcggctcactgcaagctctgcctcccgggttcacgccattctcctgcctcagcctcccgagtagctgggactacaggcgtccgccaccacacccggctaattttttgtagagacggggtttcaccgtgttagccaggatggtctcgatctcctgacctcgtgatccacccaccttggcctcccaaagtgctgggattacaggtgcgagccaccgcgcccggcccatgtggggaaatttaaaaaagatagtgagtaaatgatatgaaatatttatgtaaactaaagcacagcctttctgtagccagctaggtggtccgcacctataatcccagttatttgggaggctgagaccagaagataacttgagtctaggagtttgaagccaccttgggcaacatagtgaaactccatctcataaaaaaaaaattaaaacacaaaataacactagataatttgattggctacatattcatatgttcagaagtttgaaaactaattgagggataaatagcaaatttctaatagtgtttacaccagtgtagacgaggagtggatcatcaaaggaggtgaggatagaagagagcctggctagatgagtgatatctctaattattttctgtcgaaatatacctgtattcatattttcagtagtttgtgaagtatgcacatggggggaaatgtgtttatgagtaaactaaataaagtataaaaagtggttaattctggaagctagcaatataggttattaatattatttcttttttatgtgttttctaagtttgtaaatattttatcaggataattataccaaaaaaagtagttttaaaaaacagtgcagcagattaacttcagaacatacagagccactgggcaaattcctgagcagaggaatttatatcaaaagcaggatacagaggcaaagagatcttaaaaagacagttaagagatgagtatagcttttgaagctccaacatagatctaactgattattcataagaaattaataaagagaataaaaagaaggaatatttgaattgataatgtcaaataatttttcagaactgaaaaataagagtagagtccactgtttaaaagtatgcattgaatgcccagtatgataagtaaaaataaatccacctatagaaatcaaggttaatgagaacatcttattagataccagaaagaaaagacagactacctacaaaaaaaaaaagacaattagaatgacaccaagcttctcgttagcaaggagagatgccagaaaacaactgaggataaaatatttcaaccttaaattctatgcctacctaaacaattgttaagaagacaaaataaataaattttctgatgttgactaactaagacaacttctgtccataaatttagtggagaggaaggttttttaaagcaccagcaaatgtgaaaccaaaagacaaaaataggattcatgtaacaatgcattttttcttcctcctctcgaaaagaagttaaaacttctatattacagtcaattgaatttccagtaattttccttttgagaacaaataaagtaaggaaaatctttacattttgcctcctgtttcttgataaaatgttaggaaaagtcaaaataagtcgaatatttgatgaaattgatgcagttcatgtcagtatgcagtaattggaagccttggaaccctatgtaggctgacatagaaagcaatgtaaaaatggcacgtgaattttctttcttctttctaaaaagaagagctagatttttagataggaatacaaatgcttcatttgttcataggttatcaagattttctttcatttgaagttttgtttggcagacatcttcctttgaaaatgggagacttgtggaggtttcaaagggacttgtgaggaaaaagttttggacagaaccagaaactggctggattgagagacaacatttttatacaaatgcacattgaaagggaatgaaataacccttaattccaacatgatctgtttcagattactaaaggaaatatattatattgtatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcattagattatttatgtactagataattaattcagtttaatataagaataatgaaatagattaaaagagagccatgcatgggttaatgatattaaaatgtcacaaacgaataattataccaattgtgtacacaggagctttttgagaaaaaagtagcggattttatgttctgttgaaaactgtaaagttctatataaatgttatttcaacagcattgaaatggtgattttctgagaaaattttctgtactagtttaactaaattatacatggagatcaaatgaattctcaagtgggcctatttattttgaatcaggaattatataaaatatggaggacattattaagaaaaatagcatttaagactaggcctaattaatattttcaatgagggtaatttcataggattgaagagagaataggatttttataactgaatatggtataatagagaccaagagttttctggtcattcattaccaagaaaattttaattatgtggaaaaaagcaaaagaacaagaaagtcaagaggatctgaagcagagtatttatccagcccagtgtcacttgattaaaatagagatgttgtagtcctttagaatgtccatagagacaactgaaactgacctttaaaaagtgttgactataggttttgttgttactgagctttgatagccactttaaatcccttctgatgcaatttatgccctcccttctttatcaaaaaggaaaaaaattgtttagtagataatatggaaatatgcctcatttctctacagtctagcaccactgaactagaaaatataaggcatttatattttctagtttggtgatttcgaccattgaagtgttcttcattccacgctttggaatggaaacttgaaaatgatgtaggaatatagtataaacattctgactagagtatgattgaaaaaaatgtaactagagtggttttctcttttctgtagactgttctttcagtgcacctcttaatatgattatggctccaatctcagagagcctgagaaacttgcccaagtccacatggctagaacataacatgattcattcagggtatattaacaataaggtttattttcgggttaagaataagaaaatgccttatattttttgagtgttcgtttaaagtccacagtcaaaaaatattatatgacttcatcaaggcctaactctcttcactttatcacattgcttcaacaatagactgttaaggcagtggaataatctgggatgattaattttcttgtaatcattgaggaccatgaataaaattgcaaaaaaaaaaaacaactgccattttttccatttatatttttaattagaaagcaggcatttaatgagaaaaattcacgtttgccttgcaactacttatggtcgcgttaaaatgtctatcaatgtaggataaatggaaacatgttaagatttgattattaagctttgcttaattaatatatttccaggaaaatatcagactactgatttgggctacaaataacactgcctggttttttgtagccaggtagtgttatttgcagctgaaatcagtaagtttgtaatttagaacctgttagcctaataaatcatcatgtgttactatgaatatgtgaaggcatttaactaaagtctaagtatgatccatcatatggaaatacgtgaaggcatttccagtctttagtaaggacatggcaatgtcactatcatatagaacagtggaatggctattatttgcctcatcagacggatgcattcttaataaaagataaattagattgaacccataagcggatgtcaggaactgtgagatttacattttagaaacatttcctagaaatatcatgggaaaacttatcaaatggatttttattatcaaaaatagctgagaattgttcgtacatctacatatgctcatgttccttaattctaaatttgcttcagaaacaagtcagtaatttaaatgacaaataaaacattggaaaaatattttcaatgcatataagctaatttttattttaataccaatagacattacatgctttcttagaaaaagaactgaatgtgaaaacgaaacagtttaatctctgctctgatatcacgcatttcactggtgagtctactatttttttctcatacattactacttaaaagtatgggagtttgataaattcaacaaaataccttttattgtagccttaggtggcttcctttgttttctcagttaagaagaggacattaatgagtatgaaaacatctaagattgttgctttatttactaaatgctgggctgattaaatagtaagtctgccaaagatcacagccttgaacaaaaggcatagatgcatatcacagagtaccaggaggggattccattcctattccatttgagtctcccctgacaaatgatactgagcactacgttacattgattcacttgcccacaaaaggttgtgataagagtgtctaatctttatgcttgaattgccttattgtacttgtagaaatgaaagcagaagaaaatatatggaaaacagattgtgtatcttatttgtcttctgtccaaaggatacatttaaaataatttgtctagccaggcgcggtggctcacgcctgtaatcccagcactctgggaggccgaggcgggtggatcacgaggtcagcagatcgagaccatcctggctaatacagtgaaaccccgtctctaccaaaaaatacaaaaaattagccagacgtggtggcgggcgcctatagtcccagctactcaggaggctgaggcaggagaatggcgtgaacccaggaggtggagcttgcagtgagccgagatcgcgccactgcattccagcctgggtgacagagtgaagactccgtctcaaaataataataataataataatttgtctaaacagagttctttcttcagtgtgctcttcacattttaatgctgatttgaagcctgtaaccattaaaattaaaatggaaagattatactttaagagtagaatcctcaaatgcatatagaagtataaacctaatgccctttagcaaagtctaggaggcatcaagataagattagttcctagtagttactctttgttaattaactccctgaagaaacctgagaacatttgatattaaagaaaatatagtagttcattttcagatagattgaagttttccttgctcttctaatagatgtcttcctaatatagtttccataatctctaaatatcataccctgcttttattctcttgtatatttcccctcccatatataaagtatataatgtactgagaaacatagaaataattgcaatatacaatattcctagttacatttcagtaattgttttgtggcatacagttacatattctttctgggagagtgtgatgaaggatatagatgaaagattggtcatttcagtgccaaatcatcttagactttatgtcccttcctccctacaatgtcaccatcctctgtaacgcttttctcagaattgagactccctgaaggtcttagagtttaacgatgccctttttgtccattagtttatttaataaatgattattgagcaactatatggcaagtactgttcttgattgtaaaatctggcaaggacctttaaggtcctcccagggtcttttatcttataagttgtcaaaaaggcttagtagtaattattttatttgagttcacataaggatattacaaggttaagacttttatcgtgacaaaagtttttgtgttttatttttcgtgtctctagttatttttgtttcatttttattctcaaaccagttttgaatcaagggattttatttttgtccagcatttcactttaagacagttagagtttcttacaattcctgtgctcatgaatgaaaattaaagcatataatcattcaactaaagcgtattgcttgtcatcttaaaacctattttaggatgtgaagtattatttattgaaattttaagttagcagtgtttgacgtagtttgtatcagatactctccaaagtcattttctgattaatggagaccatttaaatatataaataactgatacagaatgaatagcactggctattacaatttctttgtctttaaattcacaggagaatggtgttgcctaagaattgttggcattttttaatgaaaatttgtttatacatttacataataaaattaaaaccctttttcaaaggcacttgacatttagaggcattgtttaaaaatattttccagcatcttctagattttacaccaagtgaatgttctgtttaaaaatggttctatggtcaaacaagtttatggaatgatgcctgcttattctccctgtagaaattcataatgcccatttctgtatcagaaaaatcttagagaatcttgcttatctttatgtttccctttagaaaatgaaaactatttcaaacattttattagtatgtagaaaatactatgacagcagaagtattttatcagtctttaaatttttcccaaatagcaatacattccagttgcatgcaaatgtaaataccttctctcaattgcctgaaattaatacattaaaataacagaaaaatagtgttatcttagtctgtttgggctgctataacaaaatactttagacttgtaatttacaaacaataggaatttatttctcacagttctagatgctgggaagtccaagatcaaggcaccagcaatatcagtgtctggtgagagctctctgcttcatagatggtggcttgttgctgtgtcctcacatcatggaaggacaaacaaactctctcaggcttcctttataagggcattaatcccattcaggagggttccaccctcatgatatagtcacttcacaaaggccccacctattaatacatttgggattgcatttcaacatataaatcattgagggacacaacattcagaccataacaagaataagcttggatttggaaagaatttgaaaaggaaagtaggaatacaattgactttcccaagttcataggtagtaacaaagaatgagcaataatcaagatgcctttgttcttatctttccccaactcaaataagttatatataaaaattcatttcttactaggtccattatacttgtctatctcttgaaaacttgagtgtcctaatgaaatgagacttctattttgtaagatgagagaaaggtgaggcaaatattctgaggcaccttctagactgcagagcaacatgcactgagttttttgaaagatttaccagttttaaaaaataaatgctgtcttgttcttcatcatcctcccatcactggcatatcttggtaaaagtgagatgttatcagtgagagccctttaggtagatcctcgtaaaagttaccattttgagaattgtatttatgattgttggtgtgttaacaaaatcatgttgcaagagaaatggacttttggctaactgcctagctctattatcctagaaactagttaaatggtatatgtcaactattttatgataaaaatgtcccccgtggatggatgagatgtatctaggttggaagaaccataaatacttgagaagaagtcacagctttgggtgttcctaggtgcagggactcttgatatggggcatatcccttgaaggtctttggaagctgtattagtccattctcacattgctataaagaactacctgagactgggtaatttataaagaaaagagatttaattgtctcatggttccacagactgtacaggaaacatggctggggaggcctcaggaaacttataatcatggtagaaggcgaaggggaaagcaaacatgtcctatgtggctggagcaggaggaagagagcaaagagcgaggtgctacacaaccagatctcctgagaacttactcactatcatgagaacagcaaggggaaaatctgcctccatgatcatgtctaaattgcatgtcagattgtaattcccaggcccttcctccaatactgggaattacaatttgacatgcaatttagacagtgacacaaatccaaaccataactttccgtccctggcccctcccaaatctcatgtccttctcacatggcaaaatacaagtatcccttctcaacagtcccccaagtcttaacttattccagcattaactcaaaagtccgcagtctgaagtctcatgtgagacaaggcgagtcccttctacctatgagcctgtaaaataaaaaacaagttagttaattccaagatacaatatgtcttggctattagcattcggctcctctttacttatgcaaatctctgcagccagcttgagtactccccagaaaacaggtttttcttttctaccacatgatcaggctgcaacttctccaaacttttaccctctgctacccttttaaatataagttccagtttcagatcatccctttgctcatgcatatgctgttagaagcagccaggcaacatcttgaatgctttgctgcttagaaatttcttccaccagatactctaaatcgtctctctcaagttcaaagttccacagatccctagagcaggggcacagtgctgacagtctctttgctgaagcataacaagagtgacctttgctccagttcccaataagttcctcatcttcatctgagaccacctcagcctgggtttcattgtccatatcactatcagcattttggtcacaacaatttaacaagtctctagaaagttccaatctttccctcagcttcccatcttcttctgagccctccaactgttccaccctctgtccattaaccagtcccgaagctgcttccaccttttcaggtatctttatagcaatgtcccatttcccagtaccacttttctgtattaatcagggttctccagagggacagaactaataggatatgtgtatatatcagaggaagtttattagggagaactggctcacatgaacccaagtcaaagtccccaaaagtctccaagctgggaaaacaaggaaatagtagtggctcagtccgagtccaaaaacctcaaaagcggggaagccagcagtgcagccttcagtctgtggctgaagggctgacagcccccagcaaatcactggtgtatgtccaagagcccaaaggccaaagaacctggagtctgatgtccaagggcagaagactccacaagccagcttatcccaccttcttctgcctgctttgttctagctgcactggcagccagttggatggtgcccacccacattgagggtggatctttctctcctattccactgactaaaatgtcaatctcctctggcaacaccctcacagacacactcagaaacaataccagctagctaggcattctgcaatccaatcaagttgccacctaatattaaccactacagaagctgtcagtggtgttgtcctgaatgacgttggcctgtacctgttagggtgatagctcttctaaatcagaacaatttccccatctcaataatgtggatctgtttccttgaacctaaactgtgtctctgagggtatagcttccagagggctgtgtgagctgtcatacacatgaaatgcagcaaggactcttatggagaggacctctatcacctgacgtagtttctgagaagactcatggcaacagcgcctatcatagttttgagtgtctgaatgtttaattaaatctacagtgaccccttggagggtgattgaatgatatttctctactctccaaatatgcaacttcgttcttaccctctgcatcatcatttataaaatagaaagactagagctggttttctccaggtgtggatctctgataatcctcagcagagtcacttgggatacagattctcaggtctcaaccaagagaaattaaatcaggatctttgaggttagggtcctgtaatcttcttttttaacaccttctcctccccatggtacttgaatacacagctggacaagatgctcattagtttattttctattttagcccttgaccttataattctaatgatttgttcctcccattctacataatgtcttaatgcaattcaaatctcatttcttcagaagaccatcaaggaataaataactgggagtttcagaaatggcaacagtttagggaaaatctctgtagttaagtcaggtttgagaaacccctggaacaatttgttgtaattgtatacttttttaaagatccttttggtcccctgtaatccttatgattattaaaacatacaggtccttagcaccatataacgattctgtttaaactgttggcttttcttttttttcaacatgctatcaccattgtcactgttgccttgactgtagggtagtgacttgctagaaggtcagagattatattaggtcttaccaaacaagtgaaaatcaatattttcactctctttaggagaatgagtttcatatatactcgagatgaaagaaaaattccctttgttgttctgctgaagttgtcaagccttccattagtctaggttaagtttctggggttatgaatttaattttggtttctaatattgatttatatttcataaagactttgttggttacaaaaaaaaaatcctcagtaaatttttctacttcaagggcagtgctttagtttagaaaaagatgtgtttctcagtgatttagtttccatttctggacttaacaataatgagtgaaacaggaaattttgctgtgaattatgaaaggttattatacagtatttccaagccactcaaaattatgcattcatcttaggctcttaaatttaacaaaactgaatgagattcaatactattttctctgttttatcaaaatgttattgaaagttgtttaagattttatactcctcgagggcacatatcttttgtcatctttgcattttcagtagtgtttttatactgcagataatttatgcacattttataaatgagtgaacaaatagatgttatgaaaaaaaagtactgttatcagattccaggataaagtaaaaagcaatatttagcaatcctccatatactacaatgccctacccaagcctgttaattccactcctcatcctcatcctgccacaaacattttcagaagtcctcagacatctctgctatattccctaacttgccccaaactcccgtgatccaaaagtaggcttccctttctcaattaaacttccctttcgctcagtaccccaatctgagcttgctatcctgcggagagttacctgggaaatgaagagatgcagctgtatgatatatatgaacaagtttacccttactggggagatttgtattttaaaagatggtgatggaaaactacagtgatatatacatgctaacttttcccaatgttcaaatttcaggtagtgggacatatggcaaaggtatttttcaatagcaacctaaagacctctcagggaggtgacctccttttctgcctccaagtattgctggttctgctataacctgatatgattttttatttatagagtgctttttataagttgccttcttcaggaaacataaaagagtgggaggggaaatgaataatctctcatgcttttgtatcagttattatcaactttggctgtacattagaatcacctggggagctttaaaaaaatccttgtgtccaggccatcctccaagccaattaaatcagaatctccagggatggagcccaggtatcagtatatataaagttcccaggtaattagattgtgaggcccactaatctaaatgaggatgaggaatgcagtagatctctgatgcttacagaagacaatagttataagaaaaagccatgtgagaaaaattggaaatggttgaccctttgggaactggagagcaaagacagtggctactgagctccaaccaagtgttgcaccatgggagggaaggagcaagatgattaagaggatcagccctagtggcagatcccctgaggttaaagtacttttctgcccttcactatgtgagtttgaatgagtgtcttctttgtacttgttttcttattagcaaagtgaggatgatgattatacctatctcttaaggttgttgtgaggattaaatgaaatcataagcataaatcacttagcattatgttgggcacgtaacaaacatattctacacttttgaactattttgttatgatgatcaactttgaaatactagagttcacttgtcttcttttcagtaggaagttggcttccaatctagggagagagaaggaagagaagcaagagctagggagatgataatcaaatggttctgagaatgatcttaaatttttaagatttttaaatttttaaaaaggctttctatccccttgttcccaccctcagccctcaagaatttcttactgtctttatttcctgccatttcttgttcttttataatcttgtacctctagtttcactatacatcaaaaagatgggaagtgatatgctaacataaatgggtgaatttgtagatgtatcagttgagattttgctgtgtagtaaactacctcagaacaaacaataattattttgtagcttaaaacaactattttgtttgtgcctcattaatgaatgggcaatttgggctgtgttctgctgggtggttgtttttatggccttactcatgtatcagtgtcagctgttggtcatcagggacactctttatttcaggatggactggctgaggctgggatgaaggggttgactgagccatgtgtccctcattatataactagttaaccttggcttatttacatgatggaaacagtttccaggagtggaagattggaagcttttaagatcaaggctgataaccagcactgcatacttctcccaatttcttttgggcataaaaaatcataaggctagcgcatatccaagggaaaagtaagatgagagttgcttcaaagcgttatggccattttttggtaatctttgacaataacctgttgaaataaagcaaatgggaggaaatgaggtcacagtgaggctgatagcattggacatataaaagtcatattatagataggctttggcagatgactgggtatgtgtggtgagagatagaaaaaaattagtggaagttgcagacttagtaattatgagaattgaactttgattaactaaaataggaaagccagaaggtgacaaagtagcacggaggcttacctatatattctcttacagaaaactttgtactgtattccttttctaaaattgcttttgttttttaataaccattttttcccaagggcaagatgtgttttaaaattcattagttaaggactcaaatgaccaattcgatttttctacttcttagttgactccttcatgaacttttggaataataataaaatgtataaatagtgtatgtactttatgctttaaatgaatattcctctaatatcaactccaaagcaggttattcaaagtatgaaaaccaacatatctaactctgtgctcagaccaagatttgtgtagcatctctagagaatctgagagaaatctatgagaataaaagacagtggcactgagacattatctttacatatgtgcttattgaatctgtatagaattcttctataaaaattatagacttttttgttacagatttgctctcatgaatttaattttatattgccttactcttatattgtcactttatataggccactagactgtgaaataaaatcagataaaggtagatgttttccaccactaccccttctccccaatttagtattcacaattattttgctatagcaagatggtctctcctttttactggtattttccctcagaaagtcttttttttttttttcactttgacgtgcattacgttaggtactttaaaaatagcatattttcctaaattaatagtctttaatattcatttataaatacccagcaccacttaacctagtgctttaaaaattgattattatttattattgccattacttaaaatgtgcttttaaataattaaatgactttttaatattcccctctctctctcactaacttgaatacattttaccagccttgatttgtggagatgtctccacatggatagctagctctactggacaggatagcttgtgttactagctcaggcataaataattatttacttttgttctcttacagtattttcctgatctgttactttgctacttccatattattgctgcataataaactatctaagtactcagtggtttccaataacaatccttaattctcactccgttatccgtggatcttctgggggttggctatctgtaaggggcttagctgagttagactctaagatgtaggttgagtctcggtctgtgtcatataactcattctctttaaacccatcataggtttgaacatggtatggtctaggaagatgactctgacagcactttttctctttgccaatttgaacgcagatgactagacatctcaatgtataagatgtgaaacaggaaacaacatgcaaatatacctttattgacttataacagatgacagcaattccattttcctctactattgcattttctactctatttgtgaatgtgagctttcctcatcaatttatagaatctctgtatgactcattctgtcttaatctaaaactgaaataactttatattgtggaaataaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctggattctattattgttgagatttttaaaaatgtgttttaattcctaacctagctttgcaggcacatcaaagctgagtgcatgtccttccgaaatcttccctggtatcctgtaatggacactgattttttttttaaatcttcgaattcttgtaacacttaaacattttggtgtgaggatagtaaaatcattaagaataggaagcatatctcttgctccttctgcaccctctcacagagattagggcagttctggctgtttaatattattgacaactccccagaaagatgaacacaataaactgttgattgagcacagccaagtttactagatcaactacagtaagagagagcaccatctgaatggagtcttggtaatgtgtcaaaatatgatatttttaagagtttcaagcccaggctgtataattttagggttggtcttgcaaaatgggtagttagttgaggcttgggctgagtttatgtcctaacaggtttgaatgggtgagaacaacactacaagaacccatgatatgattagtgatgggtaaggtattccagtatttttagtgcaagacgaggaaagcatgcatcttcccagaattgcttaacgtgggaaaacatagtggtatcagtttttaatatttgcttatggacaggtcattattacataatcctaaaaatgaaactgggtaaaccccaagttatatgtaggaggcatttctaaataacactcagaaattggaaactatgtaattaatcaattaattaattaatttttggtatacaaatatagctctattaaactaatgataaagatagcatctttttttttttatttttttatttttttatttttatttttattttttatttttttttatcatactttaagttttagggtacatgtgcacattgtgcaggttagttacatatgtatacatgtgccatactggtgcgctgcacccactaacgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaagatagcatcttaaaaggatacattgggcatcagattcaggaactagaggcagaaaatttatgggaaaggattgcaggcactcagaagtaattgtggcacaacaaagtgatctctgtgccatatcatttgtcctacagtgcatgctttctagtttcctttgccttgacttcatagtaacctcctagatagagtctaagattgctcctctggcactggtcccttgcttacttgtgcttggcctgtctgttgctgacttcatctcagacttcagcctacagccctgatccctgccttcagtccatatccttggtttggtaacttgtttatgcggtcttcccagtatgtaaccactgtccatactctgtccatatcactgctccaaggtggcttatggtactatatttccaaaagcctgctaaaggtcatcactacagcaattctcctttttctcccatcatcaattttctcttctctactgaatattcctgaaaacatacgaacagtccattgtttttcccattctaaaagaaagaaaacctttcttgactccaatttccattatatttaactccttattatctcttttccataattgcaatatgcctaaaatttcttcaatttctttaattaatttatctcctcccattcttacctgaatctaccccaatcaggccttcaactccaccgctttgctcaaagtgtactggtgaagttgagtcttgatttccatgttgctaaattcagtagtaattctcagtcttcatcttacttaaaattatccaggctggagtgcagtggcaagatcatggctcactgcagcatggacctcccaggctcaagtgatcctcccacctcagcctcatgaatagctaggattacacatgtgcaccaccatgcttggctggtattttttattttttgttgagatggggtctcactatgttgcccggtctagtcttggctcctggactcaagctatcatcccgccttggcctcccaaagtgttgggattacaggcatgagccatcatacctggcccatcctacttaaaatttcaagaacacttcacacacagctgatcaatctgttctctgtgaaacattttatcctcttagcttccaacataatcacttgcctgtttttccttctaggtatctaaatgctcattctcagatttgtttttcttactggtttctcttaatttcctcatcttcttttttaaactgtattttattgtgttgagaacacttaacatgagatctgccctcttaaaaacttttgaatgtacaatacagtattgttgactataggtacaatgttatacaacagatctttatcttatttaactgaaactttatgcatattgattagtaattcccatttatccccacctctatcccctggaaaccatcattccactctgattctatgaatttggctattttagatacttcatgtaagtggaacaattcattatttgtctttctgtgactggcttattttaattagcataatgtcctcaagtttcattcatgttgccatttattacacaatttccttctttttaaaaggtgtattccattgtatatatgtatcacatcctctttatccattcatctgttaatgcacatttaggttgtttccacatcttgctattgtaaataatgctgcgatgagcttggggtcattgatatactgatttccttttctttgaataaatacccagagttggattactggatcatacggtagttctattttcagtttcttgaggaaccttcaaactgttctccataacagctgtaccattttacattcccactaacagtgtgccagggtcctaatttctccacaaccttgccaacacttgttttctttctctatattaaccatcatgacaggtatgaggtgatgtcatatgtcattttgatatgcattttcctgatgattagtgacattgaacatttttctcacatacctgttggccatttgtatgtcttctttaaacatctgttcaagtctttagcccattttaaaaattagattactagtgtgtttttctgtttgtttgtttgtttgtttgctattgagttgtaggagttccttatgtattttggagattaactctttatcagataaatggcttgtaaatattttattccgtgctataagttgcctcttcattctcttgattgttttttgttgttgttgtcgtgtaggagcttttcaattttaagtagtccctcttgtttatttttggtttggttgcctatgcttttggtgtcatattcatgaagcaattggtaagattaatgcatgaaacttttcccctgtgtgttttcatagtagttttacagtttcaggtcttatatttaagtttttaattcattttgagtttatttttctgtatagtgtaaaacaaggatcccattttatgctttcatatgtggatatctagtttccccaatatcatttgttaaatagactgtcctttctccattgtgtattttcggtactcctgtcaaagatcaattggttgtatatacatggatttatttctgggttctctattctgttagattggcctatatggctgtctttatggcattaccatatcttttgaatactgtagatttgtaatatgttataaaatcaggaagtgtgaaacctctaacattttctttcaagactgatttcatcgtttatggtcttttatggttccatatgaattgtagaattttttttacctatttctgtaaaaatgccatggagattttgatatgaattgcattgaatctatagattgctttgggtagtatgaacgttttaacaatattaattcttccaatccatgaacacggatatctatttgtttgtgccttgcttattttttttaatagatgttttgcccttttcagtgtacaactcttttgcctccttaagtttattcctaagtattttgttgtttttggtgctaatgtaaatgggattattttattaatttcttctttagatattttgtttgttagtatatagaaacacagctaatttttgtgtgctgattttgaatcctgcaactttaccaaattcgtgttgtagcaggtttttggtggaatctttaagattttctttatataaaatgttgtcatttgctaatgggaacagtttttttctttcagatttggatgctttttgtttctttttgttgcctaattactctggccaggactttaaaaccatataatttagtctgcagacatcgttagccatgaaattcacaggtcttatgcaaagctgggactgctgaaagtgccatttgaattttaagaaacaacagaggagtttagtcagttattctttcatgtgttattgaaactcagttttgagtgccatctcaaaactaacagaataaaaagaatgtgggaaaattctgtatgtactcaatctcaactttcctccttgaaagttaatatttagtaaaatgtagtctgaaagaaggaagccactagaagtcatagaaacagagagtagaatggtggttaccaggggttgaggttgtgggcggggggttggggggcattggagtatgttggtcaaagggcacaaaatttcaattagataggaagagtaagtttaaacgatgtattgtataacatggtgactgtagttattaacaatattcttgaaaattgctcagagtagattttaagcattttcaatgcaaaaaataagtttgtgagttaatacatctgttaataacttgattagccattccacaatgtatatgtacttcaaaacatcatgttataactataaatataaacaacttgtatttctccatttaaaaaataataaataactatttatagaaaaggaaaccactgggctcccccttgcactattggtcttatctggggaaactgttagcaaaggcgaaataatatgccagatgttccaaatggatacgtgataccaacaggcttctgttagaaactatctcctgcctacaatccaccaactgcagtagtgcttttgtgtcctgcatgtgtactgtcgaatgccaaattatagctccattttccctcagcttttctctattcaaactattgcaggaagttcacttgtacattttgttttgttttatccacccagtgctactatttggctccaattctaccataagcacagatatatccccatgcactgaaatcttgtggcaatgcttacagtggttaatatttttggattatcttcaaaatgaaagcagcacactatttttaaattgttcttgagaaccctcaagcctcaatttgaaagatactgccctagagacctaacataaacatgattctctttttaacatgcaaacattcattccttcagtaaatatttattcagcacctactatgtgtcaggcattgtactttgcactggagattcaatgggaagcaacaatggataaggctgttgccctatgaatttatggtgtaatggataaggctttccttgaataagtcacaattataatgaaccaggcagctaaggacatgttcacatttttatgtagtatgaacagctgtagtacctcaaattgatagaagctatgagttatatgcaacttaaacttgaagtatttttaccactgaaatagtctagaagctgttcctgagagattaagttgttttgcattatcattaccttgtcatcatcagtggtatgtggatgtcatggttaaaagaggaaatataatttcggaatttgtggcttctcagtagagaacacatttaaggaatgatctctaaactactatactacgatggaagagagagttctaagaagtgaaagaggataacaagaagattattaggaggcaacaaagataggcttggcctctgttgatattttctagtgataagtgcctggggatcatctaggtgaagctctaggcgaatagtcagaagttgttgatgtctggtaagttatattaatgtaaaaccaggcaccagctgatttaaaacatacataattcaatagaacacttctatatgttaatcaataacatcaggtctgatcatttaggctacttgggttctatgttatttggagcaagccgtgctccagatcctacgagacaggtacactgaggatacctagcagagtccagctctgctactcctatggtccttgaatcatcctgatggacataattggtaggcatgttaagagtgccgaatcttaggccacatttatactaagtcagaacctgtattataacaagatccccaggtatttggaagaaccttaattaaagtttgagaagcacagatctagtaaactgactctctcttagatctactgataatgcattttccaagccattgattctcatatcaattttacctttttaactcattttatagcattctctgggcttatcatttttccctcattcaacatcactttttaagatccttcattcatactttcatgcattcaatgtattcatagttagcgagcatcttctatgtgtcagtcactgctctaggtgctagggatagaggagtaatccaaacaggccatatccctgactttatgaagattttagattatcatattttccatggcactcctattttcaggtattctttatgatctcagatcattgctcttgatttttggtataaaatgttatgtagcatgacagaataaagttgattatactgagattgaaggaacagaatgctttgagtcatcacagacttttgttacagtcctggatatactatagcctactagctatgtggtcttgggaaagttacttaatctcttcgactcaatttcctaaactgtgctattatatattaattagtaggataaaataaaataatatatattaaatgtctagtaggatatgtggcctaagagactttcaataaattggaggaagaacaactctggctgttcttgtattgctataaagaaacaacagaccaactaatttctaaagaaaagaggtttaattggctcacagttctgcgggctttacaggaggcatggtgctggcatctgctcggcttctggggaagcctcatgaagttcacaatcggcgcagaaggtgaagggggagcggacacgtcacatggcttatgattaacgtatagaagctttctattgaattatgtatgttttcactcagctggtgcctggttttacattaatataacttaccgggcatcaacaacttctgagcaaggagcaagagcaggaacgagagagagagagggaggtgctacctgcctttaaacagatctcacgagaactaactcactatcgcaaggacagcagcaaggggatggtgctgaaccatttgtgataaatccactcccatgagccagtcacctcccaccaggcccactttccaataccagtgattataattcaccatgatatttgggtggggagaaatatataagctacatcagagcttatacaagaaacagcatgaacttgcttggggccagtttattaaatccaatgaagctctattagatacaataaaattagacactttagaaatgtacaaaaggcctaaatttgggtagtctcatgccttcccaagggcaggtattttccctcttcctccctgcctctcccgagtgattccttgcacacgtggaagggagatctggcaggatgctgaactagcctgacgctatgctggtcatggcctccatgtttcctgtgaaacccacaagaatagttgagcacaattcttaataggatggcagtgtctcttgctgacccgcccatgctccttgactctgcagagggcttgtaacaggggctcatccaaggtcaacctcaaaactccacctcagacatcaaatggagtctgaaagagcccaaggaagcctggctccttatagaagtcacagtgatcattggagttgatgactgcataaactataaggtgaccacctgacgacagagtagcactaacctgacatcattaactcacctaccacagcttctctggcctcgaaggaatttttctgcagtactgtgctgtgaagtattcaggaattatgttttgtgctgtaacgtgccatagccataaaccaaaataaagtttttaaaaatgagatagctacttaactaacctgttaagatttaggctaatgattagttctctggcattacacatcctcgaggcatgcaccgtagggtaaaggacaccagaatatgagatatcagtggtctggacaaacagatacttttacttcagagcagtgggaggggagatggaagtgttagtaccatcctgtgatcacataaaggtgactcttcacctgcagttgctagggagaggcttgtttgttactcaaatgaacaggaaattaagagatgagcttagttaatgctaggaatgcttcatggctctctataagtaagcacaaacttgtggggtaggcattgtgacaacgaggtgcctgtaaatatgaagttcagtgcacatgatgtggcaaaaaagacttctgcgattcagacaagcacttcttccaaagagctctaagcacaaccctgacgctgtttccttcattctcaggacacttctgtgaattagccaaaggtcaaacccagtccttctgcttagacagaggtagagggagagcaagtcaccagtcgggaggagcagagggggcaccatagtggggactgcctggctcgtccctctgcccttgtcttcttcctctgccgggcactctcctgtctctccacagggctgagcaggatgtggttctcacagccagtggcctaagtgcccagcagtcaccggagaaccaggcccactgaaccttgggggaagccctctgctgttagggaaggagacagatgcagctgtttattaagggtgaccctgtgcatccactgtgcggagcagcaatttgcaggcccaagtggactcaatctttgggaaaacacagagctagatggattcttattactgccatttcacacaggaagaaacctgctcacagggagtaagtgaaggtccaggatcacatggccagaaagtggtgaacagggatctccaacccaaatcctctgacctgctattgaatctggctgggcagcctctggccagctgtctatgaaaggctggcaggcagcagagtgtggccctagaggatctgatgaacgggtgaaaacctaaaatggggaaactcacacaggatgggttcattttctacaatgcttcaggtgacaccatttttctaagttttaacttaacaaagaacatgagagtgttaataagaattgtatgttcttgggtacatcacgtgggacagaatttacatagaatatatatatatatctttcaaaacatatattcagccattgataactctgttgctttattaaatattatgattcttagattagttgtatcatctgtgaatgagattgataattgtgtttgcaataagatatattcataaattccattcattaataataaccattaagaactgcttgaatttcatgtcttagaccatatagtagcttatatgtaatattatcatttaattcaccagtgtccacagagaggacagagcaacacatgtcacaggaagaatcacaacactatttgataatccctgtcttgggttcttttttggaatgaggtggggtatatataaataaatagtaaatgaagtcaacatgaccatgcttttgtatatttctttctggtttacctcgtttcacctctcttttcatatgaaagttcttgctccattaagttcatatcaactgcaatgccacattctctttcccattgccatcaccttctgacctttagaagttccctatatgaataatgccttcagcacttttgtcatcgttttcagcttcaccccaactgccagcatgattctgagattttatggtgccgagaggagcccccctcaccaatgtcctggcctcacaggccttgatttcctcagagccagtgaggcagtcctctctccccttcctcctcagccagctccttgcaccaggcccacagtttacactgtcactgtaagaaattgctggccttctctgaatctctggtttaaccatcccatgctgatgccaccttctatccctctttcaaggtctctggaggatagtgttcctcctgcagaaggtgatccacgctgcttacagggaacttcacttctgttcttgcagagtgggaaacaagtcagttttgcatacccgttggagctccaacagttcttttccccagccatggtgtttgctaggttttgctcagatgggccctgcttggttgtcgtattagcctgagtgtctaaggacaccagtgttcattcctccctcctcctccactttatcccattctccagcccctcgttagtcaggcttcatgactcctaaactttgtgatgtcattggtgacactgggctctgatcagatcttggcatatggttcctaccaggttcgtggtggaaacctgattaccctaatggccgaatccacttttagaaggaagccttgactttctacattgtaggaaagtaaatgagggtttcagtggaaaactttgccttgtatagagtacatcactctaggttctctgacactaaccttgcatttgtctttgagctcatttctatcattttgtaagttgtaggtcactgacagacatgcttaatatctcgtacagtggaggttcagttgtatctcctttcatgttataataaaaccagttttgcctccatttacacgttcatttcaatatccttgatcaatattctagtatgtattctttatattcttttttgaaccagccacaatttctactcatttactcattagttaaatagactctttaaatacatgttcatttcatatctgtatgagtatcatgattttactctgtttgaaaaatatttttaactgttttggaagtcccagtgagatgcccaatgtattcgcttgccagatccagattatctttaatgacaagaaattgcacctcctatgtggttaaaacccaaatgtgtcttttcttggccctctttaggtgaatccaaagcaatgagagaacattgttcactctctatttttctagctttaatttccctctctactaattttgtgtttctctttggttttgtttcatttacagccaataagttattctcctttgttggcagcaatcgttgtgaacttgattttagggtctgacgatttggagatccctctaagtagataaatggtgtatagaaatctaatgactgttgagtgaaagagaacagagaatctggcttatctttctttttgtctgtcttttttaaatctcaaatcagtgaagaattccatgtcctcttacaggaaaacagctcttctatctagactggggagtttttctgtttctgtgttgaattttgacccatgtctgaacaagaatcgaagctataagttgtacttctctgtgcctgtagggataccttcacctttgattgtgtgaatgtattgtgtttcttagttccatgtggtaataatatatattataaagtctctcaaattaaaggagccctgttctgattggtatatctgaatacttgcttatataaataaaaattgcctaaaattctctgaaataaatgaaattgaactaatactttaaatgtgctagaatacaatatatatattcttcatgaaaccattcagaaccataataaaaaatttaactacacataatttaaataaatatttggcaaaaatgaatggtttactttagaatttattaaaaacagctatatcttttttgatgtcagtgttattacaaaagtgtgttttttaatgagttggggattttttatttgtatttatttatttacttttaatttattttttatttcaataggtttttaaggaacaagtggtgtttggttacatgaataagttcttagtggtgatttctgagattttgatgcacccatcacctgagcagtgtacgctgtacccaatgtgtagtcttttatccctcaccaacccccaccctttcctcccagtccctaaactccaatgtatcattcttatgcctttgtgtccttatagcttagctccaacttatgagtgcaaacatgcgatgtttgattttccattcccaggttacttcacttagaataacagtctccagttccacccaggttgctgcaaatgtcattatttcattgttctttatggctgagtagtattccatcgtatatatacaccacatttttcttttccactcattgattgatgaacatttacatttgggctgattccataattttgcaattgcaaattgtgctgctataaacatggtgtgcaagtatcttttttgtataatgacttcttttcctctgggtagatacctagtagtgggattgctggatcaaatggtagatctacttttagttctttaaggaatgtccacacagttttccatagtggtcgtactagtttatattcccaccagcagtgttacagtgttccctttatactacatccatgctaacatctattattttttgatttttttgattatggccattcttacaggagtgagatggtatcacattgtggttttgatttgcatttccctgataattagtgatgttgagcatttttccgtatgcttgttggccatttatatatcttctttggagagttgtctgtttgtgtccttagcccactttttgatgggattgtttgttttttcttgctaatttgtttgagttctttgtagattctagatattagtcctttgtttcatgtaaggttgtgaagattttctcccactctgtggattttctgttaattctgattatttcttttgctgtgcagaagctttttacttaaattaagtcccatctatttatctttgtttttgttgcatttgcttttgggttcttggtcatgaagtctttgcctaagccaacatctagaagggtttttttcaacgttatcttctagaatctttggttttaggtcttagatttaagtctttgatccatcatgagttgatttttgtataagctgaaagatgaggatccagtttcattcttctgtgtgtagcttgccaattatcccagcaccatttgttaaatagggtgtcctttccccagtttataaaagtttttgtttgttttgtcaaaaatctaagtatttgggtgtgtttctgggttctctattctgttccattggtctatgtgcctatttttataccagtaccatgctgttttggtgactatggccttatagtatagtttgaaatcgggtagtgtgatgcctccagatttgttctttttgcttagtcttgctttggctatgcaggttctttttttggttccatatgaattttaggacggcttttctagttctgtgaagaatggtgttggaattttgatggaaattgcattgaatttgtagtttgcttttggcagtatggtcattttcacaatattgattctactcatccatgagcatagtatgtgtttctatttgtttgtatcatctatgatttctttcagcagcgttttgtatttcatttttagaggtctttcttgtcctcggttaggtatattcctaagtatttgattattttttgcagcttttgtgaaagtggttgggatcttgatttgattctcagcttggtcactgtcggtgtatatagcagagctactgatttgtgtacattaatttgtatcctgcaactttgctgaattcatttaccaattctaggagctttttggatgagtctttaggattttctaagtatacaatcctatcatcagcaagcagtgacagtttgacttctgtttactgattgggatgccctttatttctttctcttgtctgattgcgctggctgggacttccagtattatgttgaatagaagtggtgagagtgggtatccttatcgtgttccagctcttgtgcagaatgctttcaacttttccctgctcagtattatgttggctgtagctttgctatagattgcttttattaccttaaagtatgttctttctatgctgattttgctgagagttttaataataaagggatgatggattttgttaaatgctttttctgcctctattgagatgatcatgtgatttttgtttttaattctgtttatgtgttatatcacatttattgagttgtggatgttaaaccattcctgcattcttggtatgaaacccacttgataatggtggcttatctttttgatatgctgttagaattggttagctactattttgttgaggatttttttttttttttttttttgagactgagttttgctcttgttgcccaggctggagtgcaatggcgcgatatcggctcactgcaacctctgcctcccaggttcaatcgattctcctgcctcagcctcccgagtagctgggattacaggcatgtgccaccacacctggctaattttgtatttttagtagagacggggtttctccatgttggtcagggtggtctcaaactcccagcctcaggtgatccacccgcctcggcctctcaaagtgctgggattacaggcatgagccaccacgcccggccttgttgaggatttttgcatctatgtttatcacggatactggcttgtagttttctttttttgttatgtccttctctggttttggtattagggtgatactgacttcatagaatgatttagggaggattccctctttctctgtcctgtggaatagtgtcgataggattggtattcattcttctttgatataattcagctgtgagtccatctggtcctggactttcattgtttgcagttcttaagttacatttcaatctcactgcttgttattgatctgtttggagtttctttatctttctggtttaatctaggagggtttcaaagaatttatccgtctcatctagattttctagtttatgcacgtaaaggtgttcatagtagccttgaataatcttctgtatttctgtggtatcagtagtaatacctcatgttttgtttctaattgagcttatttgcatcttccttcttcttttcgtggttagttttgttaatggtctgtcagctttatttatcttttcaaagaaccagatttttgtttcatttatcttttgtaattttttgtttctgtttcatttatttctgctctgatctttattgtttcttttcttctgctgggtttgggtttggattgttcttgcttctccagttccttgaggtgtgaccttagattgtctgtttgtgctctcgcaaaccttttgaggcaggcatttaatattatgaactttcctgttagcaccgcttttgctgtagcccagaggttttgataggttgtgtcactattaccgttcagttcaaataattttaaaattttcatcttgatttcgttgttaacccaatgaccattcagaagcagcttatttaacttccatgtatttgcatggttttgagggatccttttggagtcgatttccaattttattccactgtagtctgagagagtactttatataattttggttttcttaaatttactgagacttgttttgtggcctattatgtggtctatcttggagaatgttccatgtgctgatgaatagaaagtatattctgcagttgctgggtagaatgttctgtaaatatcttttaagtccatttgttctaggttatagtttaagtccattttttatttggtgactttctgtcttggtgatctgtccagcgctgtcagtggattattaaagtcacccactattatggtgttgtcatgtatctcatttcttaggtctactagtaatcgttttataaacttgggagctccagtcttaggtgcatatatatttaagattatgatgttttcctgttggactagtacttttagcattatataatgtccctctttgtgttttttaactgttgttgcttcaaagtttgttttgtctgatataagaatagctacccgtactcctcacttttgctgtccatttgcatggaatatctttttcctcccctttaccttaagattatgtgaatccttatgtgtcaggtgaatctcctaaagacagcaaaaacttggttggtgaattgttttccattctgctcttatgtatcttttaaagtggagttttgaggtcatttacattcaaagttagtattgaggtgtgaagtactattctattcattgtgctgtttgctgtttgaatagcttgtgttttcttttcattgtgttattgttatatcggtcatgtgagatttctgttttggtgtatttggaggatttgtttcaagattcagagctccttttagcagttcttgtagtgctggctttgtagtggcaaattccttcagcatttgtttgtctggaaaacactatctttccttcatttataaagcttagtttcactggatacaaaattcttggctgataattgttttatttaaggaggctaaaaatcggaccccaatacttgtagcttgtagggtttctgctaagaaatctgctgttaatctaataggttttcctttataggttacctgatgcttttgcctcacagctcgtaagattctttcctttgcctgactttagataacctcacgattgtgtgcctaggtgatgatcttttgcagtgaatttcctgggtgttctttgagcttcttgtatttggatgtctaaatctctaataaggctggggaagttttcattgattatttcctcaaatatgttttccaaacttttagatttctctttttcctcaagaacaccaattattcttatgtttggacatttaacatagtcccaaacttttcagaggctttgttctcttttttgaaattcttttttctttgtctttgatggattgggttaattcaaaagccctgtcttcaagctctgaagttctttcttctgcttattcatttctattggtgagactttccagtgcattttgcatttctctgtgtgcccttgatttccagaagttgtgattgttttttatttatgttatatattttgctgatgatttttccttttatatcctgtatgatgttttttatttcagttagacttcacctttctctggtgcatccttgattaacttaacaatcgacctgaattctttgaattcttttactggtaatttggagatttcatcttggtttgcctccattgctggtcatctggtgtgatctttttggggtattaaagaaccttgttttgtcatattatcagaattgtttttctggttccttctcatttgggtagactgtgtcagagggaagatctgggactcaagagctgctgttcagattcttttgtcccgcagggtgctcccttgatgtggtgttctcccccttcccctaggaataaagcttcctgagagccaaactgcagtgattgtctttgctcttctgggtctagccacccaatggagctactgggctctgggctggtactggggagtgtctgcaaagagtcctgtgatgtgatctgtcttcaggtttttcagccatggataccagcccttctctggtggaggtatcaggggagtgaagtggactctgttagggtccttggttgtatttttgtttagtgcactggttttgtgttggttggcctccagccaggagctggtgctttcaagagtgcatcagctgtggtaatataaggaggatgcaaacttgccctggagacacgtggttaagtattcaggtttttcaggcggtgggcagggccatagacctcccaagagattatgacctttgtcttaggctaccagggcagtagagaaagaccaccaggtggggggcagggataggagtgtctgagctcagactctctttgggtggggcttgctgaagctgctgtgggggatagcggtgtggttccctgaccaatggagttaagttcccatgggattatggctgcctctgctgagtcctacaggttgccagagaagtcaggaaaagcagacagtcacagatctcaccccgctcccacacagctaccagtcctaaaggctggtctcaatcccaccatgcccctccaacagcactgagcctatttccaggcagctggtgcccagggctgagaatttgccccagaccatgagcctccctactgaaaaagcaagcagactcacagtttttctggtgtctctgggagcctgcagcagtgatcgggttccttcaaagggtctgtggattctctccacaaaggtgtaattttttaacttgggtatgtttttcctgaaagtaaatagatttactaatcacctaaactagcatacttctagttattatttaaaattatgaggaatataaattcatgtttgactaaattgaaccattgtgatgacagtcttttatttccagttataacatttagtagtacgtcaacttaaagaaattttccaagttgtttagataatccttagattgatattgtattagttgatgaacattaactggatgcctagatcattcctatgtaagataaaatactgaaatattaattattaagcataaattgaaatttgtatactttggctttttagtagtaaatcccacagagaggctgtattttaaggtctatcagtgaacatgttcctttctgccatgttgagaattctatagggaaattgtgctgctgtagaaacctgggctgtatgggttccccaaaattacagaatgttcacaattacccaccctttagttttctttataaaacagatgtgactttgtataaaagtcataattaataatatctgaatgagactctgctaggagtcttaaaaaaatgagacatgctttgattaaagtaaaagaatatagaatgcttctgtctataagtgaaatgacttttgttccagaataagaaagaggatggtgaagggcaacacaacatatagagatctgtttgaggttcacagaaagtgaatctgaaagggaccacaaatttgtgttaaaattttgcaaaacctggttcggttttgatgggtgtattcataagatttccaaatgcaaacctagaatttggtttcttttcaaatatagtcacagtttctttggagtattcatttgtttgtttttttgtttgtttgttttttgttttttttgagacggagtctcactcttgttgcccagtctggagtgcagtggtgcgatcttggctcactgcaacctctgcctcccaggttcaagcgattctcctgcctcagcctcccaagtagctgggattacaggcatgcaccaccacaccctgctaattttgtatttttagtatagacggggtttcaccatgttgatcaggctgatctcaaactcctgacctcatgtgatccacctgcctcggccttccaaagtgctgggattacaggtgcaatccattgcgcgtggcctattcttaataagaggttgtaaaagtttgctcttcacattagaggccaatttgcccaaatagcagagatgctatatctcactagaatgacgttccacactgtgtttttgactttgtcatgctcttgattattctcttaaaaatacaaaaaaatacaaaaataaaaataaaaacccacaaatactctcattactgaaagtgttgagtttttgtttatgtaaatattgtattgtcactttgattaataggcagccaagccacagccattcgtacactaagacacccatgatcccaatcttaagtgttcaaatctcctggcaaattttaattttgcctttctcaaatcaaatccttaatggaaaaggaaataaaaaatataaaaccttcacagtgtctttggcacattaaggtttctttaatatttcccaggctatcttaaagactttcccctggaaattcacaaagatttcttttatgcctgatggaaggagaagtaatagaagtaaatatgttcatttgttatgttactattgatgagtttcataattgtccaattaaaagtagatgctacttaatatctaggactaccctgaatttgcatatatcatataatcatcatttgtgaatgaatgagaaagattatgatttttgataatttatttcagtggttataatcaaattttcagataaaatagtgaacaaggccaggtgtggtggtgggcgcctgtaatcccagcactttgggaggccgaggcgggtggatcacccgaggtcaggagttcgagaccagtctggccaagctggtgaaaccctgtcgctattaaaaatacaaaaattagctgggtgtggtgatgggcgcctgtaatcccagctactcaggagtctgaggcaggagaatcacttgaacctgggaggcagaggttgcagtgatccaagactgcgccattgccctccagcctgggtgacaaagtgagactctatctcaaaaaaaaaaaaaaaaaactgaactaaatgtttaataatatttatgaaatgtagcctatgtcactagtatgactttttaaaattatttaaagagattttattttgtccagaatcttggcagtcaggaatcccaaataaatgctgcaactgataagtgcatcattgttagctgatcttaggaaaccatcacaggcatttcaactgtgttttccaacatacggatttgtttgttgaaatgtagctagtcaattttcatttttccacaagtcaaccagctgatctcgcagcccaatcagtttttttatttttatctttccaccaccccccaccacctccactgctggaatacatttgtagagaagttttcaaaagtttagagtttaagaattctgtttctagattgttaattgtgcatatgtgagaattatgggagatgacactgatcctgtttggtgaccacatcacataataatggaaatgtttccaaacataccattttcaaaatattttctccataataaagtttattttttaaagctatattttcattgttaaagtgaaacctccattttgagtaaatagagtatatgtcatttatttattgatttaatatattctaggaagtaaatcactgacgaaaaggtggcaacttttgaattactcctcatttttatgaaaagaaaacatacataacttctgttaaatttgacaactctttgaagtactctacagtgagtgaaataaccagtaagcctccatatggcctgagggatttccatagtcactcttcatttaattgcagagtattgtacagattttacagatttttaaggtaatgaaatccataaattcctttacatggacaatatatcaaaatatgttaaagatgtacaaatgattgaggccacatcaacctctttcccctttcaaacttctactttctcctctgaatagctgctatgatgtgaatgtcttataagtgtctgatgtaaactgggtgaggatcaggatcaatctatatatgaaatattagcaaaactttgaaaactttttgataaaatggatagaggaaaaccaaaagctcttaatattttcttctagtattccaatggatttgacttgtgtgcctcatttttggaagtcagtggaataaattgttactttacttttattttatttatttatttttttgagaggtagtctcactctgtcacttatgctggagtgcagtgatgcgatctccgctcactgtagtctctgccttcctggttcaagcgatttgcctgccacagccttccgagtagctgggattacagacgtgagccaccgtacccggccccaaattattacttttagatgatcacttttcacttcctgttagtggcatattagtaagagtttctgataccataggaatgtacaacatacaagtcatttttgaatattccagtgacataaactcttcagaccatgaacccaaactgagaatggaatagaaagtgcttttttaaccctaaagtaagaagacttcctacagaaggtgctgttggttgcctatcatatttcccagctttgcctttcctaatacaacccgtatttttttcaggatccaccctcctcccataacccatgtgctttcagggtgggctgacccttctccacacccaggccaacatggtgtaaaccaactcatccccaacgtcagtgattcattttggaatggatacgtattacagtttggctaatgaaatcagaggcatagactttttgggagatgcttctgtgctaaaatttcctaagtcttaaacacacacacacacacacacacacacacacacacacacacacacacacacacacacggagggagggagggagggaaggagggagagagagagacagagagaaagagaaaggtctcttttcctcttttgtatattatcaaaggacatgatgcctggagatgcaggtgaataaggctgaagatcacagaatggaaggaagccatcatgtctttagacttacagttatgtgtattaataacttccccttatttgtttaagtagctgaattgaggttttctgtttggtgtaatttataacccactaacacatcataacttaccaatacatggactatatactgttatatggtaaggcttcactcattgttattgagtattattcacctacatttttttttaatgtgcttgtttggttttcctacacatagcaccttcaaagcgggaatccttaagattaatgccaggatatcagatattagaggatgttagaggcaaacaaatgactgtgggggatatgaaagctgacaggctacttttgaaggaagaagatgctaaaaagaaaaagagctgggagacacagacttatactgtaatacacaaaatggatactcgttattatggctttgagacatcaagggaaaagttgaattatcctttttatataaagactgagaagtgtatattttacaaagactttcatcaaaaaattctaaaatgtattaaatgtgtaatgttttttgaagagggaagttatgcagaacattgttaggcaggcaggatattctttatttctcccaacacctagtacagagaaagggatgaaggacatacttaaaatttgttaaaggagtaaagagatggatttcgaagacaaatgatatataacagaaacatttccaaaaacactgttttcgaagtgttttctccgtagtaagaaacctagctctataacctaaatctattttgcagtttcataacccatctaacatctgaatgattacttctaaatatttttctctacttaattttctatgatgtctgttccccaatttatcttctttggatgtttaagaaaaaatattacaaagaagttttgaaggttttcctttttaagttatgcatagaaatgtacctgccaaatttcgaatttcttgtcaaatttcattcatgtagcaagatgagatttcagggtcacagtgaaagtctatgaatgaaaaaaaatgttaaatattcatattagtgatgcatggggtaggaagtagtggggagcggtcctcctaataggcagacaataaagggggaacgtgtttgtagaataatttagaaacaataaggaaactaacaggtgatctactttttatcaccgtacaccagcaattctaaacaatgtctgtgatgaagtattttccccccaaaatattctactggtctatattctaaacaactgatgtggctactgtttgttttaatcatctttatgtgaacttcaaattcgcacattattggtcatccatgaataaacatttaactctacatagcagttaacttgaagacctcccaattgcacatacagtctctaccacacagactcaactacatgcatttattttcagagtaaattcataatagtttggaattgcctgagctacctttgggagaagttactgtattccaaccagtggtactagatttttttttttctttaaacaggagaattcatgtaatgaatgatggcacagtaactttaaagataaagacataaaacatgacttgcttaaattttgacattgtatgacacccctttagaatttttgtgttcagaaagttaaacagtgaagcaggatgtgacctataaggggtagtatttttgtttgtaaggagtacatttttaatgaatgaaatatgttactatattggaaaaagacatttacagtgaaaattattttattgttttgaaactaaggaagaaattcagaaaataatgactatcactgagttttgcatgatttttagtgacactaattttatcatgtagaggaagagggtgttaaaatatgattcactttcgtagtcgggtaccctattacttctctaggtcatccctcctatgtaacatgcacactgttaaggcatgaattaattattttggaagtcaacttaccaaataaaccagtgctaccattttctagtctccatggatcagtttgagagccatgaaaaggattaaaatgatccttacaatatacagatagtcttctagtaagtcatgacacactgtaattaagttgtaactgttagtctctctgcttgttcctttcctatcttgaaatgaatatgttcaagatcaaatatgaacaagcatttactcagtggaagatgaaatgggtatgatatgaatagattaatgacatcacatgtgccttctttgaagaaattaattatccaaatgatgttagtgacgtgaagcctcctgggggcacttctcattctactttcagtaatgagctgtatcctgtcaacttactcagcaaaattcacaggaatgcatgtttctctttcatgggacacttctctgggacttaatgattccacactctttctctttttctactacctttctggattttcttctctgtctcctttgctggctgatatttgttttactagcctttccacatgagagttttttaatactatgtcctagacttcttcctcatctcatgttatattcttatcaaagataatctcatgtatgctcttgacttcaaccagcatgtatgagtggatagcgtcaaaatttctatctccagtctctccataaactccttgtagtcactaacagttggagattgccacctgactgtctcagggacacttcaaactcaacctttatgtttcaattatctattgtcgtgtgaatattatagctaaaacaatgaagatttattatattttaaaattctctgcactgactgggtggtttttaatgctccacttggtgtgggctgtagagttactcgtgcatcagatggaggctggactagttggaacctctaagatgtcccctctttccacatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccattgctttagccaagtgcatgtacctatgaaaatcttaagttttagagataaagtaggtattaccatcatagaaggggtttcaaaaaaaaaaaggaaggaaggaaggatgggagaaagaaaggaagaggaaagggagaaagaaaggaagaggaaaggaagaaagaaaggaggaaaagtaggaaagatggaaaaagaaaagaaaataatctcaaatcagcttcttaaaataagaggaggaggccgggcgcggtggcttatgcctgtaatcccagcattttgggaggccaaggtgggcggatcacgaggtcaggagatcgagaccatcctggctaacacggtgaaaccccgtctctactaaaaatacaaaaaattagccgggcgtggtggcgggcgcctgtagtctcagctactcgggaggctgaggcaggagaatggtgtgaacctgggaggcggagcttgcagtgagccgagatctcaccactgcactccagcctgggcgacagagcgagactccgtctcaaaaaaataaaataaaataaaataagaggaggaacaaatattcagcaatcagcgtcattgacactgacacttgatcagtgtctgaagtgagagcagctgttaggaaatcctacttctatctatcaagaagggtttatttaagaaaatagatgacatacacgctataattatcaatatagtttcttccatgggctaccaagtccaaagtattattgcttttgcataatttatgctgataaccttggaatcatggtttggatggtttaaacctctctctccataccaattgaatcattcatcaaatcatatggaatctccctatgtgtaacctcccgtcaagtcctccattttaatttctgtcaccactactctgctgtattttcctttcgcctcaaatttgaggtattataaaaatcttataatggcctatcccggatctaagctatcttacacattaattacacagattccccattgcttatgtaatacaggccaaacatcttagcctggcattgagtgttctctataaatcgttgctttaactttatttctagctcccttatacacaaacttccctataaggccaactggatgagtttcctgtatttaattggtcaagctcttctccacctgaattgttcttccctcatactaattttcccaaatcctgccttctttgtgtgtcttggctcaagtaccatcacatatctttctggaccaccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttacttttgaggaaaaaagaaattaacagtctcggattatgtatctcctttatacaaagctgctgtctgccaccaaacttattgggaatgaaatgaacagcataagaatctgcttttagaaccagagacagggcagatctagggatccaggtgtcaagaacctcccagtattttcaggtattgaccatcaggatgaattaaatcttaccatttttttttatttttctgatacattttgttcataaattaatttgaagagagagtgattggcagagcttcaaccacacacactttctacttgaagtatgagggggagtgggtctgatgaaaacttgaatgacttcctatcaagactagtgagagagaggtaattctccaaaacagactagtgaagcagttatcagaaaagaaggaagcaaatgttaggcaagcatgtaattctttctttatattaaatcatatgacttacctgtgtttaatatattcagagcctgacaatgagagagaataacttagaaagcaagggagattagttccagtagaaagactaatatttattttgttgagatggtaggaagtgggagtagaggaacaattcaaaagctgttcttgactcgcttttaaactcttcatggtggccagaattgctttcaaaaatactatatttcccgtagacagcatattaatttgcatttcaagcattttgataactgttaaattatttttgtcttgaatacactattttatagtgttttataatgctagttgagctctctggaatttctaagaaaagttccagaaattaaatctcctgggtaatgtgtgaataacagaaaaggatccaatgtattctcaccaaaagataactgtccctaatgttaaaaagcaggggaagatgtcatcattttattgttaacctgacggtgaaactggagaattccctgaactccttgcaggtcttgtgacaggggtgtgactcgtttgttagtttgcgcaattgctgctgcacaaaccccttacgggatggggagcacacagatgggcaggtgcaggagccggggcaagcacttttgggctcctgccccacagtggcgtctagggttgtgttacaattaatgctcttttagcagttgccatctgcacatggctaagtgttgaggactaagctctgattttttatcttgcccaaattcctacctaaggggcctagggagtcatgccctacaaaccatgaattctcatcagatgggttttatttgaccctatatattgtgacttacttttctatctgactctggcataacattataagacaaggaaaaaatatttaaccccaaaatatatttccttgccataccttgaaattgccctgcaaagtctcttgtgggaaaaatccacattctatagagaatccctttccccctttgttttccttcctttccttcctgatccaggagataatcaactaagagccaggtacccttttaggtccaataagaaacattttacaacctgctctctccctctgaagtcttctgtctgagagcttcctctgcacagtaaaacttggtttccacagtcttatactaacctgaacattcctttccattaatcccaggtcttaggtaaactcaaccaattgtcatttaaacatttaaaccagaaaatgtttaaatttacctgtagcctggaagcccctgctttgagttgtgccacctttctgtaccaaaccaatgtatttcttaaatatatttgattgatgtctcatgccttcctaaaatatataaagccaagctgtaccctgaccaccttgggcacatgttctcaggacttcctgagggctgtgtcatgcgccatggtcactcttatttggctcagaataaatctctaaaaatattttagagttttactcttttctcaacagtgttaaactggctcagtggagagtcatagtgacagccttttgcaccctgccctcttggtacctgggtccttgtctggtgtccaggaagaatcaggtcagacatggacttgaaggatgttgaatgcagggattttattgagtgatggaggtggctctcagtgggatggatggggagctcgaaagggtatggactgggaagatgatcatcccctggagttcagctgtccttgcctgatctcctcttggaccgtccccggcctaactcctattgacattcagacactccttctcttttcttctctgctataccactctgctgctctcctgctcttctgctcatctgtccatggagcctagggtttggggtttatatgtgtacaggataggggggcatagtaggacaaaaggtaacatttggatgcaaaaacaggaatgcctgttcccatttagggctgcaggtttccaggcttgacatgaggcctttgctaaagaaccaccctcttctacccagtatttccctgcctcctgtccgtatcaattctatttaattttgtaatagagcaatgggtaatatttttgagtcaatggaccctttagtaatattttttaagtcaatggaccctttagagttaccgatgacagccccagtattctctccccaaaacatacatttgcaaaatgacacacaattttgcatacaagttcagaggatctacatgtttctgaagcccatctatggatgccagatttaaactcattttattaaaaaaaaaaaaggatattagaactacaatgaaagagcacaggagaaaggataactgtctttcatgggaatgtgcacttttcaattttgctgtattttcctaaattatctctcagctaatacctgacttcatcctttgttatatggcagcaaatctcactaaaatggaactagtacaaggatcctagactttatcactcctcctcccacccatctcccttctgtagtatgtgttaaataagaaagtttttagtgtgtttctgagacttgttcctgatttgatttcacacttcaacagtagtgatccttaattattacttaggaattactttatgatttggtaatatttaaggacttaagctacaggttacttttttaatccttaggtgacatgctacctaacactttctctctgcttattttataattctaatttgagttattagctcttaattactcaataattattcactgaaccctctgtatgtgccagaaactgtcctaggtactgagaataaacaaatgagtaaacacataagtttcctgccctctgggaatgcacattcttaatttactaactgttaaattcaccacatacttttgttaatttgtctgttttagaagtctggctaacttgtttaaaatttattgtactcattctttctgaagtggctcttctacatcagcactatcaaataaaaatataatgacagcccaaagatgtgattttaaatattctagtagtcacattaaaaatcacgtactaagaaacaggtgaaattaattttaatagtatatttagttaacccagtatttacaaaatattgttatttcaacatgtaatcaatgtaaaaatttattgatgagatattttgtcttttttatactaagtctttaaattcgggtcacatttcaagtgttcaacagctacatgtagctactgattaactattggctagatcaggccaaaatgttcaaccctagccacttgctcttcctccgagagcttcaatctctcagcatttcttatgcagagctacttagctccttctcagatcctgtctctaaaatacaataacaattcgatccctcctcaagctccttaatgtcttaattcataaagagactcttgccatgaactatttgcctaggagggcaatgaaaggttataaattcaacattgacaacaaaaacagtttgctataaatgatagataaatgataggactgaaagggataacgtgcttgggtcagcgaaacttgggtgtggtaggacaaatgggagaagctgggtttttttcgtgtgtgtgtgtgtgtgtgtgtgtgtgtgtgtgtgtgtgtgtgtgtttcttttttttttttttttttttgagacagagtctcgctctgttgcccaggctggagtgcagtggcgcaatctcggctcactgcaagctccacctcctgggttcgcaccattctcctgcctcagcctcccgagtagctgggactacaggcgcctgccaccacgcccggctaattttttgtatttttagtagagacagggtttcaccatgttagccaggatggtcttgatctcctgacctcgtgatctgcccacctcggcctcccaaagtcctggattacaggcgtgagccaccgtgcctggcagagaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaattcgaatgagaaagacaaattgactggattaaaaggaaacattgagtaacattctgtctttagttaaaaaaagtccaacaccagcaagacttaccttcttttacttacacatatagttaatattagtgtacggtaaagcttctccacacatctaggaaagaaacaggaaaatgcattatttcctttgaaagctgcctaaacacaaatctgttattcttctgagaaagagtgatgcctatacagtaaaaaagttattctaaggaaggaaaaaacaaaatacagtatgtctgttgtttaagccaatagatgtctttaaggaaacattttcttaagaatattctttacaatagtgaggctgaggcaggagaatggcatgaacccgggagacggagcttgcagtgagcggagatcgcgacactgcactccatccagcctgagcaacagagcgagactccgtctcaaaaaaaaaaaaaaaatctttacaataatataattttcaaagttctcagaattctaaaatcttgctggatgatacatagatgtatagacatgtacccaaaggtgctctactaaattaatcactacctccaacaacctaaagattacagtttattgtttaaatgaaggatgcaaaatataggtgtatatacaaaaagcccctgttttatagctcttctaaatgtgagtatcacacacgggaaaaatcgaaaaacaaatgtaagtctaaatctccttacagagaagaaaatgtagtgtggcctggcctaatattacgacttttccaaggagttactatatatggtttaacagaagattatttccatcaaaaatatccattgcttgtgaatcttaagaacaggaagtttttcaatccaaattaagctgaagaaaaacaaaggagaggaggggaggggaggggaggcgaggagaggggacgggagaaaaaagttctctgctagcttcctaagcagttcagctctgagggtatgctttgcagcagcaacagcacacctgcccagaccactgcagcaaaggctttcaacaattcttgggaaactaagtgagggcaaagatacatggtagttccaggacatcccacagtaggatttgtctcacggaggtaactcagggaggaagaagtgagcagttcactctgccttaacagtttacatatatgaactactaaacttaaaaaaaaaagtttttcaatccaaattaagctgaagaaaaacacacctaaatagtatatacccaaagtattatgtggcataatattttaatcataaaaataatatgtatctatttttgtttctcctttatagtcaaagcactgtagaagtacagaaaggattgttctgagagagttcttgaagtagaggttgggggaggcagcctaggattcttatctgtaaaatgtgtggttccaacatcttatgcctacacttgatctcactgctagattgtgggcaaggtgctttgaagggatgggcattaaagggaccctccaataagtgaggcttaatggagtttgcagagatcatcatattctagaaatcacacatgccgtttttgtaggaacagagacagggtcccaaaagtatcactggatactggagcagaaaatgagaaaactcatcttgtgatgccaagagaagcaaagtcttcaagattctttctggtttatttctatagtatagctatcaatgttagtggcataatgtagtatttcatgttcattctgggtcactttagactcatcgtagcactgatttggaggaaaacagtatgaatgggcacaactggatgatccaggagggattcttttttttttttattatattatactttaagttttagggtacatgtgcgcaatgtgtaggttagttacatatgtatacatgtgccgtgttcgtgtgctgcacccattaactcgtcatttaacgttaggtatatctcctaatgccatccctcccccctccccctaccccacaacaggcctcggtgtgtgatgttccccttcccgtgtccatgtgttctcattgttcaattcccacctatgagtgagaacatgcggtgtttggttttttgtccttgtagtagtttgctgagaatgatggtttccagcttcatccatgtccctaccaggagggattctttagggaagccaggcaagtgggagtggtcatgtaggaggaaagtctatcccatagtacctgagaggtgtgcactaaacttgccacaggagacgatgctgactggggaactctattgagggtggcaaagcccacagtttaggtggaaaagcacttgaaaggggaatggattcattgcttttgtcatttttacctagactgttataagggcttctttttttatatctctattatcagtttttttcttttggaagtctgtcttttaagtttactcattaattgtataaccatttattgatcatttatacagcaggcactacgctgtattctcctaatacaacactaagaacaagtccctgtcctcatggagcctccagtccaagcaaccccaatgatgtgagagaactgccacaggatatataggagcatgtagcgctgactcactgtctgattatcatcactcttttaatgatgccaagatcgattagtgggttcaactggttacagcctcatccctgaattgtaaaattccctattagcctaaaggtgcccaggatttaattgttctggataatgatttcttaagaattctgaagaaggtttattcagagtttcctttcattcattgatagagctagtatttattcagcttattctaaacactaggcattatgttgttgctagagatacaaaactaagtgagccaagatgaatatagaggaaacataagtgagtaacttcagtgcaatatgagaaatgtgcagggctagatgcagagtcctctgggaacagaaaggaagcacagtccttaatgacagcaatctctggtgagtcaatgaatctctcgcagtttatttaggtcaggagctattaactgtcatgcattagtgagcagccaacagtgggactgggcagtctgagccctgtattgaaaagccggcaacgaaagaaacttcactagaggcttgatgaaccagttcttaaactaaagctcatgtgtctgcaatggacaatcctgcctcaacctcgtgaaaaacagaccaggattctctatggttatgcactactgcatttgtttctttagcgttcctagagttgttttcatcagttatttaagtaagaatgcccgaggtagtccacttcactccctagatccctattaatacatttcagttgaaaatctgttgtcccttgcctattttactgcttccaacattgagatttgatggaaagaaatcagctctcaaataagaatggtgtcacctgctgctggttcagcggcactgcaaactacagattatgcaaattacataaagatccaatctttctacccggagcctaggaagaggccttcttttcccactgggtcttatattctagagtcagccatttacttaatttcccaaagaatactgcaagagaatactgtgaaagcattatctaaaatacaacaaaagaattctgtaaatgttatctaaaatataataataagaaaaaccaaaagaattcataactaggctgaaagtattctcttaggattttaatattagatacaaaattgctcattagcctttaggttttcttccctctcccaagcactcaacaattgatttccttgcatactaggtaagtgtcctatgacacataatactttcaaatatttatatcttttgtaagataatatttttcatgtaatcctagatggattagtttcctatgactgctttaaaaattgccacaaacttagtgactgcaagccacacacgtttaatttttttcatgtctggaagtcagcagtccgaaatcacttttactggtctaaaatcaggtgtcaacagggctgtgctccctccggaggatctaggggaaaatcattttccttgccttttccagcttctagaggctgcattttcttagcctcgtcttccctcttgttgcagtcgtcccaatgacttttgtctctgtagtcaagtctctctttgcctccgtcttaggaggagatgtgtgattaaattttgcccacctatataatccaggataatcttcccatctcagaatccttaacctagtcatgtctaaaaagtcccttttaccttataaggcaacacaaattccagggattaggatctggatatctttggggaccaggaatcagcctatcacactaggtaatgaagtcattatcttaatctgaagtatctagatcctcatataatctaactcctttagtctatttgagttgttttaattttttctcaagtacattagctgccaaatttaaaattattgcagatggaactcttgtaggtctataatgtacagcttgctgagccacagtaaacagtatcatttttagctttctatcaatgtttgacatacaaaatggtcaactgcagaatgtttcagtgacttctctagaaccctattgaatatttaaaatgtcatacatcatgttgttgagtggtcttcgtggaaaaaatcatgtttttaagaaatctattccccttcgatttagtgcttgggtttgtatattccgatgaactgatatgcaactagagctatataactaatcctgatttttaaaaatttgtcttggcttccaggaagtacagactaaatttagtatataattacagtaactattcttagctagtatttcttgtataattatatattcttcaccccaaccccaataatcatttctcctactccttactaggatgcttttgataatttatcttcatttaaacaagcttattgcatgggttttctttattataatctatctcaaaatcttttttggaagcagatatgaaataaagcaaacaaacaaataaacttggaagatatatagaccctatgaattatagcccatctgcatcttttttgagtgccaaagacataagttcagctatgaatacattctgttactacaaaagcactttaaaattgtgtttctgtgcattatatagctccttagaatagacagatatatttagaggggaaggatatgctaatcaatgccactagagccagtagttttcttgatttcattcaataccttccagttttaataatttgcaactgatatcaatgatcataataaaattttaaattaaaatgtgtgagctgtttttttgttaatacttcatgcattgaagagacataaacaaagttttgaaatcataactacattttctgaaaggcttccacaggaaaaaaggcttcatattgatattattttgtacaattttttggacaattttccctccttcacattcagtttattagaactgaacataatatctgacataagtgattcatatatgggctaaataattcatgtatatcagaggccaagcctattggatatggtggaagttttgaaaccctatctttgtggaacaacaaaaaattaaatgtaagggtcaaaatgtgagggctcctttctcatttgttctgtgaatccagtttctagtggttacttatcatatcaaaatttctcgtggcgttttcagagctacacctccaataaacctaaatgatgactagctttaagacaatagtctatacagttacgtactgcttaaccacagggatgtgttctgaagaatgcgtcgttcagcaatttcattcttgtgtgaacatcctagagtgtacttacacaaacctatatgttttagcctactgaatatctaggctatatagtatagcctattgcttttaggctataaacctgcacggcatgttactgtactgaatactgtaggcagatgtaatacaatgatatttgtgtatctaaacatagaaaaggtacagtcatatttaattttaaatgtattaaagtaacccatttcctcttcccacttgactagctatttcctttttgagaagtagacattatgtttaaaaatgttttaaaatactgcaatattgttgatattattagtttactaaataagacaataaagacagaactcagacaaataaaatgcagcagctgtcagttgatgggggccgccattacttgtagaagaaaccttcagtaagcgttgaactagtggcctgggatagttgattttaagaagacaaataaaaatgcctggagagaaaaaatattttactcattccatatgagtagaaaatatcctttgaaatattatcagtgacttacttacgtcagtctttcttaacttgggttgtctgttaaatactttaatatggcttttgccatagctgggtcattgctataagttaacaaagggctgttttctatatcgctggaactctcctttgttagaaccttctttaaatagaaagaattctcttgcagtacgtggtaattgccatagattattgaaatgaaaaatggctatgattactcctaacaacttgagatgttctgcttacagtggatgttaagaacatatcttagtaatttaaaatttttcttaataggcataagcaagtttttattctttaaatgtacttcaagtggttacaactaataaagattggtatataacaatagagaagaggttccaaagtaaaaatccacattaaaattaaatttaggttacattattgcttagcagtttaaaacaatatgttccatatatacatacatgtgtatatatttatatgcatacaaaacatacatgaacatgtataagtatatggatgcagatgagtatatgtacacatatatatagaataaatgcataaaggtatataaatatatggctgcatttgtgtaattggatatatatgatacatattttatatctgtatgtcatgagtatttttctcattttttcctctttgagaataagtctaggtctatactatcaataaaatattgaaaattaaattaattacccaagtgaaaaaagaaagttctcagagttatgctgttcatacttatgggagaagtgtagattttttctgatttgcttatcttttcctttatttaaatgtaatttttactgatatgtaatagatgtacatttttaagggtacacatgacaatttaatatattcatataatttgtaaagataaaattagcataattggaatatctgtcaccttaaatatttatattttctttatgctagaaatacatgaaatattctcttctagcaattttgaaatatacagtagattattgtaaactgtagtcaccctactgatctatcaaatactaggtcttatttttttctatcaaactctatatttggacccattaaccaatctctctttatctccttctccttcctacgctgtggtaacaaccaatatgctatcttcttgagatccacatttttagctcccacatatgggtgagaacattcaatatttgtctttctgtgctggcttatttcacttaacatattgaccttcagttccatccatgttgctgcaaaagacggatttcattttttatgtctgaataatattccagtgatctgccagaactgaattttaaatggggttttaggcctggattgactttagataagcttataattatagctctctacttgtggtaatcaatagcataggcctgaatgtgttattgtattaaatatttctcattcattgacatcacaattgtggatcaaatctctgtggtttggatatttgacttctgacaattcattgttttgtctgactttaagttgtgtttaagtgattattttcttggtttgctctcattccaaattactggggaatttaactgatgaatgaaccagacatatatttaatatacatctgctgtgtgcaatatattgtactggagggatgggtaggtatagacatgtaagacataatctcttacttcaaccagaatatggtttcactgggttcctaagatcaatatgcataactgcagggacctcgtgctacattggatttgaatctggggctccagttccagtcccattccttcatggccatgtcaccttagcatgtcacttcacctatggcctcttaacagttagataacccaagaccactactatttctgaagagtatttttttaattacaagccaaatcagtatcaaatattatatttataatggttctgtgtaatttactaactcatttaccataaaatgacatatattgtactattagaagaaaattgtgggatttattaaaaacatcaatttattgtaccacacacttgatatgggcttataattgaacacaaatatatagaatatgaatatctttttttagttctgtcattagctctttgagtgagtatataagcatattcataaatgatattgtatctatatttatctatgttttaagaattcttgcagccgggcgcggtggctcacgcctgtaatcccagcgctttgggaggccgaggcgggcggatcacgaggtcaggagatcgagaccatcctggctaacatggcgaaaccctgtctccactaaaaaaaaaaaaaaaaaatgcaaaaattagcctggcctggtggcgggcacctgtagtcccagctactcgggaggctgaggcaggagaatggcatgaacccgggagatggagcttgccagcgagccgagatgcgccactgcactccagcctgggcgacagactgagactccgtctcaaaaaaaaaaaaagaaagaaagaaagaaagaattcttgcatctcaggcatggccaagaagcatattgcccttcatcctttctcaaataccatagaattggctctgacctcacctcagtttacttatgtttcttaagctataagatgatttgtaagatcccattcacacttagtatcctatggttataaagacattctcttgatagttatttgacatggtgtacacattggatcaatttctttggtgaaaacagtctcgccatgaccttgatgtgccatttgatgttcttggaaataccgttcctctactgttaacagtaaagtttcaaagaaaatagattcccagattatttcaaactcattaatataggaataatatttttaattcttcaagatgataagattttacacattttgatgccagtaaataattttgtgataaaagcaaacacctggtttgctagaaaatattggcattccgcaagcctaaattcattagagaggaattccacgtgcatcgcctctgagctgcagctcctgtgaactgaaaaaactgctagttaatgtctcagaagttattaggaaatgtaaagtacatacaattgtcagtgcttcaaaaatagagataacatcttagtccttatgtagcccccatagttagctggagcttggacatattaggaagtcaataagaatactgacaaactggcatgtaagtcaggtttgcctgcatcaggtttgaaaattattctattttagaataatcttatttatcctatcgtttctcaactaaattgatgtgtagtccatagatttcttacctttgctttatattcctttagagctgtgatgcaagctaaatcatttttggggaaaataacttcttaaacatttttgttgttgttaatgcttcggatgggcagttattgtctgaacatcatcaaggcacaagcaactgactgtagcatccatatttttttgacagttttcattgcttatgtgttccaagagctgcctacaggatttctttccttatatgagaaatattgtaatgatactcaattatgtataagagcaagattcctgacttgactaaatacaactactttagtattcactatttaaactacgtggctttttaataagtaaatcaacattaaaaagtgaataggagattgcaatttagttttcttagaaaagcttgactatttttattatctgatattcatgtcacatgtaatcacacatttgatttttaagtaatttttattggcttggcatggtggctcatgcctgtaatcccagcactttgggaggccaaggcaggtggatcacctgagcccaggagttcgagaccagcctgggcaacgtgggggaaaccctgttttttacaaaaaatacaaaaaaaaaaaaaattagctgggcttggttgctacatgcctgtagtcccagctgctagggaggttgaggtaggaggattgcttgagcctgggaggtcaaggttgcaatgagccaagattgcccccactgcactccagcctgggcagcagagtaagaccctgtctcaaaaaaatattattataattgaggtgaattaattgacatctatatttatgaaataactatgaataatacaagatggccacttgaaggtatgccctaagacaggggtctgcaaacttttcctgaagggaccagatagtacatattttaggcttgtgggatacacaaatttagtgctactactatctactatcttctgcctttgtagcacaaaagcagtgatagtcaatactgaatgcaaaaatatgtgcgtggctttgttccaataaaactttctttacaataaataaggatgggccatagtttgttgacccctgccctaataaattcattgacttggcctaattttaagaatcatataattttaataaaagtctgttaagtttctttatataatttgtaacatcagtaatatttttaagaaaaatgtaagtcatctgaaagtataacctaagtaaattttatttgatgatttgaatggaaatacatgatgattttttcttatatttgatttaaatatattgatctaaacctacctgttcttaccataagcctagctattataaaaattatacaataacttaatttttaaaaattattttccctagaatgtactggactcttggacaaatacctccttattattgaactttgggctaaatgactgcaaaataaatgtttggtcttgatttagctaagtgtcttcaaactacacaattctatatttctgtgagtgtcatatcatttgccggtaggactggtgcccttgtttgttgtgttgttttaaaactctctcattgagaatgtcacttctccaagtgatcatattctttttgaaagtcacttctagtttctatataaaaaatgtcttctaaaatcaataccagtgaaagttaatcagtgatataatgattacaggatgccttatttatcattggaaggctaagatggttatctctgtgatgatccttccatgtgatttgaaaggacagaggggtagctttttctggccatgccacttctaatttgtaaaatgcccccattataactcttatgtaagaaggcagcctgcctttattgccatatcctaaaaagattcgttagtattatgcccaagtgctcagtatttcaccagccctgctcccgtcttaaatttattatagattcgacattgtcataaagggcataattagaaaatcatctcacgtctcatctcattatgtaattgtgcataaggaaacaatcattttaaaatataaagaagaaagatttgggtcatgcagctgcttcctaaatgttatatttttatttccattgcgtctgtttttcctcattgaagtgcagagattactcatattgagatacaactatttttccgcaactgagtcttcaatgcctgctattttattagccccaaataagagatgattggaagtgtatcaatgcaagtggcaagtgagaatcagcaggttcattcttcataaacccttctgtagagcatgctcatgtttctggtaactggcttttctttctgctcctctttttgagtggttacagtggaagcaaccacatttttacaaggtgaccatatctcacccatagagatgaagacagaggtttgctcattacataagctgaattaatataagtccattctcaggattttaaagttggaactagaaaatattcacccactgaaactctgagctcttaagtaaaagtgatgcaaactcacaagctgttggcagaagttgttttctgatatgttgtttttaaaaatagaaatattattctaaaaagagagagaagaaggaagaatgaaacacacacagagagacagagttttgatatgaaaaatcaacgtcttgtttctctacagtgtttggatcagtggttccagttcaccccattactcagctggatctctgcctttgggttgtgtgagatagctgtgtatatgtttaataagctcacttttgctaaacttagttcaaatgggtttccataactttgaactgaaaaactaattgtgaagtttatttcatactctacacagcctttataatatagaatgtaaatataacgcctacgtaactgttctctcacaaagtttgatggtaaattattaaaaggaattaattactcatgagatactccccagagaaaaagaccacaaaaagttcatatgtatgtattaagttatttatttttaataatttttgggtcacttctgtgagccaggcaacagtgataagtaggcaacagtgaataaatacaaaagtgaatgtctagtttgttgggggagagatgtattaaccaaataattacccagattagcagatgattttaaaatgtggcaaatgctgtgaaggaggggtgagggacagtgagccaggtagaagaggctgtacgtgaaggccctatggcaaatgcaaacaaagcatttcggcattgataatcggaagggtttttggttttggttttggttttggttttccagaaagccatttattaattaggttggaaaagcattgtttctgtttcctgttcatcatatttagcttttatgtcagaagagcatttttgtttttgtttcaaatgtgtttcaagtcacctaaaaccctctgtccttaacattattcaagaaagtatgtaatgtacaatgttatttacaccatcgatttgtttaacgaactctctctttgtagtcaatgccaaagaaaatttcgtctcacgtatattcatggtttcctgatggattgaccagtaagttactgaagtcctacttagtgtgatgtgactgtggtggtgttccatcacattattctaagccattctcagccccatctaaccccggtggtattcagcaaaggcatacaagcccagaaccatgggaatgttcatctccatcagaattaataggaaaagacactttagtaactgtctttagtaagatacacttaggggagcagcgtgaagtaactctcttggactagcatccctctgttcttaaactgccaccaatgctactgtaacattgcagtcatattctaataaatggtgtcaagcatagaagagagaaaaattctacttttgtgacttctcctgatttctgagtgctgtatgcatgaactatttacctgtgtacacaaacagctgtacatttagttgccatggcaatgcttatctgttatctttacagggaacaaaatggtactttaaccacagttgactcatcccgtgaggtaaaattgataaagctgcctttcttaactttcagccagaatgcttcagttggcaaaagttggttgtttttgttcttcttaaagaaaggctacttgttgacaaaggcaggtttaacccccattctcaataattgatatagcctcgagcaaagatcaaagtttcctggatatcattgttataatttacacttagtaactggacaggagatattaataggatggccatcagagaaattgtgttttcctgacatgtgtcttcttggattacaggtaagtattggtgaatgcgtgacactgataactgctggtattattgatgagggactatcaatgatctgatgcatagggtgcccttgataagaaatctttattgttcatcagcatgttactgaaaagagtccagccaatgttaggtatgtgaggttaagaattccccagtcactatgcaacttggaaatagaaaggacaagtgattctaggacaaatgtgagaatccatgtatgtatttataggcatgatacccaggcagaattattaatatcctcccttgggctcccatagcactgtgtccatacttccatcatgacacttcacttcaaattaattttctttctatcccgttgggttactagctttttgaagtagatggcgctattatttttattgattatcaagtccgaagaaggaagagctcaatacatgcttgttgaataaagtctgctttgagaaagttatgctcattttgctttaatattctgcaagagatacaaagaaaagaaggaaggaaatctgagagctatcagttgactggatactcgaattggattacttttagggcaatgctcttggttgtgcctagacttgtaataatagctctgatttcaacttatctagaaaagcttaaagaaaatagtccaggactgagaaagctatttttcattttcttaaataattggcacctttgaaaggctccagaaactacagttttggaagcctctaggaataaagatttcttatttcctggacctggcatatagttttagtaaaggaaatgaattattctagatcccaaccaattgtcttcaatcaaataactccctgacagaaatgaggcaaaattttaatcactaatttaacctctgcaataaaattcctaagaaagaattttgtcaaaggcagagaaaaaaatctacagtatcaacactgaatatacaaagtgtactaaatgtttttaaatcaggaagtatgcatctttttatctttggtagtttttttttttaattaacaaaacttcaccatcaagactccactcaaattattgtaggttatcctagaagtttgagaaatacaaatgggataatatagaaaagattataaagtttgtattccatgagattttgcaatttactcttcattgatatagaaacaagtattgaaatctctaagctattcaagatagtaatatgtagtgtatttgggaaagtgaaattacagcacacaagcattatctcagtttaaaaagtaggtgtaggtggtgtgttgcatagcttaatgtttgtcttctgaagaaatgcatttagttcccattctttcttgataacctctatgttatcatatctaattctttgtgataaaatgcactctgttttagtttcatgaaccacagtcaattttgttttcctttgcaaacaaagaacgaaaagatcaaatctctctctgtgctagactgtggatctcttcctagcttgggtggccatcccaaagtcatttttgcatcttcctctcccactggcctgaaagagtcaactggaacccgttcaatgctgtttgtattcatcaacacttaatgtatcaggaggattttccaccttctttcctttaaaatattttattatacctaaatgagtatcttagtctgctcaggctgctataacaaaacaccacaaagtggataacctgtaaacaacagaaacttctttctcactgctctggaagctggaaagtcccagatcagtgtgccagcagattcagtgtctggtgaggatgtgcttcctcatagacagccctccctcacatggtgaagggagaagggatctctctcaagactcttttgtaagggtactaactgcctttatgaggacttcatccctatgacctaaccacctcccgaagactcccatctcctaaaaccagcgactctggagtgaggatttccacatatgaattttggggggacataaacatttagatcatagcaatgactatatagtaaaattctattaattcaggtttattgggagaaaggtggtttgaatttagtgggaaggacttcgttgctgtagatatctaaattcaaatcaccttattaagaattgtcaatacaactatttcactaccagtctcttattagaaatgaaacatttaatactccagagaaaatagtttctccagactttttttttttttttgagacagagtcttgctgtgtcacccaggctggagtgcagtggtgcaatctcggctcactgcaagctccacctcccgggttcacaccattctcctgcctcagcctcctgagtagctgggactacaggcgcccaccaccatgcccagctaattttttgtatttttagtagagacagggtttcaccctgttagccaggatggcctcgatctcctgacctcgtgatccgcccacctcggcctcccaaagcgctgggattacaggcgtgagccaccgcgcccagccctctccagacattatttaaatggataccacttttaaatatttaactgttctatcttttttgacatattaaatttgcattttgacttctaaaaatgtaaaatgtgcatcaaaattatacatttttggtttaaatatttgaatcataaatggccaatattgaaaatatgttttttcaatatattgaacatttattcaatatattcctgttctaagaatctgtatagtgatgggttaatacaagtaaatggaagcattagattgtgatctttaactaaacaggcactttttgtcattgtaattgccttgggactaatgtatgtgactgttacatttgtttccaacatgattttatttatttattatttgtatttattttttttccagctcttggttgtgcttagacttgtaataataactctgatttcaccttatctagaaaagtttcaccttatctatctagtttcactctgtcacccagactggagtgcagtggcacaattaggattcactgcggcctcaacctccatgggctcaggtgagcctcccatctcagcctccttggtagctgggactacatacgtgtgccaccatgcccagctatttttttctattttgtaattttttgtagacacagggttttgccatgttgcccaggctgggctcgaactcctgggttcgggcattctgcctgcctcggcccccacaaagttctgggattacaggcatgacccaccatacctggcctcaacatgattttatacctatttgaaaagacatgctatatgtcatagatattcagttaaaataaattagccgggcatggtgttgggcacctgtagtcccacctactcggaggctgaggcaggagaatcgcctgaacccgggaggcggagcttgcagtgagccaagattgtgccactgcactccagcctgggtgacacagcaagactctgtctcaaataataataataataaaatagttcagttgattacagctaattgaatcacacacacaaccacaaaactctattcaagtaatattcagtacaaaactaatggatacaaaaaggagaagatttagtattaagggtcagatagcactgccttgatctttccgagaaattataattattggcaactgaacttctaggtgttaattagtgtgacagaaaaatcaagccctttctcaccttactgtgactaattatatagttatatgagttttaatctcttcccattcaatctcaaaatggtgcctcaaacatgtatttcctcagaagcttaaggataaggcagatatagttttggttgtaacttttttttttttttgagacagagtctcactctgttgcccaggctggagtgcagtggcatgatctctgctcactgcaagctgcgcctcctgggttcacgccattctcctgcctcagcctcctgagtagctgggactacaggcgcccgccaccacaccctgctaatttttttgtattttcagtagagacggggtttcactgtgttagccaggatggtctcgatctcctgaccccgtgatccgcccacctcggcctcccaaagtgctgggattacaggcatgagccaccgcgtccggcctgtaactttcaataaactatttatttcactgaattctaggcttctgagggtgtatactgatatgtgggcagtggaaaaatacatataaaaattaaaatgttttatgttcataagatcataagaatgttattactctggtgatactgaagtccaatgaatctgaaatagcattcttaatcttatgctgacggtgtcttgttagctttgtcatctgtgtaggcaaggaggaacctcacggtcagtcacttcagcaaatctgagctttacgtgggtgatagtttcaggagtagaaaggaatcatgtcatttttttcactcttttccaaacctttatggtgatgtaatattgaacgaatttacagacactaatgattttatgtctgtcaatcctatctcacaaatatttgtctgctacatgatacccattcttaatgataacaccagcaagatacctaaccttcagaaatactctcaagctttgctactgggattgtatattagtaatatcatttttaaaaactgtcagtatctaataaggttgaacatatataattcatccttttctttcctaggtatatttccaacagaaacatatacaatatacacgagtatgttcatagtagcactattggtaataggccaaaatttttaactacctaaaggtccatcaacagtagaataaattgtgatacattcacataatggaataacttacagcaataaaaataaatgagttccgatttcacacaacaatatgagtgactctcacaaacataatattatgtgaaagaagccagaaaaaaagagtatataatatatgatttcatttacctaaatttccaaaacagtaaaattaatcaatattattagaaatcagaatagtacttacctttgctgagaagaggtggaatggaaacagaagagaagagcttctggcatgttgatctaatgttctatttctgaatctggttggtagttatgtgtgtatgttcagtttgtgacaatttatcgatatatatatacacacacacacacacacacacacacacacacacatatatatgatagattgaactcaaatatttaatttgtgcttatattagtttcccagggctgctgtaacaaattaccacaagctgggtggcttgaaacaacagaaatttattccctcacagtgctgatggccagaagtctgaaataaaagttttatcagggttgtttaattctggaggcttgtggagagaatctgttctatgcctgtattcctagcgtctagtgtctgtcagcaatctttgttattcattggcttatagatgtatcactccaatctttgccaccttttccacatgatcttccttcctgtgttctcttctcttctgtctctgataaggccactggccactggttttacccagcacccatctgggtaattgagatttttaacttaattatatccacaagggcgcttttttccaaataaggtcacattcacaggttcctgggtgacatgccattttgggggctactaattaatccactacagtgttccttccccaaaccccacagaaatcatgatagcggaaatataaaaatattgtacagacaagaagatttaagaagggttaaatacagatgagataggttcaagattttgaaagatcgtgagtcgatattacttgattcagcaaaatgcaggaattaaagttagttgccagtgcgaagcaactcaggcagtctcaggatctggagatacgaggtacttctggattcaggggtaaaggctggggcttaacatagtaaatttggttaacaatccacttaagaaagttaaagtcttagatcaatgtccccactctgggcatcaagtgaatataaccatcccatattgaggcagaaagaaaagataattacagctttataaaaaaaataaaacagagaggagtcaaagtggctctggactagtggacatgaagaattgctgagggagggtgagttactgtactcaaacaaggaagtaaagaagcagcctataattttaatggtgtagactccctcctaccacccctctatgcttatctaccaggaccctggcagttgggctcataccctagtcacgagattcttctcagcagaaaacactccaacccaagagaaaagacctgcctttggtgtgggtgtggtgatggtggtggtggcagggggtgtctccaaatgaaaatatcaaaacttccctgatctcataccctggagttcaattagcaatcaccatccttctgcacacaaagcttccattcagcttttcattacctcacttataaatagcagtggtcagccaagagttacaagatatttgaggaaagcttgcattgtaaaagacagagattttttaaaaatgagtgtacagataaaacgaactattagaaaataaaggctattcagggagatgaaaacttcaaaaaattacaatgaatattctcaaatacattaaagaagcactttataacatccagaatgctataaaaatgaacattgagggaactaataagaactcttgagagaataaaatattatggcataaatcccccagaaggtagaataaattatcaaagagatgacaagatttttttcaaaggaggattgatacaggaggtctggttaataggaattttgaatacctgaaaaaaatgagagaaatagagaagggggaaattatcaaataagtgatgcaagaaaaatttatttaattaataagcctggttttccatgtttaaagggttcaacaggtgaccagcaaaaggaaattaaggtaactgacatcaaggcatagtggccagaaatgttaggacaccaagggtaaagattctaaaaacttttccaaaggtgttagaggaaggtgatatacaatatgacacaaatcagagtaccactgacttctcaggagcaacacttgaagcaaaaatcaataaagtaatgtcttcaaagtttcgagagacaattactaattgcttttcacttataattctaaatctgaaagatcagatagatagaaattttcaggccaacaagttctcaaaaaacataactacaatgtatcatttcacaagaaagttctggaggttatatgttaccaaaatgagtgaataaactggcaaagaagagttgagaaccagacagcagggaacacattgataaaaaaatatattaattaaagagaaaacctcttgagagaaatgtgtggattataagcaacagagaaaacagaaacagaaatatatagaagaaaatcattttcagtgaattcaatcattagtaaatttagatgttaaatatgtaaatggatgcttccggaaaaaaaaaaaaacccaaaaactaaagatctctaaacaacttgctatatgtttctgccttttctatttctttgattgatatgccctttctccatcctcattgtaggtacgctagtcattcaaagactcatcttaaaatgtaatcccttcaaaaatataggaagatatccatatgtccttggttaaggagagctttcttagcatagacccaaaatacagcaataaaaatagaaattaaaatctgaccacattataatgttagtcttataacaaagtctaaagcaaaaaaaaaccataaacatgtttaagaggtaaatgacagagtgaaaaattaaatttccagtggataatatgacaaaaaatggtatgtaaaatctgtaaagttttctaagtcaacaggaaagatatcaaacgcaataaaataaactcgtgcaaaaaatggtcaaagttatagtattataattcacggaagataaaatccaattatgagaggatgttcaacttctacttttatcagtaaacaacaacttaaaacaatagtgagttcctatttttcgcccatcagattgacttttaaaatctgtttatcacgtgttagggaacatataaggaacgttttaatctcagatattgccagtaagagtatacatttgcacaaccatttttggaactatttagcaacagctcataaaattgaaaatctggatgccttattacaacattaatcatataatttattattcattctaggacacctttgaacatgaaagagagcactattaaaatgtatgccagaacaaaggcataaactggagttatcccaggccaatctcctatactgtcaccctctgtatgatccacttagtgtatagaacctagttagcttcttgtccatgtgtactatgtgtatgtaaagctactctttgtcacatagtttataacagcaaaaaaaattaggaacaggctgggcactgtggctcacgcctgtaatcccagcactttgggaggccgaggtgggtggatcacctgaggtcaggagttcgagaccagcctggccaacatggagaaaccccgtctctactaaaaatacaaaattagccggtggtacaaatacaaaatacaggtggcacatgcctgtaatacagctactcgggaggctgaggcaggagaatcgcttgaacccaggaggcagaggttgcggtgagctgagatggagccattgcacttcagcctgggcaacaagagggaaactccgtctcaaaaaaaaaaaaaaaaatttaggaacagtctgtcaaaaggaaactcaatagataaaatagataacacagaatagtaaataataaggaaaacagatgaactagatttctctgtatatcagtaccaatagacatccagtacacacacttaggtataaatagaaaattcaaaattccagaatattcattaacatatataacattatatatctcttatgttatatatataacatatatatatatatatatacacatcaaacattacatatgatgttaattgatgtgagtgcaagtataaaaatggaatggaagaatatacctccaatttataacagtggttgtctctggcaatttagaaaagatctggatgtggtttaaggagaattaagctatattaataacgtttaatttctttaaaaataatctgaagcaaatatgacagattttaaagttgatatatatgaattggagaaggtatatatgtatgttttaaatttttttgtatagtgattttttttctcaaagtaaaaacaaaataaatcctctttcacaaagctttccttgatctctttaagccaaacatctctgtgtgtcctctgtatgcctctaacactatagctctcataagaattaagctttctgcctatggagtttatctctcccattacattggaaaagcttaattgaaaaagcagtatctcatccccttttgtatctctccacagcacctgatcagatatctgttgcatagtaaatacccaataagattttattaaacacaatagcaaaggaatagaatggtgtacatagaaacacttgctctttttaggcaactctagaaaaatgttaaatttttcattttttcatgcttttcttcacacagcggacctatgtttgttttacacctatgttatgtttctattgacatacttttagaatgaatacttagaaaatatagtgctttgtaataatatacatggtcctagcatattggagatacaccagacaatctaattgctgaaccaaatgtaggctagcttggtgatcaaagggaattgttttgatttctcctgtctcatatatatctgttatttgtcctaatgctgagctctagactgctgaatgaacggtgacatttttcttggttactccattgtgccacctcacctccatttgtcactctagtaatgttaacatctgctgtcaacaccaattaacttttttttttttttttttttgagatggagtttcactccatcgcgtaggctggagtgcagtggcacaatctcggctcactgcaacccccgcctcccgggttcaagcgattctcctgcctcagcaattaacatttagtaaacaccttctgggtccatagtagaatgtcagttacttgctgctcatttaaagactagttgttaagcaaaacttgaatacagtatggcatttgctttgagtttattttttttaatttcaagtttcatggcttttgtttttccattctcataaataaaacatatgcttttattccttgacagttatcagagtttgttcagttgaacaatgcccaacttgcaaatgaatacttttgcaaatacatatggtggatatacaaatacatatgtgaattcatttggctctaatgtgaacttattgaatgtgctatgtcgagttatcttttatcaaaagaactgttagtaactgaggacatcaaaaaattatgcttgctcatacatacataaatgctatatttaggttttaatgctagcttttaaaatgtcttctttgcccgctacttacactaacaggatttccttgttcttgaaagtgaaatatatttttaagaacaggttttaaggccaggcgcggtggctcacgcctgtaatcccagcactttgggaggctgagacgggtagatcacaaggtcaggagatcgagaccatcctggctaacagggtgaaaccccgtctctactaaaaatacgaaacattagctgggcgtggtggtgggcgcctgtagtcccagctactcggtaggctgaggcaggagaatggcgtgaacccaggaggcggagcttgcagtgagccgagatcgggccattgcactccagcatgggcgacaaagcgagactccgtctcaaaaaaaaaaaaaaaacaggttttaaaaaaatttttagatttgttttttttgtttgtttgtttccagttttctctgctgtttcagacttaggactagacatgcctggctctaattgtcctcttagattgttatccagctttcctttgagacaatattttgcacaaagtgtgttctcttagctggttgattccagtgatggctggaatctatgcatagtgtggtgtttcacagttagacctgactagttatcctggcactttgaaacagttggtttcaggtacccttccacacatacatacaaaagatgtgctgatgatagcactgacttttcagagtggtcttttcatcataattaaaagttttttttttttttttttttttaaagcctgaatacacaatctgtgcatggctttgatgattctgtagttaagaagggcaggaacagccttggggaacacttactaacttggaatcatgaagaaagtcacaagcacctacagatgagcagaaaagcaagattatttcattcattttacgtccacaataccacagggactggctggtcagttacttgcgcatgttgtcaaagctaacctttaaagacagttcatctggctaaaaatcaaataccttatacccagagtattagatatgcatcagcgggtggccagggtcttaaggcaggaagtatattataggtggcctggtattttgcaggctcttctgagccagaagcattttttatcagaaaggttttggaaattatgctcagcccctggcatctttttggtcctctcttgatcgctagtccagctgttgaatgaaaagaaatgaagctgaagagacatcactgtggctacagctggtgttacggaggttggtgtcatgctacaagataacacacacatcatttttactcatgtggaaggctgccttgctgtgcatttccacggctgtcagaaagattgattcctgaaatactttgaaaaaatgctaagtactagctactttgggtgtttacccaggggcaccacagctgcctggcattgtagtatggcagctgaacagtaatcactgctatttctctgatttgtttgtgtctttgtcagcatctgagaggagggaggttcaatcccagagtggggccctcactccacagtgatctcattcagcccatggctttaaatactctctgcaatgctaatgactcccaaatttatgtctgtggccctgatgtcatccctgcatcccagactcatagatccggctgcctattaaatagcactgctttgatgtctatgaggtatctgaaatttaacataagcaaaaccaaatttctgatctgtccacccatatatgacccaacttatcatcccaccatcttcccacaggagtaaatggcaactccattcttgtggttgctccagccaaagccttgtgatcatccttgacccctcccttactttgtatcccacatcccaaggtatccaccttgaaagtggattcagtacatgaacacctctctactgctgctgtcttaatccaaaccaatgacaaatctcatctggacgattgtaattgcctcctaacatgtcaacctgcttccttttcccaatagtgtactttctcatggcagtaaaagggaatccttaaacacaaattacattacattatcttctgcttagaaatcaccagcggccagatgcagtggctcacacctgtaattccagcactttgggaggccaaggcaggaggattgcttgagcacaggattttgagatgagcctgggtcacaaagtgagaaccccatctcttaaaaaaaaaaaaattaaaaattagctaggcatggtggtacgcatctgtagtcccagctaatttggaggctgaggtggaagcatcagctgaacccaggagatcaaggctacagtgagtcacgatcgcgccactgcgctccagcctgggcaacagagtgagaccctgtctcaaaataaacaaacaaacaaacaaacaaacaaacaaacaaaggaaatcactagtgaatttcaatcccaaggttcaaaccacatctgtaaaaccataagcgatcagactgtctcatacttgtttgcttatccttctgttatttccttagccgatttccttaactcattcacctgcgtattcaatggccttttcatttctcttcgaatagtttccacctaagtgcctttgaacttgatcatctctatgactggaatgctcttctcccaggtgtttacatggcctggttcctcttttcatttaaagcccatgcccactcaaaggccatatctccttgtcagtaagatctttcctcaccagcctttataaaatatagcactgctcccaatggtctcttattctgctatattttcttaatggactttataatcctgatgtcttttcccactgagtgaaggctttgtttcgttcactgccagttctccagcaccaagaacagtgcctagtgcacaaagggctttgataagcatctgtggaaagtgcaaacattcacctgactcttctttctatctctatctccaccagctgtaaaactgtgcttagaatccctgaacattttattttaatgaaattacctctgcaatatctttagctcttcagtggaaaaatctttcaaaatccagggtctcatggagctcatgtctccatctctgacttaaatagtccatgaaacacatgattctggaaactgagattgtgaaaagcacatcttgctgcaccctccagtctttgtgtggtctctagcacttggtgccatagtgacagtgtctgggtagaacagatgtttttagtgatctgaaaatcactataaagaaaaggcatttcctacatcttggagagaaacttgaaagttcacaaacatgttaagtctaacaatttcttagacttgccatttgcttttatccactttcaggataaccgtaatgtttgcaactcatcttctgtgtctcccccaaataattcatgtttccttttcctccttgtcttatatttcaatgagtgagaagtgaggcatcttactcttattttgtattaaagccctgcgctaatatttctaacgttctcttttacgatttagtgagatttcagaagtgagagggatagttttgttctgttttccatgagttttctagttctttgagaggaagagggaccacgaaattcaatattagtgtttgtcataatactcagcaaaagccttgcctgtggtatacactcaataatgtctgttcatttgggttttaacttttttcaaatctcctcagtgttataattacctgtccttttcattagaaatccaaacctgattagcaattgtttttccagagaataagccacttgccttctctaatagtattggattggatatcaactaaggcatagcttcccaacggatgtgcagtggcacatgactgtactccacatggatttcaaatgtgctcagacaatgattcctgtaagctctcaggggcagctggaggctctagaccaatcatttctaaccacaagattgtgtattccagggtgctctacaaaaattataatttccattatgtgctacggcatgagaaatgttgagagttagtctagtccagtactgcctaactaaactatctgtgcagtcatggaaatgttctagatcttccttccaataaggtaaccacagtgcagctggaatttaaactctaaactatataaactattaggaaccaaagatgaaaaataagcacaattcagcaatttatcagactcgacaaatattaatttgaggtgttaacaacccacagtggtaccagcaggcagaaattaaattaatatatcactaacttgagaataaaggcatcaaaggaaacctcattttttaatgtggctaacattgttggatattagctggctgatgctagctatgtacgctttttctcttgttgtcttctttttgtttgacgatgtggcaaatgacagtgctgttgcctgaaaatggcttcaaagtcacacttgtatgtcttactgtattgggtttaggtgaattctggtgtctgtgttgttcttctaatggggcctggagcaatctaataatttgcatttgggtcctatagaccatatggtgtttatcacccacttctccatcttagatgatctgccagtcattgatgaggtgaaagctgtgtttggcagtgctttcatgctaggttaatcattgtggaattagctattgtttatagcactttttaatccaagcaagagtattctggagtctgtacatctgtaagtcaaaatttacaacctaacgtcgatttacaatgaggaaaagcaagttagataacatattgcatattcataaattactcctaagagataattagtacctggcctccacttcatgattcctctgtttgttagttcttatgatacaatggttgtggagatgcctatttgatcgtatttctcaaggagactctgatccagtgtgttccactgcctcattaacctctgccctcaaaatacaccaagtcaacctctgtttctttattcatgctgctccctctttctggaatggcccatcccacctttcttctcaggtacattttagccttacttatggaggcattgaaatctttaatattagtattaatgtacactagcatttatggaacacatttttttgtgtgtgtcaggcgtaatacccgccaccttaactaggtatttcacttaaacgtcacaacaggacttcaagatatattttttcaagatatatatgtttaatacctatctcataaatgaggaatctgagcttcaaatatgtgaagcaattttcataaaacaattttgtaatgaagtagagtaaggttttaagctaggacttcctgactctaaagtctttgttctttccattgcaaataaagaagacaaagaagtctattaaaggtatctaatgaaggaatctgttctccattaaccttgtactcacttgagacacagttgaaacacagtaaaacagctttgtagattgcttgcttggcttattgatttccaaatcctgttttctttttgctaccatcttacttcctgtgtcatagtggaaaccaacaaaagaattaattctttgtcaagtgtgtgaggaagagcatggtggaccagaagtcttggtccttcctgggcaaacagatacattgtcttctgcacctatacatgtccctcattcgtgaatttcgccctctgatttatatcctatctgttctatcttttaactaagaactgtgaaatcacccatatccaggactacatggctaatctttttattaaacattgtctatcatgtgtttttttttttgttttgttttcttttgtttttgtttttgagacacgtgctcactctgtcaaccaggctggagtgccgtggcatgatctcggttcactgcaacctccgcctcccatgttcaagtgattctcctgcctcagcctcctgagtagctgggactacaggcatgcgccaccttgcctggctaatttttgtatttttagtagagatgggatttcaccatggcagccaggctggtctcaaactgctgacctcaagcaatccttctgccttggcttccataaatgcagtgattacaggcaagagccaccacgcccagcctctgtcgtatgttgttgaattcttggtcatgcctattcaatcagagtgtaaattgcttgtgtgtagtatcttatttggtcttgccctatggcaccagctcaaatgctaggctaatcactggcagtttttacatattgttgattatgtgaatgattatcttcacattataactagacaaaaagagaagtaaaacaattagatattttccccagagatgagtgaaataactgaataaactaactcttgttcataaatttcttaaagaaggatgacaaatttatcttgtaaacatacaaataactggtacctaatatttttcagtggggtggagggtggagtaggatatcagaataggactctccagccattgtctccctgaagaaactttaatttgaacaactatccatgcatgaaaacatcttcaccagggctaaggaaatcaggtgagcaatcaaagcactaggttatagtgtaatgctaagaaaagacgcatcaaagagggcaagaaaaacagttttattacctctgtcacccctccacaaacccagtaagcatagcatggaaagagattctgtctgcttgggggaaagagagggaagtaagcataagactttgcctgctacaatgaaatctagcatcagtcagaattccatgaccactgactccaggctaaaacctatgtacggagcctttagaaccaacttggcacccgagaggagcctgtagcccctatgaaatggaatcaagttttggtctgcattgtggccagctgactacagtggccttgagctgtgaataacccacagtgataggcaggccttagtggctgtgggtttcaggcatgccccagggctgtgctagcctcagtggccacgggctttaggcacactccaatgctgcaccaacattggtgaccataggattctagccctatgccaagctcagcagccgcaaatccaatcttagtacagcataatttgcagtggtctagggcttagggaattccctagcactgcaatgactgtagtgctcaagggcataggaaccataccggacaaccttttcaaaatgtctggacaggcttactgctgaaagatgttttcagacaaaaccagattgtgaagggcctacttgttcagtgcacagacattgattcatgactacaaggaccaaaaataattaggaaaacatgacatcataaaatagacaaaataaggtgccattgactgaccttaaagagatggagatatatgaactacataacagaaaattcaaaatacctcctttaagggagatctacaaatgtcaagaaaataaagagaaataataaatttcaaggagtaaaacaataagtgaccagtacaataaatttaacagcaaaattgaaatgataataataaaatattcaacagaaaccctggaactgaaagatataaggaatgaaataataaatgcaacagagagaatcaacaaaagtattcatcaagaagaagaatctgtcacttgagaacaacttatttgaaaatatacggtaagatgagaaaaagaaaaaagaataaaatggaatgaagaaagcttactttggggatagtatcaaaaagaaaaagcaaattatgagtcactgacatttaagaggaaacaaaggaatataaagctatagaaagcttatttaaagaaagaaaagcagaaaactgtcaaatctgcagaaagatataaatatccagttacaggaaggtcaaaggtctccaatcagattcagtctaatcagatttaaataaaagccaagtcatattataattaactgttaaagatcaaagacaaagagaagattatatacacagcaagaaaaaaaaaaagaaaataaagggagtttcagtacacttagcagtagcagcacatttctcagcagaaaccttacagaccagaagagagtgggatattttcaaagtgattaaggaaaaacatgcccaccaaaaataccgtaccaagaaaagctgtccttcagaaatgaaggagagataaagacttcccaggcaaacaaaagtcaagggagttcttcaccaccagacctgtcttacaagaaatgccaaaggaacttcttcaagctgaaagaaaagaatgctagtgagtaacacaaaaacatttgaaggtataaaactcactggtacaagtaagtacaaagtcaaattaagaatactctaggccgagcgtggtggctcacacctgtaatcccagcactttgggaggctgaggtgggtggatcacctgaggtcaggagttcaagaccagccaggccaacatggcgaaacctcgtctctaccgaaaatacaaaaagtagctgggcgtggtggcacgcgactgtagtcccagctacttgggaggctgaggcaggagaattgcttgaacatgggaagcggaggttgcagtgagcgagatcatgccactgcactccagcctggtgacagagtgagactctgcctcaaaaaaaaaaaaaaaaaaatactctaatacggtaatgatggcgtgtaaattccttatatctttagtaagaaggttaaaatataaaaatactaaaaataataactacactaacttattatggtacatgtaatataaaaagatgtaaattgtgacatcaaaaattcaaaatatgagtgtgtgtggagttaaagtgaacaatttttttgtgtgtggtcgaagttaaattgttatcaatttaaaataacttataaaatgtttttgtaagcctcatggtaaccacaaagcaaaaaacttataatagatacactaaatgtaaaaagcaaggaatcaaaccatagtactaaagcaaatcacttaaccacaaaggtagacagtaaaagagaaataaattttaaaagcatttacaaaacagctcgaaaacagtgaaaataatggcagtagtaagtccttacctatcagtaactactgtgaattaaattgattaaattatccagtcaaagatatagagtggctgaatggattaaaaaacaagactcttctatatggtacctataaaaaaattcactttactggtaaggacacacagagactgaaagtgaaagtatgaaaaagatattgcatgtaaatagaaataaaaaacaataggagtagctatacttaaatcagataaaatagactttaagtcaaaagctatgaaaagagacaaagtcattatataatgataaaggggccaattcagcaagaggatgtaatgattatagacatatatgtacatcacattggagcacctaaatatacaaagaaaatagtaatagatctgaaaggagagaaagactgcaatacagtaacagtaggggcattcaacaacccactttcagcaatggaaagattatccaaacagaaaaatcattgaattgaaactgtactctagaccaagtggacctaacagacatatacagaacattccatccaacggatgcagaatacagatccttctcaactgcccatggagcatgattcaggatgggtcccatgttagaccacaaaacaggtgttatccagctttagaagactgaagtaatatcaagtatcttttcagaccatgatggtataaaactaggaataaataacaggaggaactttggaaaattcacaaatgcatgaaaattaaacaacatgcccctgaacaagcaattgatcaataaagaagttaaaaggaaaatttaaattttttaagacaaataaaaatggaaatacaacataccaaaagctatgagatatagcaaaaggagttctaataggaaagtttataacaataaatgcctatatcaaaaaagagaaaaatcttaaatagcctaaggttgcactgcaaggaactagaaaaacaagtagaaactcaacccaaaattagtagaaggaagggaataataaagatcagagcagaaaagagtaaaatggagatcagaaaaacaatacaagagatgaatgaagcaaaggctttttgaagacaaaatcaacaaacctttaactagattaagaagagagaatattcaaataaataaaatcagagatgaagaaagagacattacaacctagactgaagaaatgcaaaggatcataagagagtattatgaacaattatatgccaacaaattagataatctaggagaaatgaatatattcctggacaaatacaacctaccaacattgaattatgaagaaatagaaaacctgaacagaccaataacaagaaaattgaatcagtaatagaaagtctcccatcaaatagaagcccaggctttactgctgaattctaccaaatatttaaggaagtaataccaattcttctcaagctattacaaaaaattggagaggagggaatacctcctaaatcattctgtgaggccagcattacactgataccaaaaacagataaggacacaacaacaacagaaaactacaggccaatttccttgatgtttacacatgcaaaaattctcaacaaaataggagaaaaccaaattcaacaacacataaagatattatttacatgatcaattgagattcatcaaatggatacaaggatagttcgcatacacaaatcaataaacatgatacatcacattaacagaaggaaggataaagaccacataatcatttcaatagttgcagaaaaagcatttaataaaattcagtatcctttcaagataaaaactctcaacaaattaggtatagaaattaggtatagaaacagtgcacctcatgaccataaagaccatatgtgacaaacctacagctaacatcatgctgaatggggaaaagttgtaagcttttcctcaaagatctggaacaagatatggatgtccactttcactacttctattcaacatagtactagaaatcctagccagagcaattaggcaagggaaagaaataaagggtatccaaatggaaaaggaagatactaaacttttcatgtttgcagagacatgatcttatatatatagaaaaccctgaagagtccaccaaaaaactttagaactaataaacaagttcagtaaagtggcaagatataaaatcagcatataataattagtaacatttctatacactaacagcaaactatctgaaaaagaaatattattttaaaatctttatttctagtagctacaaaaatgtaaaatacctatgaatacatttaaccaagagggaaaaccatctctacactgaaaactgtagccgttttacattttacagaatcttgatgaaataaactgaagaagacacagataaatgaagaatatttgtattcacaaactggaagaataaatactgttacaatgtccatactactcaaagtgatctacagagtcaatgcaatctctatcaaaatacccatgacactttccacagaaatagaacaaagaatccaataggttttataaactgcaaaagacacaaaagagccaatgcaatcttgagcaaaaagaacaatgctggaggcatcacactacctgacttcaaaatgtactgtgatgcaatagtaaccaaaatagcatgatactggcataaaaacatagaccaatgaagcagaatgaagagcccagaaataaatctacacatttacagctaactcattttttttttttcaaaaactgccaagaatacacaatggggaaaaagcagtctcttcaataaatggttttgggaaaactggatagccacatgcagaaaaatgaaattagactattatatctcactctatacaaaaatcaattcaaaatggattaaagacaaaggtaagacccacaagtgtaaaactattagaagagaacatagggggaaaactccatgacactgttttgggcaatgattttttggatgtgacttcaaaaacagaggcaacaagagcaaaaaaaatagacaaatggaattttatcaaactaagaagcttctgcacagcaaaagaaaaaatcaatagaataaaagcagcctatagaatgaaagaaaatatttgcaaactatacatctgataagggattaatatacaaaatatataaggaattcaaacaactcaatagaaaaaagtcaaataacccattaaaaatgggcaatagacaggtatagacatttctcaaaagaaaacatacaaatagccaacaggtacgtcaaaaaatgttcaccatcactaatcatcagggaaatgcaaatcatgaccacagtgagctatcacctcactcctattagaatggctattgtcaaaaaaaaaaaaagataagttttggttagattgtggagaaaaggaaacccttgtgcactattggtgagaatgtgaattagtgcagccattatggagacagtatggaggttcttaaacaaattaaaaatagagccataatatgatccagtaattccactcctcggtatatatccaaagaaaacgaagtgagtatgtcagaaacatatgcacttctatgtatattgcagcattattcaccatagccaaagtatggaatcaacctaagcatccatcaatggataaatggataaataaaatgtatatagatacacaatgaaatactgtttagccaaaaaaaaataagaaatcttgtcatttgcaacaacatagatgaatctggaaggcataagtttaagtgaaagatcccaggcacaatatgacaagtactacatgatcacactgacgtatggaatctaaaaaactcatctcaaaaaggtagaactttgagtgatggataccagaggctggggtggctgggatgggagtgttggggaaatgttaggcaaaggatatataattatagttagatagaaggaataggttcaagtgatctattgtgcagcatgatgactatcattgatgacagtacattgtattcttgacaaatgcagagactggatgttaggtgctttcaccacaaaaatgacaactacgtgaggtaatgcacttgttgattagttagatttaaccattctacaatggatatatacttcaaaatatcatgttgtacatgatagatacatacaatgttatctgtcaatttaatttgaaaaagaaagaatgagaaaagatacttttcaaagagtattaatagtcatttttctgaattcctgtagtgtattttcaagatgaataagttttctaaagtaactgaagcatatctcattagccatcaaaaattatttttaatggcagtttttaatgtagatcttcagaaaaaaagcacacaattactgccttttaaaatagaatgcatgaaatacaattaaatctttccttgactagtcaaatcaaaaaatttttttggaatatcttctgttttacctgttatgaaaaacactaaaatccagggaaataaaagtttagaaatttattcttagtgcgtttacaatctcaatggaaagttaaatgtgtagaaggaaaagttacaatctggcctcttaaaggcgggacagaggtaaacagattgtgtttaagagtcccagaattagtaaagtttaacctacaagttgacatctgtggtagtcatggaaggatgggttaggatttaagaaggagggatacggaaggatgggttaggatttaaggagggatacagcattctagaagaaaaggaggggcattctaaatgattccaagaaagtggtaaattggggaaatggtaaaatgttcagtgtgcttgattagtagcagcttgagaatagttccagactttacaggagcatgaaaaaaattcaattcggatcacattactttcttgcttacaaaccattgttctgctgttactgagtaaaagtcttagcttgttaaaatgcaaaaaatgtgagcaagcccagccaagatgagcaaagccacatgcttgacctgcagttaaccacagatacataagggagtaaaacaaagatcattcaagcctggccctgatcagttatcttggagacctatgaccaataataagtgaccattattttaagctactaagatttgggatattttgtaactcagtagtatttcactgatgaattgtattagtgcttttctattcttctaccctaaagtaaaaatgtctttgctacttatcacattcaaagaaatgtggagctgtaatagaaacaaattttgccaggcaaataggaccatggtattgctttgggctggcatagatgcaattccatgtaattccatttcttgttataaacttggctctaactgtacaatgtatacttcagtatatggacagatgtagatgtagatactgtgtataggtatgcactatttatacctctcaaaaatttaccaaagtcttcatatccatagcactgatattttttaaattaactcttgttagtatggacaattttagctataatattcacaaacgtagagagaataacataatgaaaccctatgtacttatcaccaagctttagtaatttctaacattttgcatgtgttgttgtttgtaacaggcttttgttttgttttatttttgtttttgttttcctttcttttgacaacatgagtggtgttcaatgctactaagaacaaatttgcagatttttcctgcaatgcttgaaatgattaacctctgtttgttgccaagtaactcttgggtacgtactgatagcaaaagtaatataagaatattcacagcatagttaaatttggatagcaagtattatttaaagggtgcctgatattattgcttataggcatgtttttctttcttgtacctcttatttttggtagtaatcatgtttttaatgacttgtgatagacttgttttatgaaacaatagaaaatcaccataggacctctttagtaagcttttagagtgttgaagctacttgaaatcttctctggtgggagattattatttgctaaataattgtttgcataaactgactcctccaacagtgttagttaaatgaatcataacaattagtataaacagagaaaagtaatgatgatctaggcaagtaacttataggtgttctgtttgttgaacaaaagaatgaatggaaaattagggctcttatttatttatttatttatttatttatttatttatttattttttggctgtatccaggatagaataaataaaatgtttgttttcagtctgccttcacctatacttcttggtaagaaaggaaggatgaaaggaaatggtggattgagggaggatgagaggaagaaggaaaaaagaaaggaagtgagagaggctaattatctggaggttttttttaaaagcagtaatgccaccaaattaaagtagcttttcaatttaatgcacaatatttatattactattatattggcatttcagggtgccaagtgtaaagaggttatcttagatgcacagaatatcaaaaaaaacctgtgctatcatctcccagtgcagcctaatcattgacagaggtcaagaaagttaaagcaagtgctgaagttgaatatattaatatacaaaaatatagtatttgtattagtctgttctcatgctgctaataaagacacacccaagactgggtaatttataaagaaaaagagatttaatggactcacaattccaaatggctcaggaggcctcacaatcatggcagaaggcaaaggagaagcaaagtaacatcttacatggtagcaggcaagaaagcttgtgtagaggaactcccatttataaaaccagtagatgtcgtgagacttattcaccatcacaagaacagcatgggaaagacctgcccccatgattcaattgcctcccactgggtccctcctcccacgacatgtgggaattatgggagctacaattcaagatgagatttggtgggggacacagccaaaccatatcagtatcattacccataaagacacagatcaccaatgaaatttaattcatctagagaaatgcattgtagtagtactaaagttatttggttaactttatgttcctatattttatgcaaatacgaatttttttataagatttgggctgttataaaatgtcattctaaagaacatctctaatattttatgtaattactacaaaaattaaaaatagttttatatttataaaccttgaatttcagtggaggccatgcttattaaaattcactttctttttggttacagcattaaaggggcttctagaatgcttaccttttttcagtccactatcataatgagagcctcaaattgtatgtcatcattgggtcatgtaatcattaaagagttctacttatgagagccaataacagacatgaccctttcttctagtctgttcaggcaagcagatcaaacctcttcaaatcctacagtaaaagtttcactattgtcaaatatagcttagtcctaatgaagtacattaaatttacacaaaactttctgtccttgtttccaaacttcatctaaataagtttctcccacctccctcccacagcattgctcataatcaggaaaaatatggtgtctagtagaaaccatgttggaaaacacaaatgtgaaaaagcaatctacaggctgggcctggtgactcttgcctgtaatcccagcacttttggaggccgaggtgggtggatcacctgaggacaggagttcgagaccagcctggccaacatggcgaaaccaggtctctactaaaaatgcaaaagttatccaggcgtggtggtgggcgcctgtagtcccagctactcaggaggctgaggcaggagaattgcttgaacccgggagacggaggttgcagttagctgagatcatgccactgcactccagcgtgggtgacagtctccaaaaaaaaaaaaaaaaaaaaaaaagcaaactaccgaaatagaaaatatttgaagtatgtgaccattaaaattagaagaggtaggtttgaattctggcttctgtcctcactggacatttgtttttgaagtttctatgtctgttcctttgtagcaaactgacagttttaaataaagtaacgtaaccgcacaccccaaaacataagtgttaattttccctactgcacaccccaaaccacacaccccaaaacatgttaattttccctatgcatatgcttacttgtgatcttatatttatgttcttgtatcttataagccttaaatttatgctgagagttctagccaacaacacatctacttaatgttttgtcagtgaaattaagcagagggtgttatgtcaatatttaatgatagattgatatattgcatgggctactttgtttttaatccttggccagggccgttaaatatttattgacagttaccaaaaaaaatggtttttaggctaacttctttttgtaaatatatgttcagtaattgccaataacttccatactaactgaagtatattagtatataggaagctgttgctatgaaataactgtaatatttcaaaaactaaatgttttttatttcaatagttttgggggaacaggtggtgtttggttacatgggtatggtctttagtggtgatttctgagattttggtgcacccatcacccgagcagtgtatactgaacccaatgtgtagtctttaatcccgcactcccctcccatccttcccccaactccccagagtccattatgtcattcttatgcatttgtgtcctcatatcttagctcccacttataagtgagaacgtacaatgtttggttttctattactgagttacttcacttggaataatggtcttcaactccatccagggtgctgtgaatgccattatttcattcctttttatggctgagtaggtatttcattttatatatatatatatatttatacaccacattttctttatccactcattggttgataggtatgtaggctagttccatatttttgcagttgtgaattgtgtcataagctaaatgtttggaaatacattggaattatttctgaagttccggaatggctttgctattctacattaggtggtttattgaatatttttagagaagaacctcttgattttcagttgtttgtgtggggagaagagatggtggtggtggtcattcttcatatggggatttggaagatgaaagagtaggttactcattctttatatggattttcatcagtccttctcattttggccttgcatctcttccccgtaccctatcatacctgatctttctgggtactaagcctgtacaaggtttctaaacccttcatggcttccttcatggctgtggtccactctatgacagcccaggctgcagtttccaccactatgtatcaacagctccatgttaacaatagctttctgtctaccagaaaattgaactttcctgaccatttctgtttgaaatataggtaataaaaccacttttaatatgtggttatcatagggcagaatttttcaacctcggaattattgagcactattaacatctagggccagataattcttgcgtttgtctttcctgtgcatcgtaagatctttagcagcgtccattgtcaagtaacaccccctaccaattgtgacgatctcagttgagaaccactgtcataaaaccatgccaatgagtaatcatgcaggactgtgtatcacaaacagaataccaagaaatgtaaataccttctgcagaagcgcaagcatatgtaaaccaactcaatataatctggaaggtcattaaattacattatactatactttagaaatataatgtctttgtgatatcctgagacaagcagattatttaaaatgttctgactttcgcagtgacattgtgccttttttgtgttccaaaattttcttttgataagcatttctaaataacttgggatttatcctttttcatttatgaaggccttttatctgctaatagaaagaagaaaaaaagatatgctatgatcattttgcatactgcctcattgctagagatgctttccctcacaggatacataatttcttggaatagactattgttcctagaagataattagtgactgttttttttttttttttttggttttttgcctgtcaatagaagtgaaaacagtagttggcatgctcacctacttgattatagctattacatcaatcagcatccttttcctatgcttcatcatcatttatctcaataattatatattgtttcatttttctcaccattttttctttagcattaactatacacaaatttatttaaaatggctgaaattagtcatgcaatcagttggaattcatcctcacaacatttatgcaaaatctactgcagtaattgttttaaaagtgaaatttaaaaatattgaaccacctttatttattctacatctagtcgtactctcttttgtttaccctccatgtttttctccactcatttggtcagaatcagggtttagtgggtggttaaatgtgttctgggatctgccgtgagtcttggtgcatcaaacagggctgaagacaatgaaagctgtggcataaaggacaaatgtagaaggtgaaaaacgaatagagaccctgaaccttaacattatctccatgttgaccacggtttcctttggtattcttgagtaattctatgacgaaaataatgaatagagtattttcattgtttcttttaccttggaggtttatcaagatgttggacagcaacgaaatgtaaattccgtaactcatgtgttaggacactacttcataataaatattttttaatgagaaaaaactaaatcatgattatatccaatttgccagttaaatatgttccacacatcagtgaactaaggaagtgctggagaattgttcttagtaacttggataagcaggaccccgattgtattagtcaaaaaataaatttgggtgtatactttttattgatgtgtcatagttatacacattttggggtgtatgtgatattttgatgaatgtaggcaatgtgtaatgatcaaatcagggtaatggggatagccctcatctcaaatatttaccaattctttatgttggtgggaacattacaattcttctcttctagctattatgatatatgcaataaagtattcctaattataattttcctgctgtacaatagagtactagaatttattccttctatctaactatatttttgtacatgttaatcaacttctcttcaactgcccaaagcaattgacacattcattgcaatccctatcaaagtactaatgtcatttttcacagaagtagaaaaaaaatcctaaaattcatatggaacgaaatggagcccaaggagccaaagcaatcctaatcagaaagaacaaagttggaggcatcacactacttgagttcaaattgtactacacagcaacagtaaccaatacagaatggaactggcacaaaaacaaacacatacaccaatggaacgaaatagagttgttatgaccaaccattctattctctaccttcataagattgacttgttttgctctcacatatgagtgagaaaatgtgatatttttctttccgtgcctggcttatttcacgtaatataatgactttccatctatcttgctgcaaatgacagattttcatactattttattgctgaatagtattccaatgtgtacatatgccacattttctttttattattttgaggaaactccatagagttttccacaatggcagtactactttacgtttccaccaacagtgtacaggcattcacttttctctgcagcctctccaacatttgttattttttgtctttttgataataaatagcatttctagctgggctgaaatttctcttcgtggtttttgtttgtgtttttgtttttggtttgtttttgaaacggagttttgctcttgttgcccaggctagagtgcaatggcgcgatctcagctcactgcaacctccgccttccgggttcaagcgattctcctacctcagcctcccaagtagctggtattacagctatttgtggttttaatttgcatttctctgatgaagatttttgctgttgagttgtttgagctctttatatattctacttactaatcccgtgtgtattagttcattcttgaattcatataaggaactacctgagactaggtaatttatgaagaaaagaggtttaattgactcacagttctgcaggctgtgcaggaagcatggctagggaggcctcagggaattcacaatcaggcagaagtgaagaagaagcaggcacatcttcatatggcagagcaggagagagacagcgaagggggaagtgctacacacttttaaacaaccagatctcctgcgaactcactcactatcatgagaacagcaagagggaagtccgcccccatgatccagtcacctcccacaaggcccctcctccaacattgaggattacaattcgacatgagatttggatggggatgcagagccaaaccatatcaccttgtcaggtagatcatttgcagataatttcttccattttgtaggttgtctcttcactttgttaactgtttcctttgctgtgcaaaagctttgtagcctaatgtaatctcaattatctgtttttgcattggttgcctgtgcttttgaggtcttaaccaaaaaatctttgctcagagcaatgtcccctagcatatccccaatgtttttgtctagtagttttatactttcaagtcttatatttaagtctttaatccattttgagtttatttttgtatatggtaaaagatgggtatctacttttctgaatatgaatatccatgtttcccacaccatttattaaagagactatcctttccccaatgtatgttcctggtgcctttgtaaaaaatgagttggctgtaagtgcatgggtttgcttctgggctctctattctgttccattggtgtatgtgtttgtttttgtgccagtaccattctgtattggttactattgctttgtagtacaatttgaactcaagtagtgtgatgcctccaactttgttctttctgattaggattgctttggctccttgggctctatttcgttccatatgaattttaggatcttttttctacttctgtgaaaaatgacattagtactttgatagggattgcaatgaatctgtcaattgctttgggcagtatggtcattttaatgatattaattcttccaatgtatgatatgagtgtgggatgtcttttcatttgtgtacatcctcttcaactttcttcatcagtgttttatagttttccttgtagagatctttcatctccttggttaaacttattcataggtattctattttttgtgctattgtaaaggggatttctttctgagctagttaattatttgtgtatagaaatgctactaatttttgtatgttgattattatcctgcaacttcactgaattcatttatcaaatctaagagttttttggtggagtttttagatttttctatgtataagatcgtgtcatcagcaagtaaggataatttgacttctttctttcaaatttgaatgccatgtatttctttctattgcctaattgtttttacaaagacttgcagtactatgttgaatacaagtggtaaaagtggacatctttgtcttgttccagatctgagtggaaaggctttcagtgtttccctattcagtaagtgaaggatagtagagattagccagagcttatctcataataaatgactatgacattagcctaaaatatgaaactttccaagaccacttccctttgggggatcacaaggagatgagtcatcagtcactgccttacatttttgaaatataaatcaacattgaatagtaaaattagccttatggataaaaagaggtgactaaactgatttataaaaacttgtctctggataattaatccaccctaaacttgcttctcttatgttgtctccacatatggttaaatggtaccaccattcatgtgtttgctcaagctcataactagggatcatgccccttaactcatgaacattcgtttataattcacatctagtcagtcagtaaattttgttagttctacttaccaaatagatacttaagggaaaaaaattctaccacttccaccaccaacactgtgccgtcgcctttcagtggactgcctcaacatcttcctccctgccttcctgcctccattctgcctctctgcctccacaccacttcattctcccagacttgaacaccaaaatgccagagtgatacctctggtacaaatgctacttggggctctcttatttttaaaactctccaaagcattcctcttatacttaaaataaaacccaagtcctttccatgttctacaaggcccttcctgcattggccagtggctatctttgaattcattgtcactctttttttacatcattatagatacagtggcattctttgccctctcttaagcatgccaagtatactccatctcagcacctttgaacttgctcttccctctgcctggcataaacatcctccaggttttgctatgactcacttcctcccttctcacagatatgttccaaatgatcatcagagcaagctttcctgacagttttttctaaaatagcatttacattagtctctatctctttagctgctttaattttcatagtacttataatcacctggcattatattgtgtgtgtatcaatttatatgattattttgcatctccttctctggaatgcaggcttcatgaaagcagaagttttgtctgtcttgttcactattatagcccctagtacctggtagagaggaaatattttaaaaatattttttgaatgaataaatgaatatttttatagtttaattacaaaccacacttatcaaattaaatgaacaaaatactaagtatcaaagctagccaaatgaattccttggctttcctaaatacatgtcttttgatggatatattatgagttacttccttggaagtatttgttctgtctccttggcatgactcttaagttaccttgtatatgttgttagtttagtcatcaactgacctccccgcacctttctgttcagttgcttagtcactcctcactctttgaggctcctgaggctccatgactccgtggttagtcaccacaattatttgcaacagaaaggagaaatgttgccaaccccaaagcattagagataagtgaaaaatagagcacccctttcaccccaagtggattcacctagtaaatgttgatgttttcttctgtccatttccttcttctgcaaggaccatgagattgtgtttacattctacagctctcacaagatgtatgctccaatattagaaactaatgtttaaacattccaggccaaagaaagcaaaactgaaattccactcttgagtcattcagaggttgaagcattatgggtgatccaagttcccctgactatctgtgaacacaggcagttgtttgtcaattcttttaagttaaaaaaaaatgcacaaacaacctattgtaaaatggagtgagtcagtgcaattgcacaaagcatgttttattgtcagctgtataaatctgtgaatatttttcgtgaccagttttagttggtggatttaaatgaggtcaccaaaaagttatctctgagtatagcactcgccacagtgcatcataaatatgctctcatctatgaacatccttatgaatgactctatgtcttactcattcttttatctctaaattagtactgactattttaggtccttcataaatgcttttgaaattggattatggaggtatttataattatctagattataagctctttcaggactaaatgctatgttttgtttacatttgatccccttatagtcctgtacattgccttgcatatttaaaagtctttagaatatttttgttgaattgatttgttaagtatagatcaatccccctgctatggaaactaatgtggaaagtgttaatgattcttaaatcagggtctaaaccccttttgatcctttggttggatgtccagttcattatttcacaaatagtaatatttttcttgtcaggctatataggctgctaaatgctattatcccaaactttgatggatataattagaacagatttattttccgtctactatatgcaggaacttaatctgttttcctattaaatcctcacgacaattcatgcaggaagactatgtcacattctccatataaaaagactgagactaagagatgttaagtaatttatccaacttgccaaacaaataaggcagaatcaggaactgttagacctgtttccttgaacactaactgtgtgaaatctttcctactctaccacaatgcttctaagaaacaaagtgggccgggcgcggtggctcacgcctgtaatcccagcactttgggaggccgaggcaggcggatcacgaggtcaggagatcgagaccagcctgactaacgcggtgaaaccccgtctctactaaaaatacaaaaaattagccaggcatggtggcgggtacctgtattcccagctactcgggaggctgaggtaggagaatggcatgaacccaggaggcagagcttgcagtgagcggagatcgcgccactgcactccggcctgggcaacagagcgagactccgtctcaaaaaaaaaaaaaaaaaaaagtgaagggaactagttaaaatacattatgaaaattatatatgactttgaaagaaacattttatggtaggataagtatagatatccaaaatgtatcgaatattctcaatagtatttgagggattagtatgtgaaggattaaaattaacttttaaaggcgtgattgttcaacagagaaagatacatgtattatagacacctcacatttctctccacgttaagaactttaaaaagactcaagaatcttggcctctttaccctggtgttgtcatatttgttttaggaagatagtgttttactttttaccgttccatagctcaagtgtaaaagggatggggaaaagagggagaggctgtatccctttatgaatactcaggaaaagttaatatagatagggaatcaatcctgtacacatcttcatgtgttctgacttctagatgtttctctaactggtagctagtaagaaaaattagtgtccttaaaatgttccttctattatgcagaagctttgtcaactgagacattaataactctgtaagagaggtctgttattatttaaatgtctatagagctttaccgttgttaataggatgttctgaagaataaaatgaggtcttgaaaatacttttgttggtgaatacaaagctatgtttaatgcaaaattagtgagagaaaaatctctactataattgctgtgggtttttgtggacaaaatatgattaggatttaaaattaccctgtgcttcatatcattactgttacactttgtttagttttcaaagtgatttccatttgtgagtgagtgtgcatatgtgtgtataggtgttttcaaggaagagagaaatgtcttcgtaacacaagttgttttcttaactataaaaagccagttggcttagtcatggtctaatgctaagaacgtttcttttaaaattgtaatttgtttgaatttccttctagtttcacctttgccagtgcagaaaataaagagggtttttgtggttgtgtgtatgttcatcttgattggccattaccatagctgcatttgttttccagttctgtgttctgtcaatttaatccaactaatatttatgaaataccataatgttccagaaacattcaaataatggaaaattcagctcatattcttcctttgtgactttgtgacagcaaaattggtcaccctcaagtgactgtagaactgagctacatcttagctttagcagtcacctccttttcacagtcattttgccaatgtgtcaaatcagtggctcagccattgtggtctctggaagtttcccttcacttctatcaaagacaggcaaatcacatgagaaatgtatccaactgatacccatgataataccaaaacatgacacttacagatgatgacagattgcatggcaagagctctctgccgtaggttatgattatttagttgcatgtttccagtcttgtaacagattgcacacaccttgaggggagactgcacagacccatgcaatatttgcttgacagaattttccaaggagcacataacaaagaatggggaggaaaagatctaggaaggattctagtttgaatttgctctgttatttttggcaagccttttgatctttttgtacctcagatccttgatctctaaaataatagagttgaatcagtccagtttttttttaagttattaatattttttattaaattaaaatttatttttaaatttttattaaagttttttaactacaaagcaccgtaaggtataaggacagaaactaaagatattccaaaccctgtatcataatatctggcacattattctgtttaatatatatcagttgaattgaattggatttgtttggtcaacatcttgggtgaaatactgatgtataaggtaaaataaaagcagaactaattttgtcaaagaggaatgggtggcacaacaaggcagggaactgagcccagtgggcacccccaaactccacctactcagaggggcatggtgaaaatcataccatgttagagaacacagtttccaaatcaaagaacttaataaccgtgtaattcttcctggcttcaacattctataattccatgactgagctttaaagaattcctttactaacatctagtttgccacatgaaagtaatatgaaagatgttaaggatgttgtaacattatgccgtcaagtgggtggtgggttatgatggagaaccacaaaaccgttttgtatttctgaacaaatgtactgcatacgggttttattatctttctctgtagatctttattttttgccttactgcaaactaatgtggtatgcgtttgaacagggaacagttctctcaggtgctttctgtaaaaaactgtcaagtcgtctacttgtaactacatagtcacaagattatataaactgacataatttactgaatacaacacttatttagataccatagttgcttttgaaattcactgaaaccatttgataaccagagtctaagaaatgtagatttccaacctattaatggcaaactattttgccaatatttagtgaatataagctgattatttaggcagtagaaaaataaaatccattaagatcactttaggcaggaaataagagtattaaagattaatcagagtgatatcatatctttgagaagaatttcaaagcgattgatctcatcctattacccaaactttcctttgccctttatttctgtcctcttgttaaatagtaataaagatgaatggataattattccatgagctatgaacaaaagctatcaatcatatatgaggttgttcttccaaactaaaactcaaaactcattccttttattctctgacttggggcatgtcattcctttgtacttaatgtgttttcctttaaaaagaagaggaggcaagctgctaaagcttgaattcttgaaccctctggtgataagtatatgtggccaactcttggcaattctgcctagattagccttccagttatcaaccaagctggcatgtcctcttggcaaggaagaaagaaagccctcaaagcaaaaacatttagtttagcaatccttaaatgataatttatatacttgatacagagtagaaatttcggtgacaggtttcaagggacctaggcaattcgatgagagagggcagggcagagtgaggaggctagatgaaggagagctgactaactaaagtccagatatagtctagtttagctaggaatgaagtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaagcatgaacatacaggatttatacaagtcagggtgttaatatctttctttgattcaagccttttgaattaatgtcatataaatgcaagtagtattataattgctgttattttgagatggaaggttacagatagcattgaaacagtgccacatatgaagcaaataggtgtactcaaattttatcatgcactttatgcatgccatggcatccttaattacactagaacttattgctacattatgaatacatttttatttataaattcccataagtagccatgctcatactgatctttcaataattcataggaagatgtatttctaaggagttatataaaactattaaacattttgggccgagaatggagggttttatggtaccagttactataatgaacatagtaaaaatgaaattaattgtacgcctttgcttgacaatataatgaaaagaattttatggttgattgttgcccattgggtttctttttactgtccttgaatttgtaataagtcagattgttctctacctcttactacactgttttacaaaatagaataattggtaaagctgtatttaaagctttaccttctcttgaacaaagtcacaaagactaaccacagcaaattaaaaatatggaaatttcttaagcaaattggaagtgactatacattcatttgaagaaatatgggcatgtctgttactaaaatgcttcaaaaaatactcttaaatcctttattgtcactcaaaaaggagcatgaggtctctttaaccactgactaaactagtggattattttaagcaacttttattttgttgtgttttatgattttggttcatagtgtacagataagtcgtttactagttagagaaattcaaccttaatctttggatttgtgagcaacagttgatttgaagtaactaccttaatagtattcttgctactttgctagcattgctagtaagtaggtgaatcaaaaagggtaagtgaaaataggaaagaatattaaagacaaaaaaggcttgagatgaggtgtctaaaatatacgttttttccaaaatatgtatttggacttttcattttcttaaggatttaatttttgccctttccatatttgacaaaactgcctattcaacaggttcaaaatatgatataaatcctaagagggactgagtgaagagtcacgggttgggagtaaagagggtggcctgcgcccatgatggggaacttataacctactctgttgaaaaccttcaacagaattttacggtccaagtattcagaggtttgcctccacttgttcccaaattgagagttgacctcagagggataaccaaactcttgtaagagttacgttataagaaaaatcatcaggaattacacaaagctaagcttgtacatgtctggtgacctaacttgagcatcctagttaagttacacacgtatccaatcaaccctagtaactgtgtgtccatagattctctagtttgctcacaaatatatgtaattcattaataatgaactttgatataatcaggaagtgcatggatttgctcttcatcttcaaattcattttctctgccatttgctagccgtgcctacctttcccattttctatatttctgtattttcttgtgtcctgttcttctaattcctccatcttttcaaactggaaagggtttgatagtggtcatttaaattcttttattgtagaaagaaagcaaaaagcactaaaagcaaagtacttaggaaaaaatcatataatggaaactaaattcatataaaatatgtaaattgtcggctttgaatttgaatcaatacgtggtcacaacctggcatttccattttaagtggcaactgtatgttatttctaaatgtaaaaaaaagaacactgtccatttacataactttcaggcatcagcaaatatgtgaatagcacttttttgggcaaaaggcccagaaatttcactgtacagttctggaagtcaatctgggaggtgagcctgagtattttttcaggctactatagtcaagagaatcaaaagacagccacaattgtcttgctaaacctgagccctgaggatgtcattcagagatgtggcctgcctgttacggccaggagcccactttcagaaccgtccaggacagagagcatattctatcgctaccagactttcaaagagtagaaatccaccctacccttgacctaatggtacaaattatattttacaactcagaattcactgaaaattatcattaattacttacctagatatgtgtatcactttatttaaatgtcagtgttgtctttaaaataattataaaggttaatggtagaaattttggggaaatagagagaagaatctttttcttacactctacattataaacgcattctgctcctattaaatattctcacaaaatatccttttaatggccgatgtgaatgtcatataatttcatatatattgctggaaatttgaattcttcacatttttgttattataaataatgtgatggtctttacctatacactttccctctgactctatagttatctcaacagaacaaattcctaaaagtaaaaatactgggtaaaaagaaataattttgttaaaggttcttagtacatattttcagaattcttaccagagaagttgtataaactcccaccagaagtatgtaataagtataaatactacttaatctttaacaaaattaataaaagtatatctttataacataaaactcttaaagatctctttgatactaaaatcacctctctctcctctcttttacctctttttctctcttcactcattaagtacaagtggatgctctttgagtttatccgtatttgaaagatctagcccatttaggtaaatgtctacccttgagaaaatatacaaacctaatcgaatgtctataatctctatccattttcttctcttgctcatcctaatgctcagctaggaccttcctccagattctatgtttcttaataaagtgcccagtaatttcgtgatgtactgtgggcacatggaatgtcaataaatactaactgacaataagttcttcacagcacaaaggacacacacctctaaattttctgcaagagaatataatgtgtagactgaactgtgtaagctgcccaaccgtgctcttatttttctttactaatttattctcattgttaagcttgttaaaaagcaagcactttttgtatctgagtgggtaataaggattcaccagatattcacatctggaggaaaatggttggggacataaagaaacttcagatttttaaacatagatcttagtaaaaggatacacattttatccaatatatgcaattttatccagtttaactataggctacttaaaataaaatgtcacactagaaattaattagcactccttggcttgttccaccatactgtagttgcagaattttagatttggaatagaccaaaggaaaatgtccatacattttattacagatcataattgaccacaccttttctgaatagttactactctgtgttagtaaacttgggaaatctttttgtttcctctctagggtgagaaaatacttaatataaatatcctagaaacaacattatttaggtgttgaatttgataccgaattctgaaagtgtcatgtaatactgttgagtctaaacattattgttttgctgagttgtacaagtgatgtaaatatgacagttcccagagataggaaagtcagtatcggccagattttctcatctacattcacgctactggttgtcataagcaaatgtaaggccattgatttgattttaccggatcatagagcatataaaggacatattttcaccaacaaactcaaattaaaaaaccgtaaaacttccctttctactacgagaaaaacaataatatcccaagtccaagctttttatggaaaatgtggttctttttgcccatttaagaaagacataccaatcagcatatttctagtgcctgaaataaacctgttagacataaattaaaccttttggacaaatagacatcgtaattaaaccatggaaagataaataaagactggtattataattatttaaactatggcattcaattctactcaatccaaatttatcatcccaaggtaaatgaaagtggtaactcttaacagctctcttagtctgtcttgcttttgaaaccaaaaagcaccctaaaaattgtgactgacctaaaaaggaatacttgtcataccactatttcagttattatcgtatatcattaaacagatgataaatcaataaatggaaactagtattcgtattttgaggtcattgtatgacctaacttacatgattctctcagattctcaaattcagtcactttttggtgacagagaggagaaataggtttggaaaaaaatacaactgcatgtttgctttaaaaactgctatctacgtagaagttgaaattcctttttatgttttaagtggtcagggccagtcacggtagctcactcctggtatcccagcactttgggaggctgaggcaggcaaatcccttgagctcaggaatttgagatcagcctggtcaatatagtgagacctcatctctacaaatatacaaaaattagcttggtgtgttggcatgcgcctgtagtcccagctacttgggaggctgaggtaggaggatcacttgggccgaggtgattgaagctgcagtgagccatgattgtgccactgcgctccagcctcggtgacagagcgagaccttgtctccaaaaataaaaaaaagttttaagtggtcaagccctagttctaggacaggtttgcaatcccataaaaaagatggacgtgaaggtaagaacagttccagtgggccaatgatatccaaaagtttggaagtcagttaaagcacttttttaaaaaaacttttattttaggttcaggggcacatttgtaggtttgttatataagtaaacttgtgtcacaggagtttgttgtatagattattttgtgacccagctgctagtacccaatagttatttttttcttctctctctctctcctcccaccttccaccctcaggtaggccccagtgtgtgttgttcctctctttgtgtccatgtgttctcatcatttagttcccacttataagtgagaacatgcagtatttggttttctgttcctgcattagtttgctaaagataatggactccagctccatccatgttcctgcaaaggacatgatctcattctttttatggccgcatggcattctgtagtgtatatgtaccactttttaaaaaaatcgaatctgctattgatggacatttagactgattctatgtctttgttcttgtgaacagtgctgcaatgaacatatgcattcatgtgtctttatgatagaaggatttatattcctttgggtatatatccagtaatgggattgctgggtcaaatggtagttctgtttttagctctttgtaaacagacaacctacagaatgggagaaagtatttgcaaactatgtatctgacaaaaaaggtctcatatccagcatctataacgaatttaaacaaatttacaatgaagcacttgttaaagtctttaaaaactgggacagagacaagtgagttttcttgttcacttactttccaaaagggccagaagggaaagaagaagaaagaaaaggcccaagaaagagtgctgtcacagagcaatgcagagagtccatttaagcttccaactcctggtctagtccccacgctggacactgacacatattatgcagattactcttttgctgcagcactaagagtactattttatttgttatcagtcagttaagaagctatataggtataaatctttgcaattctaaatgaagaactttaggaggtggagggggtctggaagttatcaggtcaaacctttttctttcttttttttcctttttttgagacagagtcttgctctgtctgcccaggctggagtgcagtggcgccatctcggctcactgcagcctccgcctcctgggttcaagggattctcctgcctcagcctcccgagtagctgggattacaggcatccgccaccatgcccagctaaagtttgtatttttagtagagacggggtttcaccatgttggccaggctggtcttgaactcctgatctcgtgatctacccaccttggcctcccaaagtgctgggattacaggcgtgagccaccacacccggttaaacctttttcatttattgatgagaaaatggagactcaaaatggctacatgttttttacataaaaaatttacaaaagcttgttattgccattatcatcatcctcatgatcatcatattatcactgttagtgtttttgttgttataattaagaggcagtgtacagtagtggctcccagttgaaatctcacacaggcctatgtgacagtttagctccaccatttacttctagtgtgaccttgaacaaccagctttcagtttcctaatcaataaaaaaggtaccaagatagtactgcttctatggaggtaatgtgagtatttgatcggataatgcatgtaaaaattaatagattacttggcatatattaagtagtcaatacatgtttgctgttagtatttgagacatttgaatgctgtaaaagagtactgtatatagaagattcttgaaatgcattttgaatgtcaatgcttatttgatcatgcttatattcttactacagtatcatactatggcagcagatacagccttcattacaggataaataagattttagaaaatttatttccatctcccctttaaggattcaatatgcatactaaatttttgtatttcaatgaaactttttaattatagaaattattgattttagattacttaattcatcaagtctagccaaatgcatatagtaagtacatagttataacagaagaaaactatctctattcttatttaaagaaaatgataatttaaaggacactatgccacatgaatttataaatgaccatcaagacaaaaataagagtaaaaaaatttctcttttgtaaacagaggaaattcaggtataatatttttaaaaacaagagacctggaaaataattttccaccattatgcctgtcaagttcttcatgaaggttttgatgatagtcatatcattttatacaaaaaaatgctgcttttcccctgacaaacactgttatcacaaagctttctaagtcattcttaatgattgaagtttactagcatataaaaatacagtcagtattgtatgttaacaagaactactcctgaatttgcaaagtaaatgccaatttatcagaaataaacctatcaaagaacattacgttgtagaatattgaaagaggttttagaataagagtatgcactgcatgactgatgtccattaaaatagaaactataaaaagacccacatcatttaaagtttgaatataaagagatacattcacccataaatttcctctcaaatttcagctaaataactaaggatttctaaattatatgcagactctccatgaaaaataactagtgcttcaataagattatgaaaataggttaccagtattttatgctttcatgttaaaacacttagcattcctgtcaaaccttactttatcaacttagtatattcccacagatttgtgggtaaattgaatcatcatcatttcagagaagtgttcccttcatttttgattgattttcgattagcagtggcttaacatgtcaggtttaagaggctctgtcccccattctcttttaagcagctaatgatcaatgaaagatttatatgcataaaggaaatatgctatttaaagaaactctgtggtgaataattttatataagaacccttttgtaactgaatgatcacccccataagttttccctgtggtaatgcagatttttacatttttgtaagatgaggttcatcgatatgaaactgcaagttgcatctccaactgatccagaaaaaggatcatccacccattaccatgtgtgacctcccgttgtttattaatggaaacaaatgtcctcattgtgactttctgcctcctctgaggaaatattacattttactcaccagcttcagaatcaacagtatttggttttaatctaattctttgaaaatatattttgtagggtagaatagttaagtaaccagaatatctcatgtccaattatgacaaaatagtttattttcataagggatatgctttgaacgccatcctactaccttatctgccttggttttgttgaaatataccctagtaggataactgcccatggtgtcacttgtttttctataactgtgatgagagttcttatttccaggtttaaaaggaacatcttgtattttgattcttctaaaatttgtatgactctcattttatcattctggcagtcacttctttttatcttaatgtattcatatatgtttaataatttcttttaaatataaaagtatgtacaatgccacttgatttgcagctttatgaatgaggctattaccaaaatgtacttaaacatgtgctccgaaacatgccagatatttacatgagtccaatacatagagtgtccataaggctttaaaacctaagccccatagcaaaacttcatgaagaggcttccttccaattcaccacacacaagttcaacactactttttttttttttttttttttttttttttttgagaaggagtctcgctgtgtcgcccaggctggatgcagtggcgcgatctcggctcaccacaagctccgcctcccgggttcacgccattctcctgcctcagcttcccgagtagctgggactagaggcacccgccaccacgcctggctaattttgtgtgtgtgtgtgtgtgtgtttttagtagacacggggtcccaccatgttagccaggatggtctcgatctcctgacctcgtgatctgcccgcctctgcctcccaaagtcctgggattacaggcgtgagccaccgcgcccggccaacactatttttttagaaatgccaaggatctttatttaattttgtaataaaaatttataaaatctcattataacatatactaattgaattatgaaaggaaaacaatcttgatttaaaaatttttgttttccaaaattaatctgttttaaaataagtcttggcttcatggtcttgtgagaagatacctcccaccgctagatctggtctacaacaagcatgacaaaaagccaggaagttgcttaagagtccaagagagtgaataattttctctcccttccacttctccccagtgaggctaccgactttctcactctctgagtgtttgtttctagtttagtaaaagcagagtacccaccttggacttgcctgttgaagaacttttatagaatggcggctctttgagtaggaaaaaagcaaagcagaatgcattgcttttctggaaaaataaaactgagtgcatcctgtcacatcaagccatcactaggaacaggatacttaacaatacggcaggtcctaggaaaatttgagattattaccacgaatattcagtaagaagccattaccattatgtgaaatagcttagggaaagttcagaaaacaaaatattttttattttctcttcttaaaagaaaaaaatgtaatgtttccgatgaacctgtatttctgatgatgatcatgtcaattatcttggcaactttaagacttcttaattaaatgattaaaagttgttactactttctgtaaatgtacctgtttttgactgaaatatttggggtgcaattagactagttttatgcactctgcttattgtatagcctatttataagtagtatgaatatttctttcagaattacatatcacatacaatattgattaaaagacttaaacaagatattgttcttaggcataaatataatttgttttttaaatcaggttcaccatattcaacatgaatgtaatttgtaatgattattattttaaaaaaaaccctgtctctatttaccataaataatatgttgtcactccaatgctctttattaggacttgctactaattacagagtgagaataaggtttttatgtaatgggagctaaataaaatgagtgaatcttatattagatgaatacatgagatttcagcctcaggagaaattgtgtgtcacagagaacatcggtgactattatgaaagacatgttcagtcaagagggaatcgtactgttgactatcaacagggcagaaagtactggattgtattttctttcagtcactatgtgcatgacctaaaatagagaactgaggcaatatatacataatttagaagggaaataatccagaaattttatttttgtctcaaatagatggctctttcaagcaaaggttaatttggggatttttttttgaggggtcaacttcctatgtctaagcaatttaaacttgaagaatcacaggatttaatacttcatagttagagctctggtcataagtgacaaatcacttaaaagacaggagtggtgctggccttaagaaggattggaataatgctcgactgttctctgtctttcttctctactctttctgcatgtcatcattttgtataggggtggagagtggtgggtctgggtgagtagaggagggcatacagggtgaaggaatacgttgctcagttcttctaaccaggaggaaatgtgggtttggaactttagtgagaacttgaagttccctaaggagaaatcctaattggcctagaatgagatacagatctaaattttggacggatcactatggcattagaggtgaggggcattggctcagtggctgttgtgtgtctctctctcctgtgatgaagcctgtatttttgtgtgagtacgtagatgtggcagttggtgggtgggtggggaggctggtaatggggcttttaacagacaaagataggggaaaaagcaatggttattatggagtccatcttttcatattccatattcaatatttgtttaacatccctggttaatccatctcattaatttagctgtcatctttattatgcctcttcattaacttagtgagggtagaatgacccatcctgattgatgcatttgaatgcagtctctcttgggctgaaaactcttccattgctcttctcccaactaatactgacatcctttcctgtgtatctgtagtgcatacgtctcaactctagacctgcattcatctctctgctgtctctaagcctgcagagtatgttctcttccagccttaaacctaaaccaaatggcagattcttagctgttaaatacatttttaggaaaaaattaatatgctttctagagctagagaatggattataaaatcaacttcacgtaatatgaataagtaaagtgaggccagatgtaatgctataaaggagaatggagaccatgctgaagtggggaaaacattttctacctataaaattttaaatttattgttaataccatcttggccaaataaaacttgtctagtgggtagttttagtccagtggcctgagtgtctgatgtcttgattggtaaatcgagagtttatactacgaaatactgctgcactgtggagccggtaggctctggattcagaatggctatcacgaaatatgaatctgttccatcatattatagattggaacatgacataatatgatttgtaatgtgtttggagtaactaataaaatctcttacccaagaagcaaggagtttagagcagcatagttaattatgaaaggagaatctccccatcaggcgatacaaaaatcatagagttagaatgaaatgggcaaattctctttagcaatctggccccacaaaaaagtagctatgtctattttgtcattacagacttgttaagttaacaaaagtagaaatgtctgttaactctcccagcagacattttcatttactcttctctgcacatttccactggatatatgtttgttcctaaggtcctttactcaaggctaggcattacctaatttacttgtgaaaatgtgccaagaaaaggatcagtgattattcttgcttcattatttaaagcctactttcatgaatgtaatgcagtcatcattcctatgtattgtcatcagagtcgagagttgggacgacagagagtagaaatcctataacaggcattagaatttttagtagataataccaaaaattgaagcagagtcagtatgtcagactctaagtttggcttggtaaaaaatcctctttgtaaattaaaaaaaaaaattaccagactgccagcttaaaaatattatgtgtttccaaatagatgagaaatgtttgaggtgataaatattccaattactctgatttgatcattacacattatatgcatatatcaaaatatcacacatacccctattagtatgtacaattattgcgtattaataaaaaggaaaaacatttgatgcaaatataattcttgtgtatgtgtggtcttaattgatattcttttaaccaagcttactgagatatttatattgagtaaactatatcgtgttcagggtaaaaatgtatatgttatgtgtctgcctgttatctagaagataaaggccactttcttcacagtctgaccccattttgtctttatagtctcatgcactctcctcttaagcccacgccactgaccaggcacccttgaccataccatggacctacataactctatcatttgtacatgctatgcccaccacctgaaatttcctctcctgcctttttcccttgtgcctatctactcaaattttaagaccaacctcaatgtcaccccaatgaactcttccctgactctactcccactaggcagaattaaataccacctctcaattgctagcaaatctctttttcacacctttattagaacatttctctcatcatttttgtacatatttttgtgtgtctatttctcttgttgcatttcggactcttagagcatgtactataatgttttcatctttacatccctgatatgtaggacagtatctgatgcacagaaataaataattcatttagcattcactcagctttaatagtcataaataaaaaccaacatacatatgtcactcttcttttagtagcatatactgcagagtaatggagtaaaccacgctaaaactgttggttttgatttaattgcctggtgtgattgaagattccccttcatggatgagagagacagatagagaaaggcctaggagtctggctagggaagtctagcaataagtcaaatcccgattagacagaggaggaaagatcagatggatattgaaggtcacaacagagcagtaggttgagtttggataaataaataggggttgaaagaacagttatatatcagttcagctagaagactggtcaagggtagagacttttcactggcgtcttgagtttcaggcagatctctaaatttagtaaagtagactccacaatcttagggccctgaatgagaaattggttcgctagttccatttatgactttattactgggcacaaggtctggtcaaatccacataggtggctaggtaggtagataggtagatgaatagatagatagatagcttaacaaacagacgactgtctacaaggagtttatgttataatctcggttaacctctggatgttccttgttccccaagacgccaagacttcctgtctttcctcacagtttcagtcatgaatgtcagctctcgttctaatgagctttttaatcacacagtcgtgatccagtaggtacagctttccttgattagtgatcttaatttatctttgctttgagagtaccttacatctgcaagacatttaagtatgttgtctcatttcatcttttcaacagcctgtgatgtctattttgcctccattttacagataatgatcaaagcttatgtgtggcacttgttgtgacacttctatacattagtgtattgaatgtgattacctgttttgctcctttgttgagttctaattgtgcacaacatgcaatactcccttaaatccataaccttcctgtaatatttaaaatggtctattcttacagactacttgagttctgttttcttccactgttaagagagtctatgtctcatcaagtagaacatctagtaataattccattgaatataaacttgtctttgaaatgtttctgtattatccagttcaggttgctaaaacaaaatgcctttatactattgcttccaaatcttaactattggaaacagtgccgcaacaaacataggagtgtagatatctattacagcataactgggttattattgttaataaaaacattttaaaataacttaaagagtgtaattggattgtttgtaactcaaaggataaatgcttgaggggatggataccctattctccatgatgtgcatatttcacagtgcatgctgtatcaaaacatctcatgtatcctataaatacatacacctactatgtacccacaaaaattttaaaaaactgaaaaatgccttatcctgattgatttataaaccacagaaattaatttctcacagttctggaggatggaagttccaagatcaaggcgccagcagatttggtgcctggccagggttctctgcttcatggatgatgccttctagctgagtcttcccatagtggaggaagcaaagcagctctctaacccctcttttataagggcattaatcccattcacaaaagcagagccctcatcacctccgaaaggcttctaataccttcgtcacctgctgataccatcagcttggtgattaggtttcaatatgtgaattgggtggggggatgaaaatattcagattacagcggtttctcaggtttttggttttgggttttgttttttgtttttctattcagttgcatgtctcttgaatctgcttctgttcatctttgcctcctattttctcattcccattttttttgtacttctgctctttcaagtacattttaagagacacttttcttctttcactgatcttcgagcatgaagttcttttcaaggcacttaggaaaatggaagtacttaggacattcatgaacagaatgtctcgagagctgcaaaagttaacgtgagaaaagctgatagaaaagttgcctagttcatcagagttttactctttaaaaagcagcaagttataatcccttcttaaatagcaagcaaaagcaagtggtctcatttcacttcttgaaatagacaaagtgaaactaataattgacttgtcaatttactacgactattaattccctgcacgcaaagttggacttcgttaatttaggattcacgttttctttctgaatataattatctgactatatacagaaaggtagtttgaagccagctagttattgtttgagcatttaaagttaaaaactatgtagacattagtaaatatccatttagaaaacctgtaacaactggatcaaaattaatcttaactgagaagttaaatttgacttacgatatttttatgacatttacagtgcatcttgctcatggcttgtaaatatatgttaactttaaagaacttgccaggagtggtggctcacgcctgtaatgccagcactttgggaggccgaggtgggcagatcacctgaggtcaggagtttgagagcagcctggccaacatggtgaaaccccatcttgactaaaaatacaaaaattaggcacgcatggtggtgggcacctgtaatcccagctactcgggaggctgagacaggacaatcacttgataccgggatgcagaggctgcagtgagccgagatcgtgccactccactccagcctgggtgacagagcaagcctccatatcaaaaaataaataaatcatgaacttggtaaggtttatgtagaaatagaggtgcttttattatgtaaatgtttgctgtattaacttaggaacataatttgcaatttttcctaaaggctgacatttaccaggtgtgaggtttcataaacactagtatcagaaaaacatttccagttgtgaaaatgattataagaacagaagtattggccaggtgcggtggctcacacctgtaatcccagcactttgggaggccgaggtgggtggatcatgaggtcaggagttcgagaccggcctggccaacatactgaaaccccgtctctactaaaaatacaaaaattagtcaggcatggtggtgggtgcctgtaatcccagctactcaggaggctgaggcaggagaatcacttgaacctgggaggcggaggttgcagtgagccaagatcatgccattgcaccccagcctgggcaatagagtgagactccgtctcaaaaaaaaaaaagaaagaaagaaaagaaaagaagtatagtcacaaggtgagcatgttattttaaacttcaatgacttaaaaaatataagtattgattttaattgcacgatagcataatattgaaaataagagagaaactgactttattctagtctgtgagaacaggttctcagtggggagataagactaagattctcatagtttattgaaataatgatcaattcaattatcaaatgcaggatagcattttgtattcagtttaataatccatcagcttttcaaataacatgttttaattgttttaatattatagattattttcactcttaaagtatcattttccaaataaagaagtatcatgatataagccattgggtagtggtcttgccactgactaattgagaatctcagtggtctgaggattttaatttccaactgtctatggcaatgattcttcactaggaatggacatgataaatacctgtagagcttttacaaaacatatgcacctagtttccttgatcccctgcctccccccacccccctaaagatttatttatttatttatttatttatttatttatttatttagagactgagtctcgctctgtcgcccaggctgcagtgcagtggtgcgatctcagctcactgcaagctccgcctcccgggttcacgccagtctcctgcctcagcctcccgagtagctgggactacaggcgcccgccaccacgcccagctaattttttgtatttttagtacagacggggtttcaccatgttagccaggatggtctcgattctcctgacctcgtgatccgtccacctcggcctcccaaagtgctgggatcacaggcatgagccaccgtgcccagcctaaagtttaatttattacatctggaagggaagctgagcaaggtctgcaaattttgaaaattcagagaaatacacatcaaatctacagtgagatatcacctcactctaattagaatggctactataaaaaaaaaaaacaaaagataacaaatgttggtgaggatatggagaataaacccttccatactgctggtggcaatgtaaattcatacggtcattaggaaaaacagtatggaagttcctccaaaaataaaaaatagaactatgatatgttccaagaatcctactactggatagctatccaaaagaaattgaatcagtaatttgaagagatatctgcacccccatgtttattgcagcgctatccacaatagcctggatatggaatcaacttaaatgttcatcagtggatgattgggtaatgaaaatatgttgtatatacacaatgaaatactattccatcatgaaaagaatgaaattctgtcatttgcagcaacataaatgaacattggggacattgtgttaagtgaaataagccaggcacagaacaacaaacaccgcatgatctcactcacacgtgaaatctaaaaggttgttctcatggaagtagggagtagaatagtgtttaccagaggatggagagggtaggaagatggggaggggtggcgagagattggtcaattgggtacaaagctatagttagattgaaggaataagttctggtggtctgttgcatagtagaatgactagcattaaaaagaatgtatatttcaaaatagctcgaagagaggtttttgagtgttctcataaaaaagaaatgatatttaaagtgatagatatgctaattaccctgatttgattattacacaatttacacatatatggaaacatcatgttgtgtcccataagtatgtctaatcatgtgtgaaccactataggaaaaaaaacctctgacctggtgggtttgatgttttcttagtcattatcatgatctctctatattctagagctctttgctctccatgtgagggagctaacagacctttctgggtgatctcatcagaaaggctgttagtgccaagaaaggaagactttataactcaggcacagagagtcccagtgaggctctgaagatcttttcaagtggaagcttgtatgacaggacactacactggggaatgagggtgggagtgaggtggagaaagaaggcacttctcagagcatagtaaaaatttagcaacaatttgagtcacttaccttactaaaaagttatctttatatctatgttagttttctgtggctggtgtaataaattacttgatggcttaaaacaacagaaatttattctcacagttctggtggccagaagtctgaaattaagggctgaaacccctcaggaggttctaggagagaatctttgcctcttccaaggtctatggctgtctacattatttgtcttgcggccgcaccagtccaacctctgcctgtgatcaacattgcctcctcatcttctctgtttttctttcccttccatctgtctcagctcttcctctgccttttctttaaggtcgcttgtcattgaatttagagcccacttggataattgaaattgatctctttatttcaagaagcttaacttaattatatctgccaagaccctttttccaaataaggtaaaaaattttacagtttctggagttgtaaaacatggttatatcttttgtgggggtgaggcgggcacgattgaacccactatagtatctgtcacatgctctgctacattcacaaaaactgatacttagtaaaagttcatgagattataaacagtgaagtatcaacaagacccctcattcaataattatcagggttgcttctctctctctctctctctctctctctgtgtgtgtctgtgtgtgtgtgtttgtgtgttctgtgttcatgtgtgttgtgctttgtggtcttttttttttttcacttgaagagtattcccatttagcccttgaagttaccaaatggggaagacattaccaaaaactatccattaacataagagttttgtggagcacaataagtaaagcaaagggaaacatccctctaaccctttcccagcaagaaaaaacaagataatcctggtagttccgagaaagcaaagaaagttagctctaactctttgtagtgaattttacagtattcagttgttctcgtacatttgtcaagagttgattcacctgcaatagaaaaggatgtctgtttacaagtggatcaatgattatatctactaatggaaaatggtagattgttcccaaagtcttcacaaataaaatctcggagataatatatctttctccgttagtagacacatcgtagtatctaaccataatgattacaggcataccttttttaaactatgggggcagtcacagtgctcagcattgcaggttttaaccttcatcagcagagtcagatattaaaaagcttatttcacgttgtatgcctgtatcaaaacatctcaggtagcctataaatataacacctactgtgtgttcacaaaaataaaaaataaaagttctcaatgtattaataagaaatcatgcatttatcaagcacttgttcaatgtttgtttgaaagtggtaggtaaataccaaaatgaatgcactgtatgagtttagggatgaagagcttatttcaaaagctcggtcaagcaaggcctaatggtgaaaatgttatgtgaactctaccttaattaaggtgtaggatttaagcagacattgatgaagtattaatagaaagacattgctgaaagaccagcattaggagaggcagagatgacagaacatatgttggcttttggagtgggcaactgttgtagccaactgaagaaattcagccaactgaactgatgaaaaatagtgctggaaaaaatagtgtagacacattacgaatttagatacactttcaatggaatatatcacaatggaatgtgtgtatgtatatacatatatattctgttgaaagtttcaatttcttatacaattaggaaagaaagagagcccaattaataaggtagtctcataatacattgtagaatgaataagaggaagtaggagccagaggtcagagagccaactgggaaactaattgtctaggcaaaaagtaatagagtaggatttgcaaaaggtcagagttgagggaaattgactttcagagaagtataaatcttattgttgtgtagactaatgctaagtaaagttgacagataggagtcaaagaaagtagattttaattatggttgagtgggaggaaggtgatatcaataataagaaaaagaatgttgtaaagaggagcaacatttgtgggaaatatgttgagtcaaactgtggttacacgacgatagtacattctgacaagtctctcccacaactggaaatatgtacagagctttagtgaggtattcgggctggacttgtatttgagagattctcttaaagaagtaacaaaggaagtcagatatttattgatgggaaggataacttactttctcatttgatctcagtattattggaataattaagcatactaattcctgaatttcttattttcctcttgaggacaggaaatgtgttttatttacctctgagtaatcagctgatagattgtcttcaaaaagttcctcttgaattactagagtttaggttgccgtgtttctgagattatcttactttttcaagtttaatggaatttaaaaaaaaatttactatatttactgttgtatcctgaaaacaaaagtatttctatgagttttactgtaatcctattatcatctcactgcttaatctttcaggtttccaaatacttttaaaatttactttaattgtttttaaatgtaatgagatgttattttaaaaactgttgattatttctacaaatgtgtcatgtccattaaaagtcactcattcataagtatatattatcaagttaatgtactagcgagacatcataaattatgcttcatctttctgctgttaattcacattattctccttctatccagggaaagaaggtactatatatacatgttattaaaatatttagaatctttgaataatttaaacaacattttaaataacagaatatggaagaaaatagaaaaaaagttaattgattcaatattttttttcaacaatttcttttaaatatatagacaaacccatacttggcatttatttggaactgtgtctgtttgcatttaaatttttgtgacctgcttaccaattttaggttttgtattgttttcttcttcctttatttatctttccatgctatattgattcctgagtgtttgagggacttccattttccagctcatttaagtgcatttcatcctgctgtgttggtcatcagcaagacacgaaaatggtactgaaatggccacataatgcaatgtgatttgaaacgaaggggaattgcacttgtctgttgggcaaggaatatttatcctgggttgctcgatgtatttagaaagtcaagagttatcaggtatttatttgtaagagtacagagaatcttgaatgctagtgattccaagacatttagatttcaggaaccagttgaattatttaaacaaacaaacaaaaaataagtaacgggaccataataaaggtgccaaatgatgttattaaatgataaagaattaagatctgctattaatgtaatatggaatttctaaaaggagcagtttaaaatccaaaacttggaaggtttctcagaggaagtgctgatcatttgaattcaatacattcaattttatatttgtcttaaaagctcactatagagccgagattgcgccactgcagtccgcagtccggcctgggcgacagagcgagactccgtctcaaaaaaaaaaaaaaaaaaaaaactcactatactgttttctgctgctaccaaattttgcatctaagagcatctgagacatagcatgattgttaatgatcgtgtcctgcctctaagaaacactacaatcataatacgttttgttttctctaccctaaaataaaatacttgagagtgaaaaccaatgcaaatgtgcaatatattttccccatatttgggaatggaatgtcctcactgatatgtgtgtgttttgtatttcatttacaatgaaggtgacacaaagaatttattctcattacagttgtatgtgtatacactgtagaatcatgttgtgaaagccatcttatataaaatataagtttcccctctctttttgcccacagccttaccccactacccagaggtaaacacctgcaactatagctgatgtttggtatttagttccatgcctcaaaatcacatgctgtactaagaacgcatttttctattttttaaaattgatttattgatttaatatgttgacttctcagtactgtagattaagatatagttctctatcaaattcttacccttcctacacaaatatgcatttcctgccttctcattctcccatgtagtaattttggctcccgtgctatctgccagttgtttgcaattatgaaaactctagcaaaagctgagccacttatagtaaatttccatctctttctctctttgatttgctttttgggacctttcctacactttgtcttcctgtcttcttactgaataatttttctaatacgtatttgtaattattaagagttttcatttttctgcatatctctttttctatagcagcctattcttgtcacatggagtcaagagcatctcttctcattctgaaaacattgaagttagttattttgtctgattttgttttgtggggttatttttctctctacataatctttatttttcccaagttcctattgtctgtttggttgcatgtttgagtctccctcatgttcaaggcttcctttgattttttgatggtccttggttgtctactcattaagtagaggtcactaaaaaaagtgcttggtaattcttagcagaatgttgattgtggatcttctggtttggttttctgctgagttgagaaatttctgctgttggtatctttaggtcttttgttttgcactggtcagattcacagagaatagtcctccaatatccagcctgtctttctgcatttgagagatgagcgggaaaaggtttcacatttggcataaaagtgcgtttcagctgcatgtttatgggtctggtgtcctgcagtgcagagactctctttcaacctctcaagagaataaacatattgtccctgtgatgacaaagaagggaaatcaatagctaccttattcataaacagacatttgacagaccctcttatttcctcccaattcttactctaccttccataggcagctggtgtcatcattcactgagcccttctggaggttctgcattggcaatcaagttgattcttagcttcaaccgctgttggattaggattcagctttttcaggcttctaagtgtgttactacttattcattaactttccagcttctaaaattctgctgccgtggtgtccttccttgttttctttgtcattatgggtttgtgcttaatttaaaatcccttcatttatatttccatgtgattttagaagggaaaaaaactctacttctgtgttgaattcactaccattacctgatagcctgcatgtgactttaggaaattggttcctgacattttatcagacaacagcataaaaactaaactgtcaacaagtcttcatagaggatttatgagcttgagcaataattgcaatactctctataagctaaactgacataactctaaatgaaagtgagcagtgtcatgtttgctattgttgatgtgctgtggacaacgtgaatgacagtcagttttaattagcccacggataattgcagtcatgtacctaagtcccattaatggtcactttttaacacctataacatggaagtagtgaaatgattcatttctttttttttttttgaatatggtagagaaggtcaactatgcttttgaggtaggaattattgataggatacttctagttggcttagcattttcatatctttttagcttaactatccattgtgagactaagcttattactgtcatgtaagattcggttaagtagcactattcatatctacaatctaccatgtggagtgatttgtcatcatttaaggaaaacccgtacatcagatataataagcagctattcttctggttaaccttttaatacatattattgggcagcaaaatcaaaacagaatctgttgtgtcatctctttggtacccaggcattttctacacaattgtaacaagactgctctggaaatagctataaatggatcctgctgagatctgctttttctcaattatcttatcctgtcaaacaagggatttttctcctcttcactttctcctccatttataaggatgtaatttcagcttgcaaattcgattttatcctttattgttagagcaagagatttcccagttttgatccagtctccacacttatggagggcccagtgtgaatgcagtatgcatatagatatcaatcagggatagcaggtcattccagccagaaaaactgatgtttttgcgtatatgtatatatgaatgataatatagggtgatggtgcctcagtctacttgtgctgctataataaaataccatagactgggtggcttatgaaccttgaaattttatttcccacagtcctggatgctaggaagtccaagatcaaggcactggtggattcagtgtctgttgagagcctgctttctggctcataaacagtgccttcttgctgtgttcttataaggtagaaggaatgagggatctctctcagggctttattttttataagggaattaattgcattcatcagagttctagccccgtgacctaatcaccttcccaaggctccacctcctaatgccattagctttgggttaagattttgacgtaataattttgggggaacaaacagtcagaccataacagatggatatggaaagagatctttagggacaccgtagttgggatggttatatctacttagaggggctggacaaggctccttcagggagacagtgttgactttgagattcaaaggatgaatataacttctccaggtggagaaatgtacaatgaccaaaaacaatatctgcaaaactcatgagcagggaaaaatcttaagtggttacaatgaagaaatgccttgaaatagaattaatgaaatttcacctttaggtctaactatgacagtatctaacatttactgaggactactcatgtgctaaacacaatgctaagataattatttcatttaaaacaccaactagattataaatcacattttacaaataaggagcttgaggtacagagaggtttcccaaggtcactaattattggagaaaatgagacttgaacccaagaagtatgatggtaagactcatagtattcagtgatatgctaacaacaactgacacaaatagttctttctgtcagctatagttgtactttggtctccagttatataatttgaagatacttgcagtcatagttcaggctgctatagcaaggtaccataggctaggtagcttaaacaacaaacatctatttctcatggttctgggggctagatgtctgagatcaagatgtcagcatgatctgtttcttggagagggccctcgtcctggttatgttctcatttagactttccttggtgcttgcaaggtggcgagagagagagagagagagagagagagagaaacagagagaatcttttatctgctcctctttttaaaaggagaataactctattatgaaagattcatccttacgtcataattacctgccaaaggccccaactccaaatgccaccacactgaggattagcgttacaacatatgaattctgctggtacacaaacattcactcctcagcaatggggtaccgagagcagcatcacatgtgggactgtggttgatgatggtgataaagatactgaaacttatgctattcttattgctaaatcatgaccacactttacattttaatggaaaacttcagaatagatggcaatgtatattttcataataaaaataaaatctcttctggtaaatttaagtacgtattggtcagttgagtagtttatgagatgtctttccctatagatcatagaattttagtgaggccttagaacagggtttctcatcctcggcactactgacattttgtgcttaatgattctttgttgggaggggttatatactataggatatttatcagcatccctggcctctacccactagatgccagtaccagtcccccagttgagccaaccaaatatttctccagacattgccaaatatcccctgtagggcaaaagtcatcccaaaacccaggttgggaaaccacagatttagagaagtctagtataatcccctcaactttacccaaaaagagaattgacgtgctgtaagcaaggtcatacagctaaactgtggcagaattttgattagatctcaggtctcctgagcccaaaatcatatttcacatataacaaactgtggtgtcttccacttaaagcagtgccttcagaacatatgatttaaaaagtacacatatatcatccataacagctcggcagacaggtagaataaatgcaatttgatcagtggaaatgcatggtgcgaaaagttatgatttgtcccaggttgcctacctagcatggaagacatcctgaacacaagacttcagatgacagctctgatgctctttccaatatcgttgcttaccgcagttggtcaacatgagcttggtttgagaaaggagcaacagaaaagtttttggggaacatttctaaatcattgctttcatttccagcactctgaccctatatcttttgtaggcaaaataataacaatcgcctttttttttttaaattggtagagagaaggaagtcataatattcacatagatattagctatttactaacttgtgcctcggcataatttttcttatacttgaatgattagagaataactgtcctcaaaaacataaaatggaaagttacattactttatgttatggatgcctcatctataaagacgtgactaccagtgattcctaaagacttatagagagttataagtgaagtcatattccaaagcctctgctgtttgggatttttttataggtcactgtcatgtagtgatatgaaataaaaatatttaactatccgcctctttccattcatcactgcactgccgcaagtgagggctttatggagataaacgatctggctttgaacacacacctggcaagtcacaatggtaaaatgtcgaccctttctgagaagtgaagtgtaagcagttctgagcagacccaccagctacgatgctgcacatttggttgtttctcttttaaaaataaactcagtctgaaagtttaaattatgtatagtttgtatagtggcttacatacaactgtaagaatgatcaaaggaaaaaaggacaaggtttgtatatctgcatattaatgttttaattttaaaaacaggtagccctaaattaacataagatgtttccacaatgtttttaactgactgaattctgtgggcaaaatgtatgtgtgtgtctgtgtgtgtgtgtttgtgtttgtgtgcttgtggtgtgtactacctgaaacgaaagttggtccaataaaatgaagttaatatctttaaaaatttggaataaattcagaaatgttctatatatactccagacatttaagtaaagtggtatttaaagtcctccttacagttatcaagtctggaactggtggagcagtatgcatctctgaccattacatctaatgaatcaccaagttctattgacaatacatccaaaatatattccaaatctgctcactgctctccttcacagccgacatgagcgcattagccactgtcagcatctcattaggagtaccgaagttgcttcttaattgttctttcacatctacacttgctcccttctgattaatttggcccaaagcaaccagaatgacctttctaaagcgtaatatggaccatggcaccatgctttttaaaatccttcccatgtctttccattgtacttggaataaaatttcaaattctaaacacgaaacataaggtccagtgtgacttgccctctcctcccctcatctttactttcaccaccttctctcatcccatcttttctaagctccaagaacacccctccatgcatcaaacttttcccaactaaagctttcacacatggtctttactatttctggaatgttctttttttttttttttttgagatgaagtcttgctctgttgcccaggctggagtgcagtggtgcggtctcggctcactgcaacctccacctccagggtttaagcgattctcctgcctcagcctcccgagtagctgggattttcccataccttcatatggcaattttttattcagtatgcagttctaagcttaaatatcaaatcctcaatgagtctttccatgatttccccaaagtatcctggttattcgctgtcttagcattctgtttcttttcactgtaaccacagtcatatatgtaactctggaataactttgtgcatggttttgtgcatggtatatacccagtggctagttcagtgctgaggacaaaaggagggaaggagtgaaggaaggaagaacagaaggatagaaggatagaaggaagggagggagggagggaggaaggaaggaaggaaagacagaaggaaggaagttgccagttcttcttcccaaaggcaaccaggattgcaattgcatgccaaaatttaattgttctaatgatttctgaactggttttgcagtgtttgtttgtttcgctttgttattctaaaccttggctttcgtcaacattagaaggaaggaattaagaaaggaagaatagaagttagaagtgggaagttcctgcatttaggattctaattctaaacttatttcttttatttttattagttctccatacagagagtagccctgtatacaacaatcattcctaacttgataactgaacataggccaatagttttcagtcttccatataaagttaaggcaaatattacgtgtacataacagaacctattaaaatagtcaaatctattatgtagcataagattatgtatctgtttatttgatttgactttttaaaaattaattcatcttttttaacaggtaatgctcttgcatggaacataattcaaaaattatgaaaggatttacaatgaaaagtctatgtgccaaccccagctactcagtttttctccacaaaagcaaccaggatttacaattgcatgccaaattttaattttgttttaatgatttctgaactggtttagtagtttgtttgtttttgtttattttgctttgttattttaatcattggcttttgtcaacattggaatagttgccttaatggtaactactattacataactcatgtgagtggaacacgtgtggttataagaattgtccagcatgctggattctattacacagttatttcatttccaaatatttgtctttcttgtaaaacagtcattatcaaatgactttgcttttacagccaaatgaggagacagttcttggatttaaagaactttgttacaatgattactcaagtacttagcagaaaatttttcaagcttttattccaaagactctcttttagaaaccccagccagaaattccaaattttcccagtgcataagtcacatcatggcaaattaggtcttcactttctcttttctgtaaaaagttactaactccctaatcaagactttgttctgacgttttgattggtctggccttttcaagtagattaaatgttattgattttaaaaatagttttcaacagattctttgtgagtggctacttctagactggcctaaagagaaaggatgacttcactcaaaagttcataaaaggagaatactgacagtcagcctttttgttcataagttgatttttaaaaatagaaatatggtaggacaaattgttgaattatttctttttactggaggctgtgggtatagtgatgaatcttcaagttggaagaatcaagaaacaagcattctgttgtccatacttggtatctctttttgtgatcttgtgttattcagttgacccattggtgcctctgttttctcttctttaaaacaagaggcatgaaccagattatctcttagaaactcccaggtttaaaatcctattgaatgaaaaaaaaagaaagaatgaactaaagccaaaaatttttaataagtttgaggcaaaagactggtttgcttttcccttatttgatatgaaatgcacatcatacaattaatattttgatctcactagagtctaatagaaattacagtatcacatcttgtcaaacacagaatcttggcttcacagtaattcagaggtcaattatttatacaaatggagttcaagttatagatttaattttcagaccaaaagtttctcacattaaaacccacttgcttcagttcattttgcagatacgaaatatgttttcttggtattatgaatctcttgttttaccctctgtttcattatgtaatcaatggatgtgaaaaatgaaggtgtcatgaaatgtcagaatctttaaaaaaatcttcaaaattatttaactgctatttaattgaagaagtttttcataggtattgtattaaattatatttatttatatctcatcagagtaacagtattacagctctgccggaagcttatattgaaagagaaatcacataaattctcatgtagcatatttgtaaagaaagaatatgttgacaactttctttttggtgacacgtcaggagttgtgagggattgaactgcctgcaattattgtttaactacatgaaattaccatttaaaaactgtccactaaaaaaataccaaataaatttgtagactcatagcaggagacattatactttattttttaaaatagctgaacttttggtaagacggaaaattccatgatttgccataaatgtataatttatctatagagaataattgtatttggatatagtaataaactctttatggagtgtgctgaatctacaaactttcaggaactttgattacaaggaccatcagagaaaggagaactgaaattttacgttacaaaattgctctacccaaattttcaatcaattgttagaataagttcaatgttgggtcatttttgtattttatgcttcaaagaaaatgaccattcagtgattcatctgggggcagaatatcagagtggttaagaagatggggtctggagccagaccacttggtttcaaaatgtggcagtgtgttttaagaaaattactttaataccttgatgttcaatgcatccatcttgaaaatgttggtagccttcatatttaacttatgggattgttgagaagataaaataggcgaatatgaataaagatggaagacctacaacagtgtcaacatctcaagaaatgttagttgttgctgttgttgtttttattagtattattcaagaggatgtgaaaattgaagttttgtctgatgtgccaataccgtatatgataattgtcatatattcaagagagtatgagactgaatagctgggaggaagcttcaaagtggataactcaaaagaatcttcatgtctttgaagacttcacccactttgagaatataaacgaatctagaatggagaggcagagggggctggccaaatttgttgagaaagagctgctgcagtgtatcccatatccttcaggtggggtgaggcagaccttttacacctgacctccaaagggtggagaagtcagtgggaccactcagagaggttaatgagcagtgtactgatgcctcatttatacctgtgagagttaaagcatgtatgaacaaggggaagagagagaaagagtgagaataaagggccacaaaatgatatccctgagggctagaggaaggcaagaggagtaaaagaaagcatgagtgtttctcacagagtaaatgtgagccacagggaaaaaaagaccatctggagacattttaagaccttcctggccaggcgcggtggctcatgcctgtaatcccagcactttgggaggccgaggtaggcggatcacctgtggtcaggagttcgagaccagcctggccagcatggcgaaaccccagtgctactaaaaatacaaaacctagctgggcgtggtggtgtacacctgtaatcccagctactctggaggctgaggcaagagaatcacttgaacccggggacggaggttgcagtgagccgagattgcgccactgcactccagcctcggcaacagggcgagactctgtcaaaaaaaaaaaaaaaaaccttcctaggaatagactctccaggtaatgtgggtccttagagatgctagttctaaggagacagtgaccatccaaatgggaggctcacacaatcacaggagttgggtgcaagctggggaccaatgacaaacccacagaagtacccagcagtgaaagatttatttgtagacatttgccgttcaccaaccaaataagaatagttttgccattatgtctctttctttactcctccctgcctctgtgttcctaagtgtggatatgacagggcggggaagctggtggtctaggtgacccattataaggtgtatcaaggacaaagggagatctctgagctttgactgacaattgaaatgttcatttgcgtgatcttagactggacactacagtgctacttataccttaaagtctggctggctatagagcatggaatcatgggaatttctgagttttcttcaagtgacatgggcagtttatccccattgactaaaactaatccttaaaaggaaagaagcccaaagttcccataagtttgaaatgcttatgctgttctgctggtttgttacaacaaaagaaaaagcaatcataaactgcatatacagagcacatgaataaatgggaaggatcctggcctaatacagcattactaaactaaatgctcatatgattcagtgcctaggctaccacatgaattaaaaatgaccttatgtaatgaattaatttccaaaataaatagaacaaagagaaaatcatcttagcatcttcttaccttaaatgagtatcggagaggtcaataataagacatgacattgtttccaaattattaaaatgatttgaaaatatatttcataaattgtaattataagtaataataatgtgcaaactctctactggattttatatatacgcactgtgttcaacattttaactattattttctgtcctgtttttgaaagttagatccaaaaatgcagtattgattcagatagaacataccgaaaaatatttattggttgatgatagcactggttcttgcacatggaatatatattttattttattaattattttcatttgtttatttatttattttttgagacagagtctcactctgtctcccaggccagagtgcggtggcgtgatctccgctcactgcaagctccgcctcccgggttcacaccattctcctgccttagcctcccaagtagctgggactacaggcgcccgccaccacgccctgctaattttttgtattttttagtagagacggggtttcaccttgtttgccaggatggtctcgatctcctgacctcatgatctgcctgccttggcctcccaaagtgctgggattacaggcgtgagccaccgcgcccagaatatatattttaatactaagttttgatttatttttgcttgattttaaatgaggcagaaatatggaattcatatacttgcttgtagataaaacatgttccactttaaaaccatgaaacgaagtttactttctttggggatattttaagtgttgaacctagaactctaaatcttgagggtcataaatatcagtcaaaaatattttcattataaataattatcttcagaaatactcttaatatcagactttttaaaaactaacaatgctagttttatggtgtcaaattttgtatttttaattttttttaagggacagggtcttgctcaggttagagtgcagtggcataatcatagcttactgcgacttcaaactcctaggctcaagcgatcctcccacctcagccttccaagtagctattactacaggcacgcactataatacctggctaatttttattttatttttttttggtggagagggagtcttgctatattgcccaggctggtctcaatttcctgtcctcaaggaatcctcctgcctcggcctcccaatgtgctggaattacagatgtgacccacagtgcctagcctgtctttttaatgtcaattatagatatcttaaaagaagtttcctattacattttaataaaatgcattatttattaattagtgcttgagggatacaatattgatattgtctgttggaaggccgactaacatgttaaaagatagtaatagaaaacctatggcagggtgcggtggctcacgcctgtaatcccagcactttgggaggctgagtcaggcagatctcttgaggtcaggagtttgagaccagcctagccaacgtgacaaaaccctgtctttactaaaaatacaagaattagctgggcatggtggcgcgtgactgtaatcccagatactcaggagactgaggcaggagaattgcttgaacccgggagacagaggttgcagtgagccgagatggcgccactgcactccagcctgggtgacagagtgagactccatctcaaaaggaaaagaaaaaaaagaaatagaaaacctattttagaactacagaaatttcacccaggttgaactaaatctagcttacttttccttaatgtactataagagaaattttgttcaaaaaataataggttctcttttattatatattacattgtcttatcttctttgatccaacttttcatataacttaattgcagttaaaccttattgcggttccatgaccatagaattctacctttcaatttttttaatttttttatttttataaatttaggggatagaagtacagttttattacatggatatattgcatagtggtaaagtctgggcttctggtatagccttcagccaaatagtgagcattgtaccctatatagcctccacatattaaattcatcgttcaatattaataaatttactatgaacttgttaatcacttttagaagaaccaatatttaaaaacccaactgtaaagaatgatagaactgtaaagtaataataatgagcaactgtgctttatacactatttcgtgtctattacttctttttttgtttgtttgttttgagacagagtcttgctgtgtcgcccaggctggagtacagtggcacaatcttggctcactgaaacctctgcctcctgggtttgagtgattctcgttcctcagcctcccaagtagccgggattacaggcgcccaccaccacacccaactaatttttgtatttttagtagagatggggcttcaccatgttggccaggctggccttaaactcctgagcgcaagtgttcagcctgccttggcctcccaaagtgttgggattacaggcatgagccaccatgcctattgtctattacttcatttgaccaactttggccctcctcctagccccatatggcaggcattttcataatcccattttacaaatgagcagactaacattcacagtcattacgatactttcccaaagccatgtagctagtggacggtggagcatacactgagactctgttctgcggaaacctgtccataacatcccttccttgctagcaatatatttatagtgagaaaacatggacttgagcttcagatttagtacttgatacctatgtggaattagagccacgtttttaacattaggtcctccccttgtaatatggagatgaaataagaatttctttgggttcttgttaacgaataaacaagttaatgtattttttaaagcactttgtattagtccattttcatgctgctgacaaagacgtaccctaaactggacaatttacaaaagcaaaagatttaaaggacttaaagttccacatggctggtgaggcctcacaatcatggcagaaggcaaggaggagcaagtcacatcttacgtggatggcagcaggcaaggagagagctggtgcagagaaactcccgtttttaaaaccatcggatcttgtgagacccattcagtatcacgagaacagcatgggaaagacccgcccacatgattcagtcatctcccaccgggtccctcccacaacatgtgggaattatgggagctacaagatgagatttggctggggacattgaaccaaatcatatcattctgcccctggcccctcctaaatctcatatattcacattttaaaagcaatcatgccttcctaacagtcccccaaagtcttaactcattccaactttaactcagaagtccacagtccaatgtctcatctgagacaaggcaagtctcttccacctatgagcctgtaaaatcaaaagcaagttagttacttcctggatacagtgggggtacaggcattgggtaaattcagccattccaaatgggggaaattgaccaaaacaaaggggctacaggcctcatgcaagtctgaaatacagcacggcagtcaaatcttaaagccccaaaatgatctcctttgactccatatctcacatccaggtcatgctgatgcaaaagatgggccaaatacttagagccaactgattgtttgacaaacccaacaaaaatatcaagtggggaaaggacaccctatttaacaaatggtgctgggataattggaagccacatgtagaagaatgaaactggatcctcatctctcactttatacaaaaatcaactcaagatggatcaaagacttaagacctgaaaccataaagattctagaagataacaccagaaaaacccttctagacattggcttaggaaaagacttcatgaccatgaacccaaaagcaaatgtaaaaaaaacaaagataaacagatggacttacataaatgaaaaagcttctgcacagcaaaagaaaaaatcagcagagttaacagacaacccgcagagtgggagaaaatcttcacaatctatatatgcaacaaaggactgatatccagaatctgcaaagaactcaaacaaatcagcgagaaaaaaataatcccatcaaaaagtgggctaaggacatgagtagacaattctcaaaggaagatacacaaatggccaacaagcatatggaaaaatgctcaacatcactagttctcagggaaatgcaaattaaaaccacaatgcagtaccatctcactcctgcaggaatgttcataaacaaaaaaataaaaaaaaaatagttgttggcattgatatggtgaaagggaacacttttatgctattggtgggaatgtaaactagtacaaccgctatggaaaacagtgtagagatttcttaaagaaccaaaagtagatcttttgatccagcattctcactactaggtatgtacccagaggaaaataagtaattatatgaaaaaaagatacctgcacatgcatgtttatagcagcacaatttgcagttgcaaaaatatggaaccagcccaaatgcccatcaatcaacaagtggataaagaaaatgtggtatatgtatgctatagaatactactcagctctaaaaaggaatgaaacagtggcatttgtagcaacctggatggaattggaaactattattctaagtgaagtaactcaggaatggaaaaccatacatcctatgttctcattcgtatgtgggaactaagctatgaggacgcaaaggcataagaatgatacattggactttggggactcggagaaagggtgggggttggtgaggaataaaatactacacactgggtacaggatacattgcttcagtgatgggtccaccaaagtgatgggtgactcagaagtcacctctataggatttatgtaaccaaacactacctgttccccagaaacctattgaaataataaaataaaataaaataaaataaaataaatatataacaggaaaaaaaattgctttttttcccagttacaaatatactcacatatattttaaattttctaaattcttcttttcactctgagcttttctatgtaagatttatttttgtgtctagtgtagaaatatactttttattgattttaagtgacaaataataattgtgtatatttttgaactataatgggatgttttgatctatgtatacattgtacaaagagtcactcaagctaataaacatatccatcttttcatcaatttaccatactattgtggcaagaacattaaaaatctattccgtctgccagtttccagtttgaaatacacactacattattaactgtggtcaccgtagagtgcaataaataactaaaacttttcctccaatttaacagaaattttattacctcctgcccccctctgcagcctctggcaaccacctttctactctgtttctataaaatcaactgttttagattctgtgtgtgaggtcgtatagtatttgtctttctgtgaatggcttacttcacttagcataatgtcttccagttcaatctatatagttgcaaatggtagattttttaaaggccgtataatattccattgtgtatatataccacattatctttatccattcatctgttgatggacacttagtttggttccatatgttggctactgtgagtaatgctgaaataaacatgggagtgcagatagctcttcaacatgccaatttcaattccttgggaaatatacccagaagtgggattgttagattatatggtaattatatttttagttttttgataaacctctatactatttccaaaattactgcactagtttacattcctgccaacggtgtacaagggttgtcttttatccacacacttgccaacacttgttatcattcctcttttgataatactcattctaacaggtgtgaggtgttattccattgtggtttcaatttgcattttactagtgattagagatgttgagcatttatttcatgtatctgttggccatttgtatctcttcttttgataaatatttgttcagatcctttgtccatattttaattgggttatttgttttcctgctgttgagttgtttgagttccttatatatttgggatattagcctgttattagatgtatggtttgatgcaatcctatctgtcttgtttttgctttcgttacctgtgcttttgtagtcctatccaagaaatcattgcccagactgatgttgtggtgtttttcccctatgttttctgcaagtagctttagagtttcaggtcttacatttaagccttttgttcattttgagttgagttatgtatatggtgtgacatatacggtgttcagtttcattcttctacatgtggatatccagtttttccaacactattttttttggagaaatcgccatttccccattgtgttttcttagcacctttttgaaaatcaattgttcataaatatatgggtttgtttctgggctttctatcctgttccattggtcgatgtgtctctttttttgttttgttttgttttgttttgtcgggaccatactgttttgattacaatagctctgtaagatattttgaaatcagggagtgtgatgcctccagtgttggtctttttgctcatgtttgcttttgctttttggagtctttgctggttccatatgaattttaggattgctttttctatttctgtgaaaaataacattggaatttcgataagtacaccaaggaatctgtagatcactttgggtagtatggacattttaacaatattaaatcttccaatctatgaacatgtgatatctttccatttatttgtgtattcttcaatttctttcattcatgttttacagttttcagtgtacagatctttcacctctttggtgaatttacttctaagtattttactgtttttattgctattaaatgaaattattaatttctttttcagatagctcattgttactgcatagcaatgcaacagatttttgtatgttgactttataacccacaactttactgaatttaagtatctcgattctaatagattttggtggaatatttctttaaggttttccatatataagatcatgtcatcagcaaacagactatttcacttcttctgttctcatattgatgccttttatttatctctcttggctaattgccccaggtaggattttcagcatcatgttacatacaagtagcaagagttggcatccttgtcttgttcttgatctttgagaataagctttcaattttttatcattaggataatgttagccgtgggtgtgtcatatatggcctttattgtgttgagattcatttcttctatatctactttgttgagtttttttttttaaccatgaaaggatgttgaattttctcaaatgttttttctacatctattgagatgattatatgatttttttgttgttcgttttgttaatatgatatatcacatttattgatttacatgatttttaatttacatatgttgaaccatcctttcatccctgggaaaattcccacttgatcatggtgaagtagtaatacgtctttgtattttatatatatacacacatacatatatgtgtgtgtgtatatatatatatataatatatatataatgttttgttctagaaacttttattgaatagtttatcttttcttcccttatttttgtgacatttttaacacttaagtttccatgtgtggatctgatcttagattactaaatttattttattggtctatttgttcctgtatgtataccttactatatttactaacaaacagttttataaaagaaatttatggaaatcttgttatctgctagataacctcttgtttgttatcttaaatttatgttctattcttgactttgctattaagtgtgaatcttcggatctgtttatcaaaatctgtgaaaattcctactgaaatttattttttaaaaattgattccaatttatagataagtttagagaatcatcacctttatctttataattctgagtctttttatccatgagcatggtgtgtgtgtgtgtgtgtgtgtgtatacacacacacacacacacacagatatatattttcccattatttaggcctctttacatcttttaatattttttaggtttaaacttctcattcagttaatcaggtcctttttttttcttttctttttttttttgagatggagtttcattcttgttgcccaggctggagtgcaatggcgtgatctcagctcaccataacttctgcctcccgggttcaagtgattctcctgtcccagcctcctgagtagctgggattaccgccatgcgccaccagtcccggctaattttgtatttttagtagagacagggtttctctatgttggtcaggctggtcttgaactcccgacctcaagtgatctgcctgcctgggccttccaaagtgctgggattacaggtgtgagccaccgcgcctagccaggtcctcatttcttcatgtgtgaattgaaaataattattttttctctgtatatttacagatataaatttgaagataaaattaaatgatgcttatgaaccaattacataaataataaggttttgtgtttattattttttaaacagaggtatgggtgtattttatgcttaatagtacatcatgattatctagattctatttaattattctctttccccccagtgtaaaagttaggatcttataattatttaaggtaattgttattcttcaacattaagaaaatcattgttgtgtttaatgatgtctggaatgctcagtaaaccatgattttttattaatcttatgcagtctttgattaatgagaaatataaacgatcatttagtcaattatttattatatcacctactaggttgctaagcactgaatcagttttaagatagttgtcttcattcagggaacaaaataaaagatggtaagaagttttgagggcccagtactgatcaatgttcttttaagtttagcagtctacagactttactaaatgtggaagttttaaacattattttattattgctgtttttttggagaaaaaaatgattccaaattttcttcttttttttttttgtggttgtaagtgacgtgaaactataggatttatttttccattggcttcttttaattaaacattttaataacatgtattatccaaaacttgctataccaactatgtaatcacctcttccttctatttttatgaatatactatctgacgactaaggtgatatcagaaaattttcactcaaatgaataaaaaaaagaatgacaatgaattgaatgtatatgcttcagtagataatttataaagaaaatttaatactctaggaatgatgctatacaagctggcgtgtcaaataataaataattttaaaataggacaaggaccttcatacactgaggaatgatataaaaatacaaaaatattttaattgtttaaaataagaacttaaatctaaaggagatacttatgatgtctaaatatgaaattctatactcaggttgaaaaattatattctataaaggcagactgaagtatattaatattgttagcagttagttgatggtgaccgtatgtaagttactgtgttgagttaaatattttatgactatgtagcccatatgaatggaagacatttgagtaaaaagagtatatttcttgtggagtctacattggtgcattgtggtaaaatataagaactactttttaagaggggcattgattaatcaaactgcattctgacataagtaactgggttgataaaaacaatctgaaaactctcacatgaaaatggattgaagggctagaagatattacactgaaaagataaatctggtgcaatggacaaatcagtttgaatacttgagtagttgttatatatgggaccaaattaagttttatttactccagaagaaccactaaactgttaaagggcaggtttcatttcaaacaaatttttttagccaattaaattatctaaatttggtaaagtctcatttgtaattagtagaggagcttcctaatttgagtagaagactgaactaggtaactgtcagccattatttaacaaatatttatgaagtacatacaatatacaaggtgttaaaaaattataaagaaagatcactgatccttaatggtatgtgattatagattttaatctataaaggaaatgtttcttgtagctatttgatacatataaagtttagagtaacttcgtaataattaatacattgcatatatcaaatagtgatcagtgtatactaattatacagttctccaccaagtagggtaggtacagacatgagaagacaagacttgattaaattttaaaaatggattcagtaattggattaatttgtttagagcaaaggattttcttaggtggaaaatgagaaaaatgatctaatgaagttgtgcttcaagagaaacaaagtgaaagagagctggagtcccagtgtgacccctagaccagaagcatcacctgggaatttgttaaaaatgcaaattcctgggtcccactccagacctactgaatcaaaaactcagtgttggcggggtggagtagcaaggtgtggtttaacaagcccttcaggtgactgtgattcatactaaatttgaacagcagtgtagactgctgttgttgtgaagaggagtttacatatgatttgtttagatataatttggaaggcaattcatggtcactgcacatcagtggaaataaaggatgcagatgctatggcttcaagtagtaatatattgactaacttatgtaatgcataactctagagaacattttaaatagcacagtgttgaaacatttgaaacaaatttattgatatagttttttttaagttaagttttacatctaacatttaaaatgatagaactaggtatagctggaaacaatgcctgtttattttcttacacagagaatgaattctttcttcccttaaaacagtgttgggtaatgttccagaaaagtaattacaggccagttagtaaatatacgctgagatagtagaatgccagatagcaacagctatatgtctgccactactggttaatcagctacagaacagactgattttttgacttaatatggcatagggactccattaaggacagaatctgcatcttaattactgaacatatcccccccactgttttcatctgtatttacgtatgttttctttttttgttgtctaatagaagacaatcagggttgtgcacgatttacaaattgcttcttcacctcctgtcttcctcttctattcaataggcttgtcaagctataagagattatgaaatttggggtagttagaaatcacagccaattcaatctcatttccacacaaaccaaagagtaataaattactttattgtagcagcttattgctttgaacctaaattacagaaaaatagcttggaaattccgtaacaaagatgaaatagtctatttgtgtaggcatacttcttacagtttgtgttaactctcagctctagcacattttatatgatatttggatatattggtttggaaggagacagtcatgatctgatggtctttctgattttgtttctctctaaccttaattgctgaacctattaaaaaccccattttaggtttagctgccttagattctaggattattcatgtgctaggtcaggaaaatacagaagctctatgtctggaaatggaagagttgccattgactcaaccttgctgcttatcctcttcttaccttgtatttctgttctgataattcaattcttgccttgtcactgatgatcaggactttccctcatactcaacaattgctctagagctctgctttgattctcagccttctcctctgttcatttcaaaaacagggaattattttcataatcttcaatctttctgtctccccagacacactgaccacatgtctatccaaacaggtatcagatcatcctctttccaggtaatctgatttgattttcctcatatacctcggggcatcctgctttgggatgtgaaggatttgtgtaaacatcttttgttgactgtttgttagaaaatttcttcattgccagctattggtaccctgctcagatgttcttaaccttcaagcacgcctatttttccagctgctaggagttttgggttataactcacagctaccaccatcacaacccctttctctggagtattatcttaggccagtggtcctaaaacattagctttcatctgaatcacctagggggcttattaaaacaaaagactggactcagagtttctgatttagtaagtctagggtggggcaagagaagttgtattcctaacaacttccaaagtgatgctaatgctgttgctctagataacacatttcaagggccattcctctaatctaaataggagcttattattccctgaaggctctttgtcctgtctctcctcagggtagaccacagtgagtgactgattgccacaagcttatacaagttggacctcttacctcaaagtgtaactatctacattgtttcatttgtgtttgaaagctgcctagtgggatcagaattaaagggtcaccatcagtaatgatattctggctaagcattcttttctaccctatcctgcttcttccactctccttctcctgaaagtactctcccaataaattacttaaataaaatctccatctcagaccatacttctaggagacgtgatatgagacttatacctgtggatctatggtttctggtctctttaattcaatctatctattcaataaacttgcattgaatgtctttgaatgtcccagaaagcatatggtatatggaagataattaagatccagtttctttaccaagcaacccaccatttggttcaagggtagataagcaaatgtacaattatagcagcatgattgatactatgctacctcagtgctgataatttgaggtcctgactgctttcatctgagctttggagagtgtcacatgcttgattctctgggacagagtctctgagatggagatttgtggatagaaggtttatggggaatattcttagagataccagtgaggaagtgagggaaacataattgtgcaaatggagaggctgggtgagagctcaggtgaaactgggaggggctctggagatggaatgtcccttcaaatttgtccagaattaaggaaagagatcgatcactagatgcaggctgcccagtaagaggagcataacattggaagaaataactctctttggctgagagatgcttgaagaggatacatacaatacacacaataaaagttggtccctggagagccttgcttgtgatcatctcagtaatatatactggcttcccaccagaaaaccatttatcctattcctcccaacaggaattttaattgagtttgctcttaagcactaaatttctcagatatcccaaatgctaaatgcaagccaaacctgagatttcctgaaaatatatcctgtagacagatgtgagagtgtttcaaaccttattgaaattactctgaggagcaatgcagcaggtaacaaatctgacacacagcaatctttagaataaacatatgcaggcccagagttcagaggctaaagtcaatttaatgagaaagctgtcactattcttttttacatgaattaaacgtattccaagttgcccaagtcacggcctaacagtaaagagtctggctgcagagctgagcatttgttttatgttgttctcagggtcacttaaaaatgaatgtgagttacctggattgaacagaattctatttagtgtattctaatatgtggtgataaaacttgggaacctcagtaaagggaactgatttgaatgtaaaattgtttattttgaagtacatgtatgccaaacactgaaattttctattgatattgaatatctatcaatattcaatattttccattaattctgttgattctatttgctattgaatattgatataacaccatttagtttgtaaagagaaatataaaatcttaatgaataaagggaaaactattgataagtcttcatagagttaattatacactcttaagacattagactcaagtaacttcatacctactgagaataaatgctggaaaaatttacaagttttattttccatatttagtgccagagagccagattacacacacacacacacacacacacacacacacacgaacaagaataaataggttcacatgtttccttgcagtaaagtctgtcctgatgggatggactctgacaatattatgaatgagtatgaaataatagcaaacttggcctctagaaacaatcttccctctgaaatgcgtgttttaaattacctcatggcaaggccagtgacattcaaggattgggaatgaggttagaaaaatggaaatgattctccacttctgggaaggtcttttgcctgattaacgttatgtaaacattttgctgaagaaagaataattctgcactttagccaccaaatcattatagaaaaacaatccagttttatgcctcctgtgctccagtccaagggtcagcaaactatggcccttgagccaaatcctgcttaccacttatttttgtaaatacgtttctattggaacacagctctgctaatttgtttacatattgtctatggctatttttgagctgccatggcatggttgagaagtgcaaccaaaaccatatggcccacaaaacctaaaatatttactatctagccatttacagaaaaattttgctgatccttgctctattgtgttttagttctgtgtatcccaggtttactgataagaattacctggagtgcctttcaaccaacagcttcttgatctcctcctttggagattctgattcggtgaatctgaatgagacccagaaatttctacctttagcaagtactggaactttgggaaataccaagctagttatttgactctccaatattctagcataccattttttatgttcaaaaagtccacattcttttcttcaaattcttcctcatctccccacataaatgcaaggtatggacgaatgtattgtacaggattgtcacggataaggtcggctagaagcagtttgtgataatgattagggtgtatgttgtttgttgagggagtactctcaggagtaaggaagttatagaagcagtataggaaagggcgataaagctacagaatgtgctctcattacacatacaccatggaatactatgcagctataaaaaaggatgggttcatgtccttcgcagggacatggatgaagctggaaaccatcattctcagcaaactatcacaagatcagaaacccaaacaccacatgttctcactcataagtgggagttaaacagtgagaacacatggtcacagggaggggaacatcacacaccggggcctgtttggggggtgggggactaggggagggataacattaggagaaatacctaatgtaggtgacgggttgatgggtgcagctaaccaccagggtacatgtatacctatgtaacaaaactgcatgttccgcacatgtaacccagaagctaaagtattaaaaaaaaaaaaaaaaaaagaatgtgctctcagctggagacatgcttcagtctgatcccatggggacctctgcagcataaattgaaccacagagttgatcctgccttcaggcaagagggctggccttttgagcactctcttcccattgccatcagttagttatttggatgcagggagtccttgaacaggggacagacattagcagcaatcattgaggcacaagtacacctgtggtaaaggcagaggaggggagaagtatagcatctggtgcagaagttatacccccaaatgaatgaaatttagacttggaatgtgccctgaagaaagacctatctacaagagtctttaaaagataattttgaaatatgttttcaagttagtaacccttcggaagtcacaaatatatttgctagaactgatacctatcatctttgaaaagtaagaggaaaatatgtatcagagagaagtgacttttccggttaataatcattgcttgttgatacgtgcttttgactaggtatttagtaagatcttttggttatgtttacctccattaggatgatatgagttccttatgaatttaaatgcatgtgaacatttcagagtcccacctggaatgcgactactgtcagacaatgtattctctctagcccctaacatttcatgatagattcactacagttgtagaagaatccttcaataaaagttatgttatgggaatgtaaaacaaagtttaaccttccataattatgatttactttccaaggaataatcatacctaccactacttgcttatcctcccaacctgcaaggtaggcatcaattacccaatccttacccaaagtcacatgtctagccaatggtggtgtcgaatattctgatgaaagagttctattggccccgctaaagagttgtggggttttttaaatctttaactcaagttgtttcagtgaacctagaactaagactttttcaaccactcccaaattattgatgcttgggttttgcaacaaatgccctctaagctctcaggataagttgggggaggaaaatgaaaacataatagggtaagggttgttctctaactattcccagaccagttctcaccttcaaactgctctctctctctgaaagatgagcaaaaaaaaaaaaaaaaaaaaaaaaatgtgacctcacaaaaggttgtgtgacctcaaaacctgccaagagtcctcagtgcagcccactctgaagacagtggaacaactcaggaaagaaggtagagtattttatagaccctagagtcttatctcatcccattctgctttctgtcttcttgaggcacagttggcttaaccttttcttgaagtgaaaactatgtgaataagaatattaacccccaaacaacttaaaagcacagtcaaccgcttcatcactggtcattagagaaatgcaaatcaaaaccatgagataccatctcacgccagttagaatggcaatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaattattctactataaagacacatgcacatgtatgtttactgcagcactattcacaatagcaaagacttggaaccaacccaaatgtccatcaatgatagactggattaagaaaatgtggcacatatacaccatgaaatactatgcagccataaaaaaggatgagttcatgtcctttgcaggaacatggatgaagctggaaaccatcattctcagcaaactaacacaggaacagaaacccaaacaccgcatgttctcactcataagtgggagttgaacaatgagaacacatggacacagggaggggaacatcacacactggggcctgttatggggtgggggtctaggggaggcatagcactaggagaaatacctaatgtagataacgggttgatgggtgcagcaaactaccatggcacatgtatacctatgtaacaaacctgcacgttctgcacatgtatcctagagcttaaagaagtataataaaaaataaattaaaaaaacaaacaaacagaaaaacagctgacaaaacagaattgcccagcgtaactgtatttttaagttagcagcaaaaatagaattttgattttatgtcatgtatattgggaaaaaggagcaaatgatatgatgtcagttaaaagaaaactagcatagttcaagattttcccatgattctcctatgaacttgaaattccaaaccaaacccagctgagtccaaagccagtagtgctcttatcaactttccatggcaatgtcttacaattctctttaggctagggccaggggaagaatccatggaattgaccacttggcaggacattaccaaggtaggggtggctatagagatttcagccgaaccaccctaggggatgaagcaagaacacaatgaccggggcagctccaggctcacctcctccatgaagcttttccttctctctctaggtagattaggtgactgccttcttggggaaacattaacatgggttagataatatgagctattcctatatggcaacaagctaggtgaggaaaatgaagatacgatgcatctatcccatctctccagcacccaggacagagccactatatcctggcatgctgtagcacagagtagagagccctgcagcatttaggcacattgaacatacttgttgatgatattctgagccctctttcctttaaatcattgttgagtattttctgggtcaactcacaatataaaacccctgtcataaacattcaaaaaacttgataagctaccagaaatgttcaattaaggaacaaaaagaaactgaagagcaacaatggacacctcccctcctgaactccaccagagaacttcagtccatttaaaagatgaagccagttttaatctataatttatgtcaaatttcactcttaagtcacaaggttaatatttttagtagaaaatgttgattataacagaaactcaggtatctcatatgcacatactcacggtatgattaaagataatcaggtacaattttactatgagattggacaatgtttgaagaatatcaatactgttttagtgaaaagcagatcaaagtatgaaattaaaaatatctttagaatagtaatacttaaaagaattcagtaattggaatgcttatccatgttttttaatcactctgttttaaatctgactttcagttgtttcaaaatgacaggttatgttgattaggtaaattatattagcatttatttgtatttaatttctacatttcctgttaccatctttttgcccacttttctattggtatgcaccttcttttttattgtatttatttaaggtatgcaacatggtgttttgatatacatgtacatagtgaaatgatcactatagtcaaccaaattaacatttaccttcccacatagttaccttttttgtggtaaaaagggcatgctcattcttatctttttgattcatataaatgtcttatatgtcacttatattagcactgcaatacaaatggttgttttaaattgatcttctgccttaaaactttacttgaaaaattaattaaaatacttttttcagataaattctgtctttgaatgtctgtttcagaaaggtcatatttatccaagaggagacaaatagccacctacattttctcccagtgctcttaaaattaactgcaatatatctgaatcttttgtggcaagattatctttttccttctgtttttctcaaatgagtaacacatttttaacccaattttgagtgataaatcttttttgcattgttttgagatgctatttatagtatgtaacaaattcttacgtatgcttgatatgcttctagactttctcctattttgacatctctgttcttttttcaacaccacatcaggaccattcttttcgtgattattacctcgatttacattgtgatatctgctgcttcaggcctattcaaactttcttgacgatccttgcacatttaattcctctagactattttggcatgagtctaataatgtcattgggatctttattgagattacattaaaatattttgattaatttaggaacagctggcagttttacaatattaattttccattcagaacatatgctttctctatttttcgaggcttttaaaacatttctcactgtaaattgttatagttttcttaatgcagatcttgcacatttcttataaagtttattcttatgcattttataattttgttactgttgtaagtaagttttttggatcatatttctaatttttattcctgggcatataagaaagctatagctttatgtatacagtgtctattttcagactttttatcagaccggatagaatgaggatcttaccaatttcagtgtgggtataaatagaatattagcacacttgtacattccctatgattttttaaaacagtatttcctttgataatgagttattcctgagaactttacatataactctgcatgtttgttttgttttgttttgttttttgagaaagggtcttgctctatggcccaggctggtgtgcagtggtgcgatctcggctcactgcaacctgtgcctcccgggctcaagtgattctcgtgcctcagcctcccaagtagctgggattacaggcactcgccaccacgcctggcttatttttgtatttttagtagagacggggtttcgccatgttggccaggctggtctcgaactcctggcctcaggtgatctggccaccttggcctcccaaagtgcagggattacaggtgtgagccactgtgcccggcgtctgcatgtctttttgtgaatgatttactttacttcccatctgtggctgatgggacaaaagaaaaattaagagcaatgtgattaatgctaagattgaccaacagtttttagaaaattaaactgcttccacatgagataattcatgttttctagatactttatcttccaacaagtggtaagtaatgaagtagataaacttcgttgtcactatgtttatatttcaagttttctgaatgaggcaggcggtgtaatgtgtatatattattattattgtttttatttttgagacacagtctcgctgtgttgcccaggctggagtacagtggtgtgatctgagctcactgcaacctccagctcctgggttcaaatgattcccctgcctcagtctcccaagtagctgggattacagatgtgcaccaccatgcccagctaagttttgtatttttagtagagatggggtttcaccatgttggccaggctggtctcgaactcctaacctcaggtgatctgcctgcctggggctcccaacgtgctgggattacaggcgtgagccaccatgcctggccaatatgtatatactattaattaatatgaagatattgttatgcttggatgacacccttcctgttgctgaggcaggagttacaaataaaacatagctcttcggtctgctcccagatcctcctcactgtactcttgctcacattttgtccctgacagatgcctaagggccactgaccactccctcaggaaatctctgtagctatacaagcagcaggcatagaaagaaatgaattgtaagctattcttctagcactctaattagacttttcagtctaattgcaggagatgaaattgaggcagatcaaattctcaggatgactagatttgagaatcattacaaagtaatacattgacaattacaaagctagcatgctcctgagagtagaactgaaccttcctcagcctcagagtatcagatgtgaataagaatatctcatcaacttgtttcacatgcttgtccacttgttttaaaggagaaaatgcaaataaatatgctgcaaggcagtctaggtaataattatttacactctagagacagacctggcttcaaatcttgacatgtaccacttattaacagcacgttgaaaaacacatttctttaatacctagagcctccacttctagccagaaaagttaagataattatagaacctactgaatatggttgttttgatgataaatgaaattatgtatgtatgaggtctatcctgacgccttatatatagtaagcatgacataatattatgtactgctactattgtatttgctaaatctccaattgttttaaagtataaaagagtattattattttattaaggacacagagtggtattctgagaggagtgggaatcctcaagagcttttttcctggaaattaattttgaaaagaagcttgatgaaaatcttgcatttagagtgaggaagacagtcaactctgaattacataattatatatatgtactggagacacagttcgttcctatgatataagaagggctgaaaaaaaaagttactcctttatttaatcttaaactgatctggtcttcttcatgagtcctcatccataaggaaattatatatatattccttatccaacagaggaaaaataaattctcattctggcttaatctgatcatttagggcacaatctctcataaaaaagacagcttagtctctctttcaccctccttctactgttacttgttgcaaataagatgatgttcctccattatatgaggtaaaggggatgcttcctaagccctcatggttgcaaggaaaaataagtgcccttgggtatcatgtcccttgttttctgagataatatcccttgttctctagtcactgataagcttgtcagctggtagaacacacgatcggcctcctaactagatcagtgcccaatatcattctctggttcagttagattcttcttaaattggaatgtctccagactcccaagtctctgctgtttcccattcagccctctggcccatggtccatctctggcatcctccactggggcaactagttttgccactgcaggtccaccacaaaccccttagcagtatctagctagaactcaacattcctaaagatgtgtgtgtgtatgagtgtgtatatccatctatatccatatctgtgtctatatactagactgtcaaaaaatttatatggtaacttttgttctacgacagctagggtacattgtgaaagtttcaaagcagagattatgtctcatttatttttagctttccagcacctcacctgatctctgatataagcaatcaatctgtattctcttcatgatgagaaatattctccattctcactgatagcagatttgtgaccactaaacacacacgcagtactggtgtgaacgcacaaactattgaaacaacaagcacgcaacaagcaaggaaattgtcactgctctataatttggtgatgagatatctggttactttcagacaaaagaaaatgtctcataataatagggttttgtatgattcttctctttcttccagaaataaaaaatttagaaacaaaacattgagggacattttaggttaattatgcattttagaagagttccccagatatcatttttgtctaatttatttttcaaattggcatataaaattatatgtatttatcttgtacaacataatgatttaaagcatatatacattttagaatggttaaatccagctaattaacaaatgcattatacctcacatagttatcattttgtggtgataacccttaacaccctggataacttttgattcagtttctgaacttgccatgtaaaattagtatttgtactcaatcagtttcttcagtttggagtatccttatagtgatcctgggcccaaactaaaagtgcatagggaaagtagcatagtctctttccatttgcctctagtcatttttatgtactgatgaacatgtaaatgctgctgtacaaagtacaagacagggatgaagaccctgttctcaaatatttccaggatagggagaggctttaattatattttttaaagattttctaaacagaagaaagaaaaatccccattgagaggggaggcagtggctcatgcctgtactcccagcactttgggagactgaggcaggaggatatcttgagtccaggagtttaggagttcaagaccaccttgggcaacagagtgagatctgatctctatagaaaataaaaataaaaaaagagaagggagtgcatggggaaaaagaaaacaataacaacaacaagaaattcagaagtggtttgatgtgttgaggttaaactgaaacaatgccttcattgcaatgagtgcctttgacgtctgtcaaaggtggtacagtcagtgacaatgactgcattctttctggctttgggttcacagtgctttgcagtgctgtgctattcagaactaaataactgttgtcactgctctataatttggcgatgatatctggttactttcagacaaaagaaaatgtctcataacaatggggttttgtatgattctgctctttcttccagaaatacaaaaaaaagacacatttaagaatttatctctgttcacattgaggaagaaaataagctttaaaaagttttactcctccctccctatagcaatgcttgcctgactttccatcgggggaaatgttactttcagcatattctgtgtgtgaaatagacagtgccagatgcttcaaatggtcataattgtgaaggatatgaaaaaagaggcatcttcctactgcgctttattaaatgtggagggaaaaaaaccctttgggtaaattagcacttggaggatttagcaaaagtgaattaactatgacagggtcccctaacacatctatttgatgatcttgcaagtcttattcccggttacctgggatactactttgctttgggatgccatggggtcattaaaatgtgagacaggttctctggaagagaaaaatcagatgaatcttgacttacagacagtatgtcttcctaaatagtatttcttttgactgaccatacctttcccttgatgctatatttctccctcatgcgctcatctgaacaaagaactgactgcgaatttcagctgccaaaaccaaaggacagttggaaaggctttttacaagcaattggcaagtgtgctctcaaaaactgaatatataggtgctgtttttctcttataaattagtattgaaatctagcctctattatgccatgggaatataaaaaggagaaatgaaggcagaagtatgtggtgactacattaaaaaaatgagtccactattcttattcttcttcttgttatttatttatttatttactttgagatggagtctcgctctgttgcccaggctggagtgcagtggcgcgatctcggctcactgcaagctccgcctcccgggttcacgccattctcctacctcagcctcccgagtagctgggactacaggcgcctgccaccacgcccagctaatttttgtatttttagtagagatggggtttcaccgtgttaaccaggatggtcttgatctcctgacctcatgatccacctgccttggccacccaaagtgctgggattacagacgtgagccaccgcacccagccgagtccactattctttcttttctttacacataattccaaaatcaaaaatagctccgagataccagatgtctttgtggtaactcattcaacccaacttgaatgtatttggtgcctgaaacttatctaacctaccgtgagattatctttatctctctcaatgtgactgttcatatgcttcactgcaaaaatattagtgtgtttgatgacaggggtgttgtagaccccactgggggtgctatagaatctgtgtagtgttacttctataaatctgacaaattctggattttagaacagaaaatattttgttacaagtgaggcactgtgctgctttacagactttatctcactgaagcctcacaacctcccccagacgtggacattgctctgatctctagtttatagatgaaaaatttaaggattcaaaggtgaaataagttgctcagagtcactcttctattatagttacgcactattgcataataaacatcccggaaatatagtgacttgaaacaacatgttattgttaacacacacttctgtggattgactcagctcagctgagtggttctgatatgtggctgctgtcagataggagctggggttggaatcatctgtaggattattggctcacatgcctatacctcagctggaataccttgaggctggtcaagcatgtctctctgcatgtggcctctctgcatggctatattattcctcccaacatggctgcctcagcatagtcagaagcagctcctagactagaacaagtgttccaggaagtggaacctgtcagtctattaaatcctgggctcagaaactggcatggtgtcatgtctacgtttttcgatgggtagaaatagtcagagacatcatatagtcagttatatcccctctgatatctcacaggggatataactccaagtattcatgtaggaatggaggctgctcagcttgtaagtgaacatctgggacttaaatttacatctacctagtgccaacgtccattgacaatgaagtaaaacctacctgtcacccatttttccctctgcatgccaccccgacctggtggcttaatattccattttttttcagtcactttcctataatcttctacctccaccagactgttctgtaaaaaggctattctgatgatgccaaaacgtagacctgtgctttatgtatttgaaggaatgggcagggagtattcttctttcccctctcctctacttacatgacttcagtgatcctgatttcaccctcatttttaaaattttcatcttgataagaaatacctaggaaataacaaacaaggagattcaggtaagaattgatgtgaggaagagaactggggagagcattctggaacattccaactacagtgagcagctttactcctttctccaccttcccattacctccaaactctaacacattcctcctactaaaatgtagtatatttaatgtttccttttttttaaacatttgccccagctcctaacacagtgactgtattaattcccatttctgtctcagaaatgcacgtgtgaaactccataggctggcagatatgctccccagacatgtcacctatgacctgtctctagatctgccctctatccaaacggaaagtggaaaaaaatagcttggtcatgcttgttagctgataaggttttagctttggctatattgagaccttgagctgtttttgcttttgttacttaagctgtgggatctggtcaacttggagacaaatagagaaggccttgagaattgaggttctatactgatttgtgggggaataatcacaatgctgttcagaaggagagttgttgcacttgctgtctttttaggaagaatcaaagcttcactgggatttggctagctggcagtcataattttgaaccctatccccattgggccaaacctatcacatgtgtcaaaatgacatggttctttcaggggacttttgggagtgagatccacagcaggcaactctgctaataaaatccagctcaacagtaacattgcattatttagccttcctcagagacatctggcatttgtcttccatttcctttctgttacaactttaccccctggatgctggagatacaagtaacccttcttgctgtgtcttctcttattctcccaataactaagcaacttatttctatttcttaaataaatctcatggttttctgacttctccaaggtcctcttgtcaagtcaaatgaaaactactgatggccccttccaaaaaaaataagtatcattacctagaatgttcctgaattctggttcattagcacaaggtgaagacatgatgtgtcactttttagggccttatcctcttgtttcagtgatgatgctgtagtagacaagaacattttctaaaagagaattatagtcttcagggccaagaaagtagttaggccagcagtcatgaacactatgctacaaacaccagataagaacttgttgccttgccagtggtagaattgttacaaatctatgtgggagggcctttgggatcttctcatctaattgcctcatttttctattaggagattggtacccaggtaggtaaatccatcttcccacagatatgagatgacacagtaaggctataacccagccctcctgatttctcctagctcagtgactgttctgcaataatgtatttagatcagaattcctttctttgtccatcagcatatcctgagtgttttactctatccccaaattacatacccctgtgatttatacttatgtcacatcaaagctatttttaattttctaggtctcttttaaattttggtacgttggtcaagagacctttccttgatctttctcacttgctaccaacgttttcattcctaccctctgtctttattgaactgttaagcccatgttgtcaggaaaattggcacacctttttggccaacgaattaaaggcaaagggataaagtgggttctgctgatcatcatatagctttccatctagtctcaccaggcctggctgatggaggagatttccacctcagcaaagactgtaactacagcaactagtgagttgtattgtccactttatgctagctggtgaggagatccagccaatgtggaagggtttgtaagtacatacatgtagtcccctgcagaatctatgccagaatcccatagtttgggcatgcgtcaaagacatctgatgtggaggccccctcctcacctgctcagggtctgagagactgtgactctgatctaggtgtctatctggcagtcttaatgagggatcctccaggaagcaaaaatagtgcaaagtaaaagggttgatacccctgcctttgacctttattttcaatctaataaacttacctttctcaggaaaagaggtgagagctggtattttggttttggtaactagggtctggggacaaggagctggtcacgtgctctgacagaaaaactaggatttcaacccccagctgggagctggaggggagttctgtcttcctcacttactaagcatgcttgaaaaacattaagctgaatatcagagcttgattgtcctgcagatgccacccattaagacagcaagggctgaggaaggagcctgagcaagtatagaaaagaacttacctaagagatcttaaagcagaacctggaaacactggaagcaggacataaattccttttgcacagcaaagcgatcttgtgttcctggtcagtagaggctcctttactttccttcagctaatgaaccacaaaaagaagatatatatagtattgacttctgaggccagggaattttgttttctttatttttctaaatttgagtagcatatgcttcaaaacatcagatatttactatcctcaaaatgactggaaaacttagaaggataaggcacaaggaatggcctaaataggcttaaataacaaatcccactaatggagtgatggtatataatggaaagacagtgagacattagtcttctttggaaataacgtgtaagaggattttgttaattctcattacttttccttcacttggcactgtaccccacccccgcacttctaactgttacgatagctagaactaggcaaaatgggacaaagtaattcatctgatcatatctttactcattttcagtccttatctcaaaatttgtgagtgatataaaagtcacgatccattagtggctccatacccttcataatgtgatctccattttcctcgcaatcatcaactcatggcacctccctttgatctatcctttctatgccctaactacgaaattagctaaaaaatggtgtagactttcaacacacagcatgtgctctttccttccacataatgaacatccttgctcttacctggtaactcattacttgtcctatacattccacttgacttgtttctccttctgcaaggattttgtcagtgatgttatcatatttttctgatgcatcttctttatgaatactttttggagaatgtctctgttgctggtctcaggcccagggcagttttacttctctcttaggattggttcgtatttatcttatcaacgcttagtagtgacatctaccagcttttcccttttgcaatggttgccagaactctcagaggcaaatttgtcgcacatttgtaatcaagagtatgaattttcccaaatacatttctggctatatttttacaagctgaactgttctttttctcccctttactttaaaatgtgatatcttatattttatggaacctctttctggagcaaggtggccaaggaaggaaggaagagaaagggagggaggcagaggaagaggatgagaggggagggaaagggaagggagcaatgagaagggaaaggaagagaagaaaatccaaattcaaagcctactttcttcatgagtctgtcacctgaaaaaattaatcactttccctctgagctcccccagtacttggaagaagcctctgttatggctgttatagcacttacatctctgcatgtcaattctttgtcttcttggacttttttccctcctatctgactgcaaattctttaaaacaaggacgacttcttcctttttttagtattcccagcttctggctcagttcctagttcaagtaactgctcaatatatgtttattgagtgaacagtagctgaaaagtagctccaggggtttaaaccaatcacacaagttgatttacttaattggagttctgttcaagatttagcctcattctctgaatcagacttgtgaccttcagaactttatgtgtgactagtcacagtcatatttctcattgtacatgtctccaactgactttcagcaaataacctgcagctttatttaatacaaatcagatcatattaaatataattaaaaatctctccatgaaataggataagatcccattggggcatcacaaaacacaattataccttcatggcatatgctcttttttagcaaatctacttgtgagtattaaagtctgacaatcctttctcaaagttagtatcatcttttaaataataccatataccaaataagaattaagaagtcactgtattatttctatcctggattatttctctaagcagaatcatcaacattgatacataacagggatttatttgagttcaatggcaaatcagttacatcagtataacagttaattatattcattctctttaatagatgatgaaattctacaatatgaacttaattaaaagtatcccagtgagcacaggtatgctcaaagtttctttctgcgcaagttgaaacagatgcgaccactggaagatttgctcacttaggtcttccaggtcattgctagggcaattacctaaaatgtcatttgaagcattaaactaaaaatataatcatctgaagaaattattattgattccgattttctctctgttatttggagaagtaataggcacaggaaaaaagaagacagtattgtgagtaggaaaatagattatcatacagtgtttttcaagttgcaagaaaagaagcatttaataatttcttcagacaggaacaaatcatcatttaaataaagggacaaacaaacatgatttaaccttcaacacagatatgtgttacatacacatgcattcacacacataaacacaggcacttgtgggttagagctctctctggttaaattataatgtcaccgtagtcactaatcatgaccagacaccaggacaggacgcggtacagagcaatccacactccagctccccaacttgccagcaggctgctttgcagtgtttcaggaaagaagaagaaaatgagttgacatctgcaagagataatgtctggaaattcacttctacatctagtaaataactgccattctttccaaagatgcagaatttcgttgataagctatctcatcagtgacttaaccatttggaaacatctcccttcaacttactgttccgtgttctcaaaataatagtttcagcaagatcaggggaagctacccctctcctttttttcccccttcccttgctttcagcaccatcaaaatctggagagctgaatagagattacaatttgtgaaggggaaacctaaggttgtatgagagatatgaaccccaccccccaattcccaggggaaagcacctgtcttgaactttgcacaaggatctgccactgagtttcatccttattttctcttcttgctctgtattcctcatagttgaatcatttgtagtgaatattttttctaaggcatctgtatttgttttctattgccattatagtaacttaccacaaacttcacaacttaaaatattccaatttattattttataattctgaaggtcaaaagtctggaatcgaactccctaagctaaaatcaaggtattggcagggctgcatccctttctggaggctccaggggagaattggtttctttgccttttccagcttctagaggctgcctacattccttggctcatggtctcttcctccatcttcaaagctggcaatgtctacttgtgtgtttctcatgctgcatctctctgacactgactctcctgtctgtttttcttacatggacctctacaactatattgagcccacctagataattcaggataatctctttattttagggtcagctgatagcaatctcaattccatctgctatcttaattaccccttgccatctaatttaacatattcagattctggggatgtggatatctttgggggaccattattctacctaccataacatctttctggaagcctcagcttctactcaaacaagctgaccccaagctaggggccacatctcttctttgtactcatgcatttttttcagttgaagttttttcaattggaataagttccagactcattctgtccggtgtgagagtaggtagcagcatttcaagaggctaagatgcttctgtcatcccaagctttgcagagaaagggttgatggggcacagtatgtttgagattttttttttcctagcctaagaaccaaattggagatcttatttatagatattccaccaatatgtctttattttcttcacatatttttggctagtaagtgttggaatcatcatcatttacatatttcccccaatggaaaatcagttactggaaacagagacaacaaacagatggccattaggccagctgtgttgtgaataaaaacagagtagaactaagttacaaagacatggaagacagaatagacttggttctggccgttagccaggttaaattggtatgtatgtggcaactgtgctgcaaaaccaatgaaaccattatgatcagctagaccacaaagagaaagaaaacctatgagaacactgaagttgtccacaaagaagcagattctaatatgaagattgtgcatcctaaaggttatgcaagataacccattggggtgtgaaacaaactgtaagcatttttatacccatatctctatttaaaataagaacttcaactttaccaatatttaaaatacaagccaggcttgttgtcacatgtctgtaatgccagctactcaggaagctgaggcaggaggatgtcttgagcccaggatttcaagaccagcctgggcaacatagcaagaaccctgtctcaaaaaaatacagtttgacactgccacactcattggctttgtacttcagccattcacatatcacacatgtgtattaaagaatttgggctgggcgcagtggctcacacctgtaatcccggaactctgggaggccgaagcgggcagatcacctgaggtcaggagtttcagaccagcctggccaacatggtgaaaccccatgtctactaagaatacaaaaattagccgggcgttgtggtgcatgcctgtagtcccagctacttgggaggctgagggaggagaatggcttgaacccgggaggcagaggttacagtgagccgagatcgtgccagtgcactccagcctgggcaacagagactccgtctcaagaaaaaaagaacttgtttgtgactggggtatctttggttcatatgcagtcaccttaatgtggctaattgcaatactcatgaaattgctaagtagactgattattatattatctagttttaactaaattgacccttacaaaatggacaagtgcttaaaaaatatgcacgtatcttaaagattctataagaaactgcataagaagataaaactaagatgggcccgggtaagcatgaagcaaaaggaagaaacagtattcccccaaccaccagtgtaatctcttcagtcacagaaaaatgcccagtgtgatcaaatcggacacattcaattttgagcacaaaaatatttttgtattttaaatgcatacagtaaaaataaaaatcatgttatattaatacttgtttcatcttccgctctgtttaaatttttatttagtgcatattttaagatgtttgtaatagattagtacaatagtccatgcttgtactttatattctgagggtgtatacacatattttgagggtaggtattcaaatttcttttatggataagggtacacaatcaagatggtttgtagaccattgctctagaggatagagcttttggagggaggcaacaaattccaaaggaaaggtttggcatggaaaaacacttaaaagctcactgagagaagggtgtatcagggaactctagtgtaggtcataggacttgctacactaagttgcaaatttgtccaaatctgacattgccaggaagctaagtcttgcactaatctttgtgtagtacttttatcctataatagggtccatgacatattagataaagaaaagaaaataaaccataagggtctcagtgagatcttcaaaattttacacttctactttgtttttaatgcttagtaaaagaactgctgaaaaagtcattaaaaaatgagtattttgtctttaaccaagagccgggaagtatctcagaaacatatttcaacattaaaatatcaaataatcaatttttataagaagtgcatttaattagcaacttggctatagctagcacacagtgagttaatctaataatcagtgactctctggacagagtcatcttaaattcagctattcttttatcgatttaagaaatgtaataatatgcattttatagcaaatggctagaaaatttcagctacagaatacttcattctatgaagcctgattattttatggcttagaagatgttcataacttctgttccaacatgatacagaagcatccttcagaatgttatctttaagatcacagaagttaagagatttaaatttcaaagtgaatattatccattttctgttcttttttagcctacttctaggcaagccctctgatgccctcatcgtttgtttaaagtttctctttcttccaggctactttgcgaatcaattccagatcacagaggagagaaaaccttattccttttttccaccccaagctcaccttcctagacaagatttttatctacattaaatacattcgctaacccaggatagtgacctacccatagcagtggcttctgtggagctcagcagaacatagagaagtcccacaatgcttgattaaagccatcaggaaagcctgaggtaattctaaaagatcccactctgtggtacaaaatggccctagaagccaatcttctgactacttgtcattttatttcatttcatttcattttttcttttcttttcttttttttttttttttttgattcagggtctcactctgtcaggctggagtgtatggtgtgatctcggctcactgcagcctcgatttcctgggcacaagcaatcttcccacctcagcctactgagtagctgggctacaggcgagtgccaccagctaattttttgtattttttgtagaaatggggtttcactgtgttgcccaggctggtctcgaactcctgggcttaagtgatctgcctgcttcggcctcccgaggtgctgagattacaagtgtgagccaccacctggccttgtcattttgttaccgttaacactttcctctaggtctggttcccaatgcgcagaatccggggaatttgaacagggctctcttggagagttgtttcattctatgtgctgggataaaaacaaattatttttcctgctaggaatgcactaaagatccctccactgtatcttccaggaggttcatattagtatttgctttagggataatgttttggattgcaccacagagcaaagtttttggtcagacaatctaatgggactaataacagccgacctgaacattgacaattcttgcacattatcccattccatcctcacagatcagagaaacccaattaggtaacatttccccacttcatagaccagggaaggaaatttctgagaggttaattgatgtgctgaaaggcacataaagtgcccggctcagtcccacgtctggctctagattcctttttagttcttctgtattatgctgtctcttctaaatggattattaggttggtaatgttattcttagtcattctgcccaaataatgaataacagattatacatttaagatgttaaaatgtatcataattttattataactgaaaatgttcagaatttttttaaataataattttggggaaaagaaaacttccttatacattgtttcctcagtatttttttcattaggtattttttccatttggctgtggcaatccttgagattgattctcactgtcagggtcataactctctctctttcacccagcggtaaccatggaaacatatgtataacacgtcctgcttcttttaatatgattattcatgagttgccataaaaatataaagtgtatttgtttgcatatttaattgttaaaataacacaagtatttgcttttaaaatacctactcatagctctgtggtcatgtatacataaagtaccaaccattcttaaatcctaggattaagaagtgacatgttgcaaatttagagtaccttgctcttcaccagttgtatagcaaaagagttttagtcagtttagaagtaccatgggtccaccgcgtggtggctcgcacgtgtaatcccagcactttgggaggctgaggcaggtggattgcctgaggtcaggagtttgagagcagcctggtcaacacagtgaaaccctatctctactaaaaatacaaaaaattagctgggcatggtggtaggcgcctgtaatcccagctactagggaggctgaggcaggagaatcgcttgaacctgggaggtggaggttgcagcaagccgagatcgcgccattacactccaggttgcagtgagccaagattgcaccattgcactccagcctaggcaacaagagtgaaactccatctcaaaacaacaaaaaaacaaaaaaacagaaaaaaaaaaaaaaaaaaagaagcagcagcagcagcagcagtaccattggtcgaattagggttcctgtcccatttttctgcatacatttaaagtctaatgtgatatagtaagtactttctcctttgaagatcagctataatctcagaacttaatatttcacttgtatagaagttactcttaaatcagattctatgacccagacagccatccagaattttagttcgtcatctctagcttcctaataaaaatatccaagtggatgtcccactaccccttccaattcaatttgcctaaaaccaaacttgttatctttccttcagggttcaagtcctttcagaaatttcttaattcaatctccaatcccatcattctcttagttactcaggcttaaacttttgttatcctacggcattttctttctctcttctttcacgtcctatatcctataaattattcttagcttctactagcctttctatttccactgccacacttgttacattgtgctgagactaccctacagtgctttaacaagtcttctcccccagctctcatctctttgtatctgccttccagtctactccaaggtcgaactgtctaactcaacattttgcatatgaccctcaccccctcacgacaaccatttcttctaaattaaattgatgtataacaccattcaaaagttatttctttcagcttcaaaacaatcactccagtatatacattacttgccaacatgatgtgaggtgaaccacatttcttgcccacacgctgttctcatttctgttctagttcctcacttatgacttgtaaattgaaagcacctagatttctgttgttattctggatgagtaatggcaggacaaccctaaatcccaagtatttctgtggctcttttaaggaaaagaaatatacaaaaatagtctaaaggaagaaaaatataaatattctaaacattagtcttatatctgtgttacattgccattatatcagttttgcttgaaataagactgtggagattagatattagttttaatttatgacatttggcaattgtaaacaatttgtgttactttattcttttagaatctgtgtagttttccaaaattaaaattaaaattccatttctagccatagaggagtcttcttagttctatttgagtcaacaatcatttttaaagttttaatttgaaaattaaggacagatccaactaggattgtgagtccagcagacatactgtgtgagcacacagctgtggcatatctgtggaacggataagggtggcatattttggcacttgtggaacttattcccatcattttaaacaatgcttggtaggtttatatcaacagatttattttcccttcagctattacgagagtaaagcagagacctaaggtctggcatatgaatcttacaaatgagggatttttaactaggagcgactctgaaagcttcttacattcttgggacagtctgcagtcatagattgaatgagaaaagcctcatattttggctgggtgcggtggctcacacctgtaatcccagcactttgggaggtcgaggtgggcggatcatctcaggtcaggagttctagaccatcctggccaacgtggcgaaatctcgtctctactaaaaatacaaaaattagccgggcatggtggtatgtgcctgtaagtaatcccagctacttgggaggctgaggcaggagaatcgcctgaacctgggagatgaaggttgcagtaggctgagatcactccactgcactccagcctgggcaatagagcgagactccgtcaaaaaaaaaaaagaaaaaaaaaaaaaaaaaaaagaaaagccccatgtcttttcattgaccatatacgatctcttaaccagcacagcattgatgcatttcagccatctcacaaaacttcccttttatcattctgaaatgattttatctttcccaagagactgatagacaaagcagctttgtatactcacgtcctggttattgtgcattattaggaaacagataggaaagctaccctcatacagaggctatgtaaatattatttggggaagaggaaaaacacatatgggtgctaagaagataagacagtgcctctgaccgttctatttgatgtttcttaaacctgcattgttatgaaaactcaggtaaatgaatttgtaatgactactgaaaatgaaacaggagtatacttgaataagtattgacatttttttttcaggtcatttactttaagactcacaaagaacatattagctaatagaattcatggccaaaccatgatgtaaatggagctaaggtcagaattagattccttagggagctgaagaaaaaacacggctatgaccctaaaaccaatctgctgactgttttctgctgactcttttctgatgcaaagtaaatggtgggaaaaaaaaaactgatactaaaaacaaacaaataaacaaaaaaacctctaactatccaaccacctgtgcaatacaatagctttctataaaataaaacagaatggaaaaaaaatctcaaaatcatgagttgaaccaatgaaacatacgggttggttcagcattgcaaccagatgtcatcttaataaaaaccaacactattagctctttgatgattaataatagtaaataccattatcacactcaaatatgactctttaggctgggttactaatatatacaatcaacctgcatttttcccgtctttccggatttgacaggaagagtggctgtggcatggaggaagattaaaagtctaagagaacctcggatttagattctagttgcggccctgccctttcttagttgtgtgaccttgagaaaatcagctaacctctctgaatcctatcccttcacttgaaagtgtgttaaaatggcacttatacatgataattgtataaatacgtttatatatggcatatataagtaatacatatgtaatatgacagtattgaagttaatataaactaatatgatataatgtgtttatatactatttacaaattatatattaatataatgtatttatattaacataaatacatgtatattagtttaaattatatatgaaaatcttataattaaaatttttacatataattattaatatatcataaatttctatattatatataataaatttatatataaatcatatctatacacacaatgctttgtcatgtggggtcataaaagagtactgcaatcattattatgtcttcggttaactttacaatgaaaagcttcttaatcaatattaaactacgggcaaatataatgctgctgccttctaatgtaatttactttaggaaaagcaattgatgagataaaaggtctttctcttttttcatttttatttttttgagacagagcctcgctctgttgccaggctggagtgcagtggcacgatctcagctcactgcaacctccagttctctagttcaagcgattctcctcctcagcctcccgagtagctgggattacaggcacacaccaccatgcccagctaacttttgtatttttagtacagacggggtttcaccatgttggccagaatggtctcaatctcctgacctcgtgatctgtctgccttggcctcccaaagtgctaggattacaggcgtgagccaccgcacccggccaaggtctttctctttttaactttgtttgcaatacctagcttgccttcatgctgttatattaggttagcattaattttccattattggagcagattgcctacaagcacacacatacaaatagtacactgaggaggaaggagccagtgctgaagttctttttctgaaacgtaatagagcttttctcattactgcaaatacatgaatgaatgaacaacattgcaagcacagacgttgcatacattctctcatcaagcagcgccatcactgccttagtactttttgttgttgttcagcattattgatttttccaacaatcgagtttgtttgcaataaactgaactggagcataaccttcactaattagaaaaaatgtatgggtattagcttaaggaagcaataacacttcttgtacgttttctatcgaaactcagggtgatgctttgtaggagtgctattgtttcttttcccccttgtgacaatgttgttaagtatgatgcaaaaaagtccaaagaccttttaaataatttgcatccattctagaaggaagaagaactacaaaggccaggtgtgaatggatatgaaaatagcaacttagaatagaaatatctgccattactctctctgcatacctctaagcctttgtccctatttacaattgtttttatattctggtccactttgaaagtgaacaccttaaggatctttgttttaactataaaatttagaaaatattccttgattcatatttatatttgctgggtaattatcatttataaaatcatagttgaactaagaagctagaaaaaactacatgtgtgattaactgtttagtttttcaccatttctggtcaggctgtttgaattggccaatgcagatttcttcatcccagcaaagcttaatcatagaagtaatttcaattatataataaataaaagctgctttgcctcagcatattcagtgattaaaaatgagtcgttttttaaaattttcaaatctgacagtatttcttgaaagaaataatttgtgatggaaataaactgaaaatgaggaatacaatggtcattgaggtgcaaaccaatgcaacagaataaagttaacatgaaatttgaaattattgcccagaaatcaaagtaactataaaaatatagctgttattagggaaatctctagtaggaaaagaaagccagaaattatcacattagcattaccatgggatgtcattctagttcttaaatagaactaaagacgagagcatcgtgactctaccattcatatgaaggagactaaatagacaatgatcttgaatccatttccttttaaaaatcttaacagcatagggtaagtatttggtgatggattcttggctgcagaaaattcctcatgataaacagggtgctatcattaaataacacacatgctaaatgctgggaatacattaattcctccaagtccaattccctgtaagtcatcttattctctaaaaatcattgtcataaagggaattctgtgtgtgacatctgagagtaagcatgtttagaagtgtctcaagagtacctgacagtaataaaatcaggaaggtaagacaagaattatccagtctttgcagggtcaaaaatgacccttctctttattccttaagttttttgtgtttttttttttttttttttttttttttttggtgagatacagtttagctcttcttgcccaggctggagtgcaatggtgcggtcttggctcactgcaacctccacctcctgggttcaagcaattcttcggtcccagcctctcaagtagctgggattataggcgtccgccaacatgcccggctcatttttgtatttttagtagagatggggtttcaccatgttagccaggctggtctcaaactcctgaccgcaggtgatccacccacctcggcctcccaaagtactaggattacgggcatgagccaacatgcccagccctattctttaatttttaagtagctttggccttcactagcattactacagtcctatatgtaaaagtatactgctgatgaggaaaatatacctcatttaaaatgtgtgctttaaagtcgagtctctgctatctaccataccaatgtaggttttggtcactatcaagttattttcgttctcagcaagtaaaactgccatgttcttcatgatttttttctatgcatacacagtcattgctaagataaacattatttttagacatcaaaattcctagcttattattttacatcatattagtgcaattgtcaagagacaattttatatttcttaattcactttttctctttgtaatctgagttccccaaataagagaaatattaataagggtggcatattttggcacttgtggaattaactagcaatatgtaaattcctaaatagcatactgttaaaatgcttctattcttcaaactctaataatttgctaagaaattatgataataaattttaagaatttttggctaagtgcagaaaaatctgttgaattattaatacattagcaaaatgtatcatttagggaaataattttattgtaaggaaagaacttagaaatttgataataagcataatttaatgaataattttctgaatgagtcatttctttgcaataaaaagaatttttctctctacatatgtgtggagcaagtttctgtaaaggaatccaaaacttgtaaggaagggaagccaaagaattaccaaaaaatattcctgggtgttttgaggtttcataagatatttgataacatattgaatgactctctttgtgaaacatttagtagcagacagtgcaggaaaaagctcattcttttttttttttcttcgcgacaaattcttactctgtcacccagactggagtgcagtggcgcgatctcagctcactgcaacctctgactcctgggttcaagtgattctcatgcctcagcctcccaagtagcagggattacaggcatgtgccaccatgcctggctaatttttgtatttttagtagagacagggttttgccctgttggccaggctggtcttgaactactggcctcaagtgatccacccgtcttggccttccaaagtgctggaattacaggcgtgatccgctgcacccagctgaaagctcattctttactaatcatgaaaccctatattaaaaaaaacaaaacaataaactattaggctggtcttttccagtgatatagccaaagcaccatgccagcaagtgaaacataataggccctcaataaataattgttgaaatagccatatgatcagacttcacacacaaaggctgaactgagttgaggtaattcaggatagaacccactggataatcaagcacataatattggctttaattatgtagctgtttcagaattgagaggtgatgaagggactcaaacagcttgatgctctggctactgggctgtttggatggctatgtgctctttgctcttactccattgtgaatttctgaagccaggacagccttaattagatgtgagtctgatatgataaatatgttgctatggtgaatatgaatgtttcatacaacaatatttcatgccaattaacagtaaattccaaatactttgccaataaaattgaaaataccattattccattggcctgtccatgatggcataaataatgcatatttgtttatttatcaagagggctcttattgaacaccctgagctttctaacagttatctcccttgtgcagtgtgccagctcattaggaagactaaagtcacagtggagtcatcctgaaatgacttcaacacaaattccatgtaaaaagatttttggagagccatctgtcccggggtctaggttatcttttggaaattggaactaaatggatgaaaagtatagaaatgctttggtcttccaaatactttcttaatcacctctaattgtaaaaagaggaaaaagtggctttaagaaaaaatagcaaattaaattaattcataagctattttgtatgatacaggagacagacatttataaaagtaattgtgcttagttatcttattgcaagccttcatctccacatttgacttcactggcaaatgcggcaacttacaaaacaaatcaggccatttcaacgctagtactacagagcttgtttttctcccccaatcttaaagagacttcatggatattttaatgttagattttacaatttaacatattaagatatgattactaaagactaattcttgtctctgctacctccatgatttcattactgtcatgtgccgttgggacgcttataaagccagaaacaactgtagcagaatgtgtagattacatgccattagtttcactgttcataatgccgagcatattccagagtatgtgctgaatgcctccaaccttcatgaagatatcctttttccttttttccataaaaagacatcattgatggcaactagtataatggacagatcattcaaaaagcacatttgatcatcaaacattttccaggtaccaaaaactttctggaaacacacaatagaatttaaacctagtaagaaggctggatgtgaacatattgaactctaagccaataaaatgtacaataatagaggtatgcaattagtatatggagacacagttgatgatgccattaatttttctttgggaggtaataattataacatctaatcttaactgagtaattactgtgggtcacattctgctttaagtgctttaaatgtactaacagagtgagagggaatggatattatttccatgtttttagactctaagatataatgcatcttatccaaagccatggggctagttggcagtggagctaacattttaactcgggaaatatgggtccaaaacctaggtttttggcccccaggccatactgcctttctgttttagagtcatctaagaaaagtctggagacaaattgatatttttgttaaaatctaaaatatgaagatgacttcatcatttaaagaaagagtaggaagagaatttaaacaaaggacatatagtgagcaaaattaggaagaaatatgggtccaaaacctaggtttttggcccccaggccatactgcctttctgttttagagtcatctaaaaaaaagtcatctaagaaaagtctggagacagattgatatttttgttaaaatctaaaatatgaagatgacttcatcatttaaagaaagaatagaaagagaatttaaacaaaggacatatagtgagcaaaatgaggaagaaatgaaagggagaataaattgatgggaagttgcccaaagtttgagttgctaaattggagggcatgcaggaagcagcatgggaatgaaattgtaaagggagatggagcccagactaggagtcaccttgtaggccatgaaataggatttgggcctgttctgtgggatcccttaggggatattgttatactcactcttaacattatactgactccctagccaggtcaaagtacaatttaagctgccaatgaaatatattggctttaaatttttgtcaccatttttaaagtgtagtgtggaactgaaacattatataaacattgtatagacaaaagaaaccatctattctaaatattcttaagctgtttgaataatgattggtctaaatgtattcctttcacataaattatataaactccctttgaaatgatgtatgagttaaataagcaatttttatgttaaaaagttcagtaattttaaaaatgaaaatgctcttactgaagcctccaaatcatgcatactatatacaatcttttatgttgtaaatgtccatgataaaagaaaacaaacaaaacaagacatcagcaccaccaccaataaaatttcaatcagaagggatcacttggtttgaaactttatgcagctctcagatagccagactttctttgtcaaaaacattcaatacaatgtttaggaagtgtcgtgtttaacagaaaacatcatgtgctaatattaatttggaaaattctatgtggtggctgacaccctacagtgttccagtctcttggaagctattcgggaatagtgagtgttccttctaactgttttatgtgggggtatgtggaatcttctaatctccaaagccactaggcttctatcctgactcttatttcctgatatatggaccctcttcttaactctggagtgttggactttctcttttctgcccttcactggtggcttggtttagttttctggtaactgcatttcttcctgagcacatccagaatcttctcagaggaggcaatcattccattctttccttgtgacacctcaattctccatctccttacccaaagagcctcctttatgtgtcactttccctttgaaattatcttttctttcttagaaaacttttcgtttctattttaagaaaagctgggtaacgtaagaacatgaaacattaagaggcagatggtaaattgattagacataagatgcttcgtatttgtatcctctgtcctgttttccactttttcttcagaaagtagtccgtgactttgtattcatagctgtttttcactttacatatcaagaaccaatgtttgggaaacaaataattgtgagtaagtggttatattgagttgcatatcagaagatatttaattttataggttaaatttataatatgaattgctatggtataattttgagaaaaaaaatcatttttagtcattacaaatatttattaatggccacactaggaaacaaagattatgagcctcatataggatacattttttgaacttgcaaaggaatacaccatatttcattaggtcagtaggtctttccctccttaggtattgatacgcctacaagtgtaatgacgtggcatttataatttggtaaaaataattaaagttcatttttgtgaacaacttagtttttaaccaattagaatctacttagatacattctataattacatcaccctaagatatttacaatctgatcaatgctatttttcatgaggaagagtgatagaattagagccacagtctagctgatgtaattatagccatggaacgaaacatatgtgcctgccatttatctcaggtatctcattgaaaaaaaggatgagaaaagctgatccagagtaggtcactaagcatcatccataaattgagaattggttctcaaacaataactttgaatcagcagaaatccagtgtttgctaaaagctatacatgaagagttaaagtagttgatcccctcaactctagtctctgcttatttttatattaaaagtcaaatgcttgctttgttctgaaattaatatacatatacacacatatatacatatatatatacacatatgaaatataacatgaatatgtggattatatcagagcaagtcatcatctaaaactagattctagctaatatttcagcaaatatgggctaaaaacctatgtggccacaaaatattgatacagctgtgaataaattaggtataattccttctaaaattttcagtctacagtggagacagccattaaataaattatcatgtactaaccaaaataaataactgcttatcattactgaatttctgatgttcttgcaaaaacaatttgaaaaactatatgtataaatttactactgaatatggtagtcatcctttaaaagacaatttaatggcttcttggccttttggctaagatcaagtatagtatctgttcttatccatttaaaagacaatctaccataatacctgaggaagaacatatattttataataacataaatataatacgtgttctcaaataaaaattaagccttctaacaagtgattttacttttaggcacgtaacttcaaaaatatggaaaaatggacgctgggtgtggtggcccaaacctataatcccagtgttttgggaggccgaggtgggaagatcacttgaggccaggagtttgagaccagcctgggtaacatagtgagaccccatctctaccaaattattttttaattagctgggtgtggtggttcacacctgtagtcctatctacctgggaggctaaggcaggtggatcacttgaacccaggaatttcaggttgtagtgagctgtgatcacacagctgtgctccagcctggacaacagagtgagaccttgtctctcaaaaaaacatgaaaaaatgtaactacctatatctatatatcatatatatgtgtgtgtatatatatacacacacatatatatatgataatatgtaactacctatatctatctattttatatatatatatgtatatatatgtgtgtatgtatatatatatatatatatatatacacacatatatatattaggtcccacagatgtacaaatttttaatgtacttttattgtaaataaacactgctggatttatatatcaaaaatattgctgattaagacttgatggcccgggcgcaggggctcacacctgtaatcccagcactttgggaggccgaggcaggtgggtcacaaggtcaggagatcgagaacatcctggccaacatggtgaaaccctgtctctactaaaaatacaaaaattagtcaggcgttgcggcatgcgcctgtagtcccagctactcaggaggctgaggcaggagaatcgcttgaacccaggaggcggaggttgcagtgagccgagattgcgccactgcactccagcctgggcgacaaatcgagactttgtctcaaaaaaaaaaaaaaaaaaagacttgatagacattagaaagttaactgagggaagtcatcaaatccacttccttaaataggtaagattctccttcgatggtgctaattcctttgagaatacttgaatgaaaggagatgagcgttcatgtattatttgaatactgaatcaatgctttcctgagtaaccttggtgatatggtccttccacatctgagagtttattttgcatccccagatattctaccttcattgcaatttttcctccaattggtttagaaatggtacagaggaaagttagtaaaagtaatcactctaaaagtgagtcatttattcttttatcctatgtaagtaaaagaactgaaaatcaagcagttagctttaccctgtggtctcaaacatatgagttaaaagacataataaaaactatcaatgtgtccaatatatttgtccttagcatcattaatctattccttgtaaggttggagtttataaaatgagactccataaagagagagatacctagtctaaatcaaagtgtgtgcgttatgacatagtagaatatattgataagttaactgaaatcaggtaattgcgggtagattggcttaacatgtccaaaacattctgtgtaagttaaatgactggtaagtaaaatggtgggactcatgaaagttaatttaattatatcagtcaaaaatacataaaataatttcaatactgttacaacctcactctagtaggtgtttctcagaggcacttgcttcattgtttatttgtcatcattcctaataaacatatatttgagttcatgtcatctaaaaataaatggcctaccctacagagacatggaaaactgatgtaggcatacactcacccaacatttaatgacctgaatccatctcaatgacttccttttctattcaaataaccagtttggaatttgatttactaaaattaacttttgtggtattgtttcaacaaaggacagccttttgtgtgacaacctataatatttagctactaaaagacctaccatatttctctcccactgagaattatttgttatctaatatcacttatagacttcatgtaaatcaaataattatttctggctctgcatggtgtaaggatgattaaaaacttgtcaagctatcagaagaataaggccacttcccagcatggaatgacattatttattctaggtccaatgattggtaccagaactgacccttaataataatatttatgacatgggggtgggaggggagaaaccatttagaatgattagtcttatcacaatcctaaggcattagaattttcaaaagtgctgaaataattgtgcaactttaaggaaatgtataagaaggtagctaaattatcactgaagttagtgaacactatgcagtgctaatcatgtatggcttctcaaaagcatttaacactcttgacaactgtcctcttgagatgctgtacctacttccctctctgttcttcaactttttctctattcatttgctgtctctttggctgtttctctgtattttgttcctccattacatatttgaatcctgtgatttgtcatgcattatctttgcttttcattttatgtgctgttctggaaaattctactccttcaagtgcgtttactgcttttcatatattctttaggcaagatctttttcttgaccttcaggcccatatcagcacaccaggagaaatctcccactgataactcagattcatcctggataaattgatctcattatctgtcattcaaaactggcttttcataatatatggctccaaaattcttatagtcatgtagcaaaattcctgggagttattctccctcacagtcccatccattaaaatctgataagtgaactgaaatgctactcaaaactctattctgggtcttctttccccactaccctgactcatgttcccattacctgtccattatcaccattccaaaagactctctgcctgaattcttgcacatctataatccagcttcccaagtgtgtttttttaatacacagaaacgattagccgcaacagcctttaacaatacaagactgcctgaagtccaaacatactaacttgacataagtatcctttgtggtcatatgttgagcctcctttccagcctcctttagcttggtcacctttgtgctctaagtttcagctatactatgctaccaaggcatagcaggatgtttcacacctatatgcatgagcatgatgtgtatgtgcatggacacatatgttttacacaattctcactgcttataaaacacactgcatcagctgtctattgttacgtaacaaattagcacacatttaatggcttaaaacaatacacatttattatttcacaatttctgtaggttagaaacctgggcatggccatgctgggtcctttgcttcacagtgtctcatagatggcaataaaggtgtcagtcaggactacagtctcatctgagggctcaaccggggaaggatctgcttctatattcactcagtggttgttggcagaatttagtttctcaaggccttaattcctaactaggtgttggccagaggcctttttcagttccttactacaagggcttctctataggcagctgcctcataagtatggcagctgcttcaccaaagccaacagtgaagagagtcttttagcaagatgaagttcacaatcttacataacctaatcactacagtgatattccatcatctttgacattttctattttgtaggcaactaggtttagcccactctgaacaagttggaattacacaaagatgcaactattaggaggctgggattatgaggagccatttcagaatcgaccacacccaccaaccccaccttcctttacccccatcaacctgacaacacctgctcaaattattgaagactcatgtgacttaccaagacctcagtttttcaatatttcccaacaaacccaccatgaagttggttactcctttcttcatactcccagtacacctccaatattatttttcaattattgtttacatagttttctctcccgtcaatactttgagaacaaaaaatgtagtgtgttattttctactctctggtaagatcagtccaaagaaagtgctcattaaatgttgaataataattgtttaaagtaaataaaaccacagatattaaatacataaaattatctggaaacaggtaattaccccagggataattgacagctaacgatgtgcttaacatctgaatgtatcatttactttagttagagtacacatggtaatcttttgtgagtgacatcacaaagtgacagattcggatgtctctattatttttaaattctttcaaatgagaaacaactataaaatgaaatgcgatgtggataatatagtatagtggttaagatcactggctttagcatcagtcaatgggatcaaatcccacttctaccacttattaactgtatggttttggacaagttactttaacctctctgttcctttctttactggtctgtgaaatggggtctgaaattgcacctacctcatagggctgttataaagattaaatacaattatttatggaaagcagttaataaagacctagtgtgtatttgactctcagtaaatgtcaatcattattatctcctagtatactgaaatagaaagatgtccataatatgaaacttggagagatgtatgtaagttgttaattatctttaatatatacatagatatatacagttaattcatctatatgtttgtatatgggaaaattgggaagtatacacagatttttaataatgattatttccaggaattagggaagaggtgagggtggataactttatttttttattttgcagattattgtattatttgaattattctaaataagcatatatcacctttctcttttttttgagacggagtttcactcttgtctcccatactggggtgcagtggtactatcttggctcactggaacctctgcctcccaggttcaagcgattctcctgtctcagcctcccgagtagctgggattacaggcgcccaccaccatgccagacttatttttgtagttttaatagagacggggtttcaccatgttggccaggctggtctcgaactcccgacctcaggtgatccacccatctcggcctcccaaagtgccgggattacaggcatgagccaccatgcccggtcgcatatatcacttttataatctgttatggattggatatattcgtccaaaaagatatgttgaaatcctaaccccagaatgttactttctttggaaataaggacattagagacataattagttaaggtgaggttatgctggtgtagggtgggccctaattcagtatgattagtgtccttataagaagagacatctagacacataggagagaacaccactgggtaatgaagccagtgattgagtgctgcagctgcaagccaaggaatgccaaggattgctgacagagcaccagaagctaagaagaggcaaggaaggattcccctacatgtttcaaagggatcgtggttccgccaacaccttgatttggactcctaacctccagaactatgagccaatacatgtctgttgttttaagccacttagtttgtggttctttgctactgcaggcccagaaaactaacagatagccaaaataaattaattaatatttttaagtatatacaaaaaagaagagaaaagacaggcagttgcatagctcataaaattataatctcttgaagttgaagcttcaggttcattttgactcttacctctccggccatgccaatagaattattagtttttgacatcccagccaaatatttgacaagcagttcataaactaatgggaagtgctaagaaatataatatggagctatttctttctattctgttcctccatgaaatttcttctatccaatttccaatcatgcaaatcgtatcaagaaggcaagtgatccaagggttaagcaacatttgattggctgctgtgactgcatgtatctaaagagaaatagaaagcaatttgactacggtatgtgactcaagtgatatgtgttttagataagtaattagaaacaaaacaaaaagtcaattagtttctagcctgtccttcaactgtttaaaatattatagcaataaaactaatggagagttttttcctaactacatcaaagttattaaaatgtagagtcaattagaaaaaaaatataagaatgtacattcataattgttgaatactaacaactcatatcaaatggacaaactgtttgacaccaatatatgtgggaaaggtcagggcttctaaagaaatgtttctttaatgatgaaactttccaattttaattttttttaattagcatcttatagacggaggaagaagagggtcaaaaacaaagaactttttcttgtcttaatatgtatagccatggaagatggcagaagggagtgaaaaaattcaatcaatcatttttataaataaaacaaatggagaaagcagtggaaccagtaaccccaataatggatcctatattattatttattttatttgcctatctctttcacagatatctagctattcatcaagtagacattccctccaaggcacaaagaaacactgaagttttaatctaccattgtttaattctttcttctggcagaaatacttgtgttcataagaaactttccaaattaattaaacttgtttaaggttgatactggccagagactttcctgtcttccaatttaagagattttgatgaacatatgagaattacattacaaaatatggcaagacggggaaagaaaatagaagaggtgaaagaaaggagagggaatgaaaggaggaagaaagaagaaagaaaactgaaaatggaaatacaggccagacgcagtggctcacgcctgtaatcccagcactttgggaagctgaggcaggtggatcacctgcggtcaggaatttgagaccagcctgaccaacatggtgaaacccccgtctctactaaaaaattacaaaaattatgcgagtatggtggtatgtgcccataatccgagctacttgggaggctgaggcaggagaattgcttgagccctggaggcggaggttgcagtgagccgagatcacgccattgcactccagcctgtgcaacaagagcaaaactcttctcaaaaaaaaaaaaataataataataatacaaattttctctcattcatttcacaaatgtcaagtattggccattattcctaatgtaaaaaacaaaacaaaacaaaaaaacaaaacaaacaaacaaaaaatacccaccgtgtttcacattgttctgaagtagttactgttggttattattgagagtgcaaaccacccatgcttcctcttgggctaatgcagaggttaaacagcctgagaattacctgcaccatggaaatgtattctggggttaataagaacaaagtgtccatctttgagttattttaacaactaaaccctagagaccagagataaactaaaggagaataaagaaatataattacattggacagtaatgtcatgaagagttaattaattaggattcaatgagtcataacttattttgaagatgtggcattttagaaaaccacctagcttcattcatattaccctcagacattaaaggtgtaattgttgtcattagcattttaattggtcctgtaatttaatggttatacacgtggttgttgtaaggtcttttaagctgttgggattttaatatttgacatgtagcttgaaaaaataattatgacatttcccagatctgaggttggcctttgcagttaatgacaacactgcgttttcaaaatggttattattgatagtacaaatactcaaatggcctacagagctaccttcatctgtaccatagttcttttttttggagatcactgggattatctaatcagaccaacactgccaccatatttaagcagtatgtaatgtatggtagatatattgcaaaatgccaaaagaaaagcacttgtagtagtttctacttggaaaacagtattgttactaaaagttatggcagaaataatattttattaactgtaggccttgattgtcttgattgcaaatgctaggtactatattatgcacacagcttgaaatgtatgtggcacaatgaataaaagcttactttcctaaaatataaaatgattgaggaatttgatgatcacatttaaatattttcaaaaagggttattttctacccagcagtagaataattgatagataattacaaaagaggctatgccaaaattattgctaggccctttatattgagacaatggtctttatatagtgtttgatgagaaatctatcatttcccttggggtaatggccagttatttaccaccgtaacaacttaaatgactctgtttctagacttctagttaggggcacttcttaaatcttgaaaatggggcaaagcataaatttctaagatttacttggttgtcttcacccttagtacatggggtgagtttcagcttacaaacctggcctctcctctgaaactagcaaggaagaaccaagtgtcacaatatagcaggagctcttaatccgtctgcacaatcattgcgagatggggagtggataggcttcccagtcagtgcctctgatttgattggtccagatctggggtgtggacaatttcttataaagctctcaaggtgattctaatatgcatccagggctgagaaccacttcattagtgattattagatcggttctcaaaatacagcctaacattgatggactctgtcgatggcaatatcctggttgtgatatcgtagtatggttttgcaagaggttaccaccagaaacaattgggtaaagggtacgtggaatagactctgtctgtattatctcctagaactgcatgcaattctacagttatttcaaaataaaaaagtttaacttatttgttaatagtctgccagtgaactccattaaacttacttgtgactcttaaaagatgcagacttttgggccccatcacaggtctagcaaatcggaatacctgtgggtatgtcctggaatctacatttttaaacaagctcaccaggtgattttgctgaaacactgatttagctacttacatgtttaggttttgagtaatactgggcacctggacagtcctaggtaagtgagaattaggcaaactggcacactaagttccctgccctattcagtattctgctattcctgctacacttgtcttaaaaaaataggatttcatataccaaggtgttatgatgatactaaggcacactaatgcataaaaataatatataatgaattattcagtcattcaacaatttttttattgagtacctattatgtgccaggtacagttctaagcattgcttttaagaatgagtataagaataacatttgtaagcctatcacctcaggcattctgatagtacgtggatttcttatttaagcttcacaaccaccctgatgtaggttcttttattctcccctctttgcacaagaaaacactgaaacaagctgttttatgtacattgctaaggatctagaagtaaaaactttgaatctgaaatcagatttcgactgtttctttatggtaaaatatacataacataaagtttacctttttaactatttgaagtgtacagttcagtgacattaaataccttcacacactgtgcaaccatcaccaccatcaatctctaaaacttctccatctttccaaacagaaatccagtacctattatacaatatcaggggctgtttttattatacagtatatgacacccccccaccaaagaaacctttaattgtagaactttatacaaaaggtaaagaaaacaatttgggagaaaagcctctcgccagcatttcttcaatcacacaacatattatagaaaagctgctgtgtgtaagatcagccttgatctggctgtatttttattgaatctaaaaaaaagtaattatcagaactattgttataacttaacccatttgtgctgcaattgcttctcatttgtgaaatagacactaataaggcatactaatggaatctttagtgtgagtatttattaaatcactaatgtatgtgaaacacttagaacattgcctggcatttcctcagtccacccacccaatcccacccacacacagtcaaaagttagttcttatttccccgattgtcaattttgtatatatcacttgatgcacatcattttcccacatctttgtcactgattgttagttttatctagttcagtagcaagcacaatatctaacaacctgaatttatttttattgtaatcatttcaaagaaattagagtcaaatgtcctcaactgtatgtctccagtaatttcacttagaaagtttttcaggcactgaattcgttcttgagaatagagtagcattcccctgtctgtaatatttgagcagaaaggacattgcttccatgaagccttgtttctgttcttcttctgtttgttagaaaatactctgttgatggcaaattcgtgagcaatctaaatatataattaattagaagaacaaattgaaattgaccaaatctctcagagctttgaacaaaaggactcttcaaatggtcaaaacaattacttagaatttaagcgttcattgaaatgcgagacagtgtgcggtagagatacaaaagagaaaccaggctcccatgatattgtaaatgctaaccctgctccttaagcaaacaaaagtctctttctattgtcagtagctgtcttctaggacaaatagtttggtattttataaaagggagaaaaacttatcaaaaacattccatgaaatgtacctcttttgaaaaattactccttgaatttgagttaaagaattctttagaagccaaactgctgagatgatttatctgcacaaaagaaaactactgttcaagaagcatatttgaagaatatgtcattgcaaatcaaagattcttttaaaaataagtctcaaaaggaagagagggagagagggagaaagagaaagagagagaaatatataattaaagtcataggtaatttaagtttggaaatgaacattcattcactactttgttatattgtcatatggtggtaaacaaaacaaagcaataattttgtctgattttcttcgctaagaaatggaaccatttatgaagcttagcaactgatgcgaattttgctttgatggtaattatgtaacagagtggcaggggtttcacttccagataaagatggacaatgaaggtcaatttctatcctgtcgttttgaatattcagtgccagcacaatttaattgggatcaggtaattgctcagaaggctacactgagcccactatcatccctcagtgtcgctcctgcacacctacttatcctgatgttgtttgtcaaaaactgtcacaaggaatgtgtctcactgagaaaaataacctgtttgtcattgctcagagcttcaagaccatactctaaagtgataagaaaaagttttttgttttttttttttttgagcaaaactgtcttgtctctgaactgattaaattggtccatcatggtaatataagggaacattttaatgaaataaattatttatgggagttcagtgatatttgctctcctagctcttgtgcgatagtatcaagtgtacctcttactctcttttggcattgaaggatattatattagtcttgaatatcttttgcaaaatattataaattatgcaagtaataaatgtaaacattgttttaagaactagagtattgtgaataaattgctaaaaatttatcttgtgatttttctcattggcattagagagaagcagaaatttagaaactaattcgtatataatgtgtgtttgtataataaaaggaaactatgtgctcaggaacagtctgatgtcctcagaatgaaaatactcatagtaacagtaacatacatatatgtaatgtgatttataaggattgcaacattaaatgtttgtttgaattggcactagtaaattttaattaccacctatgacttctgacttctgtctattgatacgaggactaaaaggatagttaatgttattattagtattaataaaagtaatgtaagtttagtataagatttctaatctgttcaccatagacaatgaaccaaagaggaactactttgtgctacatttttatctgtctcagggcataggttcaagacaagacaatttctagttttgtaaaatgaaagcagtgatacagaagacacctatttcattccctcagattaatagtatataatactatatattatatactttacacaaatgttagaataaaaatgaagaaatatttaaaatgataggctcactactatatttaatagcattaatcctcaaaggcagtatttaatacattaatttcttaatatgcgtgcattgtgaatacatgagaaaaaggaaaaaaattctttaaatgagttcctgcaattaatatcatcaaatgatgtaaattacagttttaaaacaaaaaagcccttaaagcgtgctatgaataaagtaggaaacaaattaaattttaatctttattattattaaaataatctttgcattgttctttttctacttgaagtttcagtggttttcattgatagtcataaactggagagaaacttgtgcccacctatgatactccagaggcacaagacgccaaggcttactgtcttccagcattgcttccattttatgtctggaggagataagatatgggtgtagctgtgaaggagaattggatatgcagacgattgctttatctttatctctgaatgatggacacccaagcagttttaagggagggcctttactggctctcatttgccttgtttttattaggagacagcctctctgggttgcaataggttgcaagttataaaattcaaatgactctggatgagatgctacctttcttaacttaatttgaattgttcatatcaggagtcctttttaaggatcagtcaataggggaacaataagacagtctatgaatcttcagcatgggttacagctggaggacataaaaaaggaggttggaagcactggacacactttaaaaaaatcttgtctgggttgaaaaatgcattttctttgtctaagtcacatgttgtattccatatttagctgtagtgttgaaataataggaaaaacactgtgtcttggcaggtaggcccctgctctgagctggacccaatggtcagagcacatttttgtttaacattcagagggctgtcaagatgaggaagtccattttatgggttttctaccatgaatttgctcttcctggccaactccgctcatgcctgtgaaaagaactcaccagcgtactggagaatgagatactaaactaggacaagagccgctgctgaaaagctcatggctgatatcaactggaaactaattcaaatgactcttacaataaaccagttctccactcactcaaagtgacagtgaagtgaaggaaatcatcctttgtgtttcctttgtttcatgcaatagtttgtgtggttaattcattatagtctttgttctcaagcgaaataaaacagtcaggtgaaagaagagttttcttccttgactttaaagtggatttccttttataacaggtaaaactcagctttcaattgtttttagttctgaagttaatagcagtagttctaggctttttttttttttttttttaaatcaatggcttgttaattgtcatcccagttatttacatgtgactatagagactgcattctcccagctgccaggccgccagggctttgccactggtataatttataacacgactaattaaaatgaatttgcttgcaataaggttctgtgtgctatttgtgggagaggagttattaaaattttcagtacagtaatagtaaacttgaatgcaaagtaataataatcatacatttttaattacatgtttaatacccatttggctaatgtagaactattctgaaaattacttgggatcagcacaatgtctttttgtgcttagtagtatccaaagacatccttctgaatgggcttagcaatatgcactgtcatcaagatacagctgtttgatgacagacacacagtgtgttcctatgatactttgcacaagatcagctatgacaaatacaagttcattttgcttattgcaggcaaataatgtcctttgcaggaacttggatggagccagaggccattattctaagtgaaatacctcaggagtggaaaaccaaataccatatgttctcacttacaagtgggaactaagctatgggtacacaaacgcatatagagtaatggactctggcgactcatactacatattgagtacaatgtacactacttgggtgatgggtgcactaaaatctcagaatttgccactgtgtcattcatccatgtgaaaccagaaaccacctgtacctcaaaagctgtcgaactaaaaaaatataaatttttaaaaatgattcccggctgggcgcggtggctcacgactgtaatcccagcactttgggaggccgaggtggacggatcatggggtcaagagattgagaccatcctggccaacatggtgaaaccccgtctctactaaaatacaaaaattagccgggcatggtggcacacacctgtaatcccagctactcgggaggctgaggcaggagaattgcttgaacccaggaggcggaggttgcagtgagccaatatcatgcctttgcactccagcctgggagacagagtgagactccgtctcaaaaaaaaaaaaaaaatatatatatatatatatatagatagatagatagatagatagatatttttatatatatatccaaatatatatatatttatatatccaaatatatatatatttatatgtccaaatatatatatatttatatatccaaatatatatatatatttatatatatatgagatttccattttccaccaactttcttttgaaaaatttcaagcaagactagtacaaagaacatccatatgtcctccacccaaatttatcaatttcttacatttgctcacttgctcactctccctccatcccctttctcattatatatattatatattaatatataatatataaatataaagtatatattaatatataatatataatatatgatataaacaaattacataatatataattataatgtataaattatataatgtattataattatataaatataaattatataatgtgttatatataatttttatatatctggctgaatcacttgaaagttatttgcaagatgtcatgatactttacttctaaatgcttcatcatatatcttctaagggcaaaatattctcttacatagtcacaacataattatcccatccaggaaatttatggtactgttatctaatacacagtccgtattcacattctttacagttgttcctcactctccactttgctccaggatttaatcaagagccatacaatacattccgatgacatgtccatttgatctttaatctaaaaaagagttttcagcctttgttgatatttatattctttatgttcttcaaggattgctcccagttgtaaatagtttctgatgtttgtttgtttgcttgttttctaagtcaactcctgaagaagcatgtatttatacacaactaatcttgaatgaagaatggtcgttgttaaggacttgatattagcaaactgtattcccaagctctttgctattttacccataatactgcaagacattttctccgactcatttggaaggtgtttccatttgtatctggcaagctattctcttagttcttaataataccgtcattgaagatcttctagtatgtagaaaagtataaagtgctattagtattccaaaggaaagtataatctaaatggtgaaaggaaatagaaacatgggcaaaatcaatacagctgaataaagtttaaagatgcagaatatgttacaaggcaggttagcattaattgctaaccaagtgatatagaacataagtctatattatctgtaatttacatagctattgattttcataaggataaggcaataccacttgtctaaaatggaaaagaattatgttgatgttagaaataatcatttacataagcgtacatgtgatttcaaggacaataagctaatgatggctcataaatatgcatatttttcattgatcaaaactgcgcagtaaacttctggtatctgatcttgtaaattgttacacaacattaaggtaattaagaagagaattaaggcaaataagactgcctttaaaacatacctttgcatggttcttcatcttgaattcgataatcacaaatgtgacaaatctctgtgctaagtttattcagtttaacagttgtaaattaaaaaaaaaatcctccattatgtttatcaagtcttccaagcttttattcaccatttttaaattatgtatttatttgtacaccatttaaaaaaattatatttttctacttcatgaccccagccaaatagcatacaatgtttaactccttacaaatcatacttatttctttatagtatattgacaagttttgtgatagatcttcttttagaattcaataacctaagaattaaaaactattttagagttagtgattctaacttcatgaatcttctgattaataagcttcctcaaatgcattttaagcagaaagaaaattgctgaatataaactaaaactgctcagagaaatgctttttattatgcactttcaaatgaaagtgaatgcacaatgagcccagtcctctctttagtgttcagtacacagctcagggctgtgtattaacccagtgccctctcctttctagctatgcaattagtattgattgactgatagatagcacacttgatgttggtggtcactgaggtacgtacacctctgtacaatgcccgccaggccattgtgtgtgcctggtacgttactgaggaataacaaaacaactggtgagtttttaatcaactgtacatggaatacaaaatgtggtctgtcttcctgtgtctagctacttttacttcgcggttttattttcccagtgatgtgtacactttagatttttttcccagacataagagaaaatgtatattgtattctacttgctgttttaagctttctcttaaaaagtctatacattatatttgtgttatttaacaggcccccatacatagcacttggtatgtttaaaacacctcatttgatgctttataaatatgagttaatttgaaggaaatcatgagcaaaatctcatgcacatttcttttgtgtatgaaatttagtggaggatgtttttgtctacatatcagcttgcaggacttctgctcaggccgcatcatcttttataatacacatgaggtccaatatggcctccttccaatctatctgctgggacaggaaaaggaagctctaaatatctcagcagtaactcccccattccctcattgccccagcccctagaaaccactaatctgttttctgtctataactttgcccattccatatatttcatagaaatgcagtcataccatatgtgaccttttgtgcctgacttctttcacattgatgttttcaagattcagccacattgtaggaattattttatttctttttattactgtataatattccattatattccacattttatttatccatttaccaattgataaacatgtggggttgtttctgctttggtgctattatgaataatgctgctatgaaaattcatgtacatgtttttgtatggatatgttttcaatgttcttggttatatacctacaagtggaattgatgagtcatatttttgagggactgccaaacagttttttttttttttttttttttttttttttttttgtgatggagtctcactctgttgcccaggctggagtgtagtggtgcaatctcgactcactgcaacttctgcctcccgggttccagcgattctcctgcctcagcctcccgagtagctggaattataggcgcccgccaccatgcctggctaattttttttttttttttttttttttgagatggagccttgctctgtcatccaggctggagtgcagtggcgtgatctcggctcactgcaacctgcacctcccgggttcaaccaattctccttcctcagcctcctgagtaactgggattagaggcacgggccaccatgcccagctaatttttgtatttttagtagagtcggcgtttcaccatgttgatcaggctggtctcgaactcctgacctcgtgatccgcctgtcttggcctcccaaagtgctgggattacaggcgtgagacaccatgcctggccgccaaacagtttttcaaagtggctggacattttaccttcccaataaatatgctttcatatttgaactgactgataaaatttcaacatacaaagcatataggaatttttacttcaagttacatctgaaatggttggctatatttaaaagtagatattctgtttttaacaataaaacataatatcttgcttttctatatgactgacattattatgctagatgacaactacataattattggcaaagcacaatttgtagaattacaggaataaaactgatggaagcatgtagcatttcattcttccaaagcccagaatggaaccaaatagcagattagttgcaatattgaggttgaaactcaagttcggtgcatgtctatttcctcctcctttcttccattcccatatcaaaataaaagaaaacaaacaaaatgctttttttttaataacttgtttttcagtgtaaggaaaaaatggtacagtgtgaaagctaaagtacatactagctgagaaaacctgacatgagactcattttttaaagtataaacctgtatagtagataacatttcttgaatgctcgctatgtgccagacacaatcataagctctttcaaggattaacaacacaaggctatgaggttggtattattgttctccatattgtacagatgaggaaataaaggcacatagaggcttagtgtcagagctaataaatgacagaggtggagttcaaacctaggcaggttagctccagaatctgtgttttagctgccattctgtgctgctaaagagcgtctgttaccaccattatcctactagcaactttaaatgcattcatgtaatcattggaaacttcacatgctatagtaatttttatgcagaatttcagtaaaatatctctaacatacaacttccagattcaaatttgcagatctaccattgttatctaaagggtgttttgattgatttgtatcttattttgtgggacagcaggattcagtgagaatttccacagggtggaatcagtattgagtgccctatggaagtgttaactccattccaatatccatagttcaagcaaattgttgtttcctgtgaatgttcttcaggctgttactatatgtgcctgtcatgtcattccatgaaaaaataatgctggccttgtagtttctacaaactttactactatgagtgtcacctctgagtttgaaatatttgaagcaggagactctataagttttcagagataaaattgtgtccagaaaaatatgtccccctttgattgacgtgggtgagcatgactgtgtatcatagattatagtattccgttcactcagtttcctttcaacaatgtctcatatatttcaaaggaaaatgttgccatgtcactttagatttaaaaggttgcagtgaatgatgttttcttaaataaaagggaggaaaaagtaattgtcatgttttgtagatttaagccctgtcattgccaaaatatctgcacgtgaaatcagtagatagaatttttggtagggcttctctgttgtctgaattcccattactggaaggaaagtatgagaaaaataaaatgaatgtctcatttttcacatgttcttcagtagtttggggtcactgtttggaaaatcttaagaaactgtgatggcttgaataagtagtagagagtcaatcactttaacctgtgctatttatctattttcttctaccatcaattcccactatatctttaagagaaaaatgcagcacagaatttctgacatagaccatgttgaagtaccatttttccccatccttgaaatctcaactcttccttaaaaagtgtcaagaaccaggtatggtggctgtgttagtttgttctcacactgctaataaagacatacccaagactgggtaatttataatggaaagagctttaattgactcacagttccacgtgcctggggaggcctcacaatcgtggctgaaggcaaggaggagcaagaggacgtcttacatggcagcaggcaagagagagtatgtgcaggggaactcccctttataaaaccatcagatctcatgagacttactcactatcacaagaacagcatgggagagacccgcctccatgattcagttgcctcccaccaggtccctcccacaacacaggggaattatgggagctacgattcgagatttgggtggagacacacccaaaccgtattagtggcgcacacctgtactcgggagactgaggcaggaggatccattgagtccaggagctcgaggctgtagtgagccctgattgcaccactgcactctagcctgggtgacattgtgagaccctgtttcttaaaaaaaaaaaaaaaagtcaaatagattcattctcaattttattatgtaagtattaggatgagatatttatagtatgatagaatctgaccaaagagtatctgttcagccataaagggagtatgtaataatattgtacgttagtgataatatcaccatcaaaaattatttctcagttttcctttgagtgtacatctgtaaatgtgtatgtttgtgtgcgtggcaagatttgcagatgccaaagtcctataagtgtccttcttcccatctttttatttgaacttctgagggtctgcggtgaaaggcaataaaagcccttaacttcattactgtactttatactaaattcaaacaatattgctttatttattttaattcacgtttagatttgcattatattttgtacaagacaatgggtagaacctaatttccagttttcactggagcagagggtggaaaggaatcagcagtaaaagtgagtcctgattagtttcccctcctcttgctttagcctttgataagtaagcgccttctactttcatttccaacagcgtttaccatagaaataatacagtgctcttctccatttgctgtggagccctgtggttcattgttattatttcctcaggaatccctttaaaggtatcctgcaataatgctataatctcagagtagctttaccccttgccacctatataatgatcatttctagttaaaaaaaaatcatgtggaagagagttgataatattacaaggagaagacaattttcctgctcaaaatgtgagaatttgaaataatagatgtggagagaaatttaagtaaatatacaattaactcttaacctacaacttcactgaaattctgaggaaatattccaaggctgcataaagtgaatgaagagtttcctaccaaatatttctccctcagtacctaagtaattgtttcttttctgaatcagttgcatacacagaagtagaggtggcactaaagataaagatgcttcgaccttgttctcaccactttttttcctgttggtttccagcagtgtcatgggctttcattacttattcaagaactggctgtgctgaacttccattgctactctgcctgtacccacatatttctgtagcttggaaatttgtctttgagtttatatagtgaggatcttttatctgtcactgtgcggtagctttagcataactgcatttagatttagagattaaggcttataacttaattatgaatccaactacatacgaaagagtttaatttaaatttaatattttgattcagcacagctcaactcatgtgttcttgttaaattgtctctcattgaatttttccttgtcattaccttggacatcagtgcttttccagaattgcaggctgtagcaaaataacaacgcagacttgacttctgtctgagctaatcttcagaaagggcacaggctaatggtgacgtagacatctttacagtttgtctgtaaatgtgttgggtgggtgtgtatgtgtgtgtgtgtgtgttcatgtgcatacacagacatatacacatgaatgtgtcttgctatgctaaggcctgaacaaataaaaataatgtcaaataaatatatttacaaagcctaatctgaaatgataaagtagatgaaatttgagaaggaacatttgtggtctcccaattttatgcctcatgcacatgtaactctatatacatatatagagggaacactattcacacaacacatacaaatatacatgtaacacttataacagtgtagttatgtaagtgtttagatatgagaaactactatttataggaatccttcagcagtatctttcttgcctcctcttcctgctcttcctcctacttctcttcctccttcctctccgccacccccctccccacccccgcataaaaagggaatggtttagtcaggtaaataactaaaaattgttatttttttaaataggctttataaaggtgattttatcccagaaagaagtgtacttacacggctatgggggactgatctatgcatataaagcttttcattatcagtgggaaatttccatttgtaattatgtccatcacaacatcagcagcaagagcatatataatgtttcaaaggttagttaaggagtgtttgtgcattttgtatataattagacaaagaagtaattaatatagacttggataacttgcttgcataaacaacattaaagcaacaataatgaacactttaaaatatacacgaatatcatgttaacgtatcaattgccctacttctacctttccctagttcaaatcctaatttaaataatatttcagtgaatataatttttatacgtaaaatttcttcaatatacaaagaattgtttgttataaatttcagtgtcagaaactttaaactagaaatgcattcccatcgaaatagcgtagttaaaccttctctaccaagtactagtgagatgtttgtgtcgagaagacacagaggctgtgttggggtctgtctgcaaactaacattacacagggtagcttcatttggatgtatttttaaattagatccccactgatggtttcctttgaaataaaatgtttctcttattttaaaatgcttgaaaatcaacattataattgatggttaaatttccagtttaagcatacttttccttgttgtactacacatgaagtactgtgctttggcaatgaaaataatagaaaatgtgccataaaagtaattgaaacctaaacagaattgctgagtgggatttttgtttcatgtcttgagcatgttgcttaaggaaagcagatctaattagggaaagacaggaggcagatacaaagactttggtgggaattgtgagcagagaattggggcattttcaagggctatgagcttgagagagtcgttatatccgatttcactttccatttcctagttgttacttttgctacacctacacttattaatcatcattggggttgtttgggagcttacaagtgagttgaagagctgggtaaagaatagaaatttcctctgagttattagaggagcaaagaaggaaaaaaacaaaagatgggagatgggagaatggtgtgcttttgtgtgttaatgtgcctggggttgaagtagttacttgtgagaagcaaaaggggacaatagatcatatgctattgctcatccttttgtggaagaaacccatcaggtatccattcactcactatttactgaacagaacacattgtaagagcacagtgtattaggcgaagggaggtcactggtgaacaagagcttcctggagctttcagtctactggtatcacaagcatagaccaaagaagcacatatcataagtgctaaaagaggtagagcacagaatgagacctcatgataagggcacttattataatagtcctagatctgagggaacacttctctgagaaaataatgtttgagctgacacctgaatgctgaatgggagttaatttatgtgccgagagatgggaatagttcctgacagaggaattagcaaatattaagctgaggagtttgtgttgtattttataaatataaattaggacctactcttccttttgtctttccttattagtgtgataaaatcatcctcctagttacaaagccaaggactctgacagtaatttttgaccctactttctctgccaccttgcacccccgttacctttactctaataacatccttttgctcaataatttttttctctttctatctctaaatctcttctcctacactcaaccctcaatttaattcaggtctgagccacgtattgctgaactcacagctttctcacttccgctagaattgactttcagaagcatttgatcatgacattttcagtgtaaacctattcagtgacacagccctgcctgtagaataagacgcgtcagctttacatgttctcttgatatgatctggacccctcatctcctaccactttccctgtattcttgccacatgcacctccttgttctcttgaatatagcaggcacttagggccctgagtctctaaacatgccagcgtgccctcccttccctaatcatcagtcacaatttgtatcctctagcctgttgctttccagttatcatactcagaattaattttgcctccttccttgtaatcgtattacttttacctgcctctcccccttttcagcatttactttataactctgtcctatattgtagtgtcataaatcattgctctaactagagtttaagttcagtgaggtccaagaatttgtcttatttatttttatattttatgcttttatcattttccacagttggaaataaaaatttatagtcagacttttagcagcttcctggaactgaggcaatgcaggctggggcagagaagaaagttaaaggatacttggagaaacctgaagaaagtaatttagactattttatggtttatagtctctttttgatcagctgtgggtgccctcacaatattggttgttgagaatgatttgacagaagttatcaaaataaggagattcaaacttagtctatatgagaccaaatactcacattttaaacaatagacatttttagtaatgacatttaagctcctagatagctggatacagagccaatgttattgcatataattcaccaattcaacaaatatcagttgatgactcaccgggatcaggtacagttaaaacttgctctccactttggtcatacttgctttaattcattgctaattgagtcttaaggctcaagcagtgggtcttataaattcactggtctttattgttgaatccttctctaattttggcagtaatcacgcatgtcaatcttgcaatgaggagctatcggattttcaacctttacattcaagctcttgttttttcctgaactggctctttgtacaaataaaaacacactggcaaaataataaatgagaatccttttggacttttcagccaacaataaaatattttttataaaaatggaagtgcacaaaatggcagccatctgttgtttaaaaacaacagaactgtatttaagtcaattattgtgtaaggtctgtgccttgaaagcaagggcaaaatggtttatgttcatctcaatgggagaagattttgtgtgcttctttgtcattgtctatgttgatgtgagactggataactattactaactgaaaatagttaatcatatttaatcatggatgaggttgattgaaaaaatgtcatttttatttatgaactcacatggacatgtctaattggacaattctgattttctctctttattttgagtagctttaaatccagacatactagcctagcaaatccataaagaatctgtcatcatggaaattgctaacagagcctgaactttttcctctttccccccactcaaagtttgaaacataggcagattaatagagataacaattagaataatggtaagaagtttttttttcaaatgaagtacatcctaatgagagttaggtttttgctaaaaagtgtttttcttgatattcaataaaattgatataaataaattgtattgttaattttaatctttttttacttggtaaaaatgctttctatgtcagtcatctatattatgccaattcttgcttcattttcaatgtttattagagggattttataaattaatcttgttttcatttatactattgtataaatagttttcatttatactattgtataaataatagtattcatttatacgatatatattgtataaatagttttcttttatactattgcattttatgagtgaaatatacaatatatattctttggaagacatatcaatatcactattgcaacagatatttttccagaggttaacaagctatggctcacttacacatttcgcttaatctacattgtagtttgaaaacacacagatgtgaacatattaccaatattttgccaatataagagtccacatttctgtcttcttttataaagtatatgaggcaaacacaacatatccagactaggatgtagactgtaatttcaaaatatctaaaataggggagtgccgggggaaaatacgtcattttgaaaagatggctgtgttctctgtgtttatagttgaaactataaacctatttctacctggatgaggggtttataagggcaacattactaattttgagtctccacctctacaatgttagctccatgagcgcaggtattgggtacagctgaatcctccaatctaccgcagtccctgcctggcacataagtgatcaacaaatattttgttaaatgaataaatgaacaccctgtctctttttctttcacctaatcctggtatgtctttgctccaatcctctgccacccagggctactattttattagttgatgccagaaaactctccaatgagaatgtcccatgttcttcactgtcataccttttttagactctttgctatcatgccttaactaccaacagcaaagaagccaaaaattcagacactgagatgtggttcagccagaaatatttacaaatgtagaagtgagaatactaagccaaataacatttctcataataaaatgtagactgtaggataatattaaaacttcaaattgtacaggagagataatttgggggaaagagtgtagcactaagccagtgcttctcaaacttaaaggttcacatgaatcacttgggggtctttttaaaatgcaaatttgtatttggtagatctagaatggatcctgagaatttgcatttataagctctcagatgatgctgatgctgctgatatatggaccacactttgagtacctcgatattaagcaactgtaaactatttgtttgaaaacagccatgatttgaagctatacatgataaaatcgatgggcatttatcaacctgctgaaaaaacttagatgtctacaaatgtccaaatgggagagatacttggagtaagaactttgtagtggtagaatggcagggacctgagatatctgttgcttcaatttacaaactgggattctggaccccaaagatactcaatgacttacataagaacccacagctatgttgatgctgcacccaattggaaccaacgtttatttattcccagacccatgctctttaaaagagatcatgcacatggacataaagaaggaaacaataaacatcaggacctatttgagaggggagggagggaggagaatgaggatcaataaactgcctataggctactatacatattacctaggtgatgaaataacctgtacacccaactcccgtgacacgcaatttaaccatataacaaacctgcccatgtacgccctgaacctaaaataaaagttggagtgaaaaaataataaaaaaataaaacagatcatgctgcctcttggctattgaagttatagtagaattccttcaataaaacacttaggaagttgttgtactataaaatatacttaatttcacttaatattgagtgcttcactaaagtcagtcaaaatgaaaggaagtaatgcattcgcttctcatgagttgcatttcttgtgggtaacatatattaattttattataatttatcttcattagctattgaaaataatgctaaagacatttagaatgccttttagcgggcattactgaatattagatgatgaacagctttgttggaatagtttgtttagttcctaggagaaagtttgatttgacgactaagtaaaaaatttaggggaaaaaagcaacaaaaaagtacccaaaatcaatatcactacgtttgctgacgaagggtgtatttttagctacactgattttttaatttaaaaaaaatctacacggatccccctcaactccaatgtcaagtaagctcaactgacattatcgaaaccatcttcctttttattatcaaaaccatcttcctttttactgtgcatgtgtgtatgtaagtgcaagtgttacaaattcttaaaagaagataaaagaatgatttttcctcattatggtgtaaaacaaaattaaaaattgaaattatctaatctgcataaattagacactttatattacattggcagttttatcatatttgaaacattttgttggtctcaagatttaattagattatgtcaccaaatcagagaccacaaatatccatgggagcttaatagaactttttggattttcatgggatgaaaacagtattttcatgaggcgcagaattcatcatcagcttctcacctccattctaccctcagccttctatttccctgacccacattagtgttatgagagcaacaaatggacgtttcttccaacacaggttgtaagaaagtgctgctatcatgtgaggagtataaagggaaaatcaggcagcataatagctgagctaattaggctcagaccattaaagatcttataacggttatattattgttgttgttaatatcacctgagtattgcctcacagattacagaatgcctcctcatacattattttatatcacagattataaaaggctagcattataaataataatcatattaaagagtgttattttaatattacatgagacattgattttcagtgatgccatgtgtttccatagtgactatgataattaattgctataaaatcacaaacagtatttccttttgagagttgacaacagatgctggcattttaacaaagagtatattaaataatccacagcatgcccagaaaattgaaatgattaccatgaattaaaaaaacccacaaaactcataacaatgcttggtgatacctagaatattctggttatctgtaagttttcaagaaggccaagcaggcctctgtcactgttctttacctgccaatcacaccgataacttctatgagacatttctgtctttgagctaatcatcctctttttaacagcatacgcattccaacaggcatggaaactataatgtattaagccattttatctgcaattctcacttgttgtgatttagtttaatctgttttctttggttccaagtataagccaaaatcaggacacagagaaggggcatcttgttaataaggaaagaggatgaaatggcagaaaagtagtgactccccaggtgcaaataggggaatatcaagatgtgtcaagaaatgaataggcagcccaaaagccagatttgtatggaaccttttctgcctttgtgcctgaataataaccataattcctaaataaatcatatgactacagttgaacagtggtaacttttgtgtgtagaatgctgaacttctaaattatttttatactcttcgtcaaatgcactttaaaattaaatagttgttataatatagtatgccagcaaatcccagattgtcttgcagagtgactcagaactcttgaaaggtcactactttcgaacttcaacatccttaaaatcacttgaaaactgactgctgctggtgtatgtgacttgaaaatatattttgttgagaatatacaatgtttcttgttctgtgtcaattggctacccacattcaaacatttggagacctcccataagcatccatttttcttttaaaaaactgaagatctagcagtattgggtccacgttctgttccagctaagtatcactacctcctttggaagggatttttcctttccagtctcccaggtcttggtaaacctctatcttccttgaatacaatagatctggcacctattggcattcagtgtagaagaaatggcattcctataatttgatcaatgcactgattgattggttgttttagaaagagctgaatgaaacatttcagtttcgttgttgatccatatctatctgtctgtctgtctgtctgtctgtctatctatctatctatctatctatctatctatctatctatctatgtacctacctacctacctacctatataggtaggggaggagagagagagaggcggaacataaatcatggtgtaagttacacttttaaaaaatggaccaatttaccattgtacaattgtaaagactgcgttgaagcaattttaaggataattcagaacatatttttctaagtaaagttctatgtcttatgagagtagaaagcaatgaagaaatatacatacattttgcgtaacctagtggcccttaatgtataaatattgcatgtttaagtgaagagtcatccatcaagaatctaatctataccagaagtatacacttcctcttttatactttgtactaaagatataaatatgacgtgttccctagttctctatccattacagagtctggtggataaaaattaaaaatataatcttaattaaaatggaaggggatgaaggctataagacagtcaggtacacacatactatatggaaaaactgggcagaagtaattctgtctcatatagtctgggaaggtcccatagaagtggtcatttagctgattcttggaaaaataagtagtaatttatctagcaaaggatataggaaaaagcattataatgagaggaaatggcataagcaaagaccttgacatgtgaaagttgattttatatctataaagatctctgactgaggaatattgttggaaatgggggatagtgaaggcagatatatgtggaagataaaatgggttgatcgtgacattttttttttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgatcgtgacattttaaagagctttcttttccttttcaaagagcttgggcattttattatagacaataggaagtagaaagtggttttacgggaggctatgaaatgatccaaaaggcaactctggctgtagagcagagtcctgattagaggagggaacaaatgaagtcagggagtttattaggaggctttaggaattggccagcgggagaggctgtgagtaagaacgaaagtgattggcaatgggaaggaatcagaagataaataactgaaagatattactgatgaagaaactttccggattggatgtgggcactcagaggatgagatgagttggaggtcggtagtctgggaaaaagtgaagaaatcatgccaaaatcaaaatcataatgtctagaaagggaagtattttccgcagcatggataacagtccctgggtaatgtataaattctctgtcataaaatactatctcccacaaatgttaattaagtatttgaaccaaaagttatttggcattaattgtgatcactgctattattgttattgttgatattatgagaagtagtatttagaaaatgtgagcaatctcatgctgtatatgcacactaggaataatgctaaaatagaaaccaaactaaacaaaaataagtaagaacaaaactccgatttaattcaagaaacatgcagattcatttttgcttggattttctttgttattctaaagaatcatgaaccaatttttttttaagtcctaactattgctatcctggagaacacttcaactacatagagtaaccatttacagaatacagttgaagtctacagctgctctggaggataaatgcctatttcttttaaacgttggctgaggccctctcgaattatatacctcacatgtgctgtatttacatcagaccaccccaaacatgctttccaaattaggttaaaatctgtgtcaccattttcatgtaacatagaaacttaattttatttatagagattttattcattttatcacatagttactatttgccttcctggtttatgattccagtttctttggaattccacttttatgtgactaagtaccctatgtgtttaactctactagatatcccatcactaaaatacaaccataccttgggattattcagttctttggtaccccactatacctcccattaggtgagtttctaatgcaagatactgaccatagtatgatgcattctgaaattgccttggctattcatacacaggtatatgtcttatatttgaaatgtaatagcattttgtatgttataagcatgctaatttgggggcctatttattgtaggagtagcaaaaaataagattgtacttttgaagactatatgtggatacatagtatcatgaatggctgctctattttgtcaaattcagaattaaaataagatttaaataaaaatagaggccttttcagtttatggattttcttattatcttaaaaaaaaaaaacatgatagtgaggtttccagctgagaggaatggttggaaaaacattttgttccagttagttaattcttccctacatgtgctctattcatcgtatccattttaaaagcaaatgaaccatctctatctcctcttgcatttgtggcaaactcttgctgtgccaatttcagattacatgcatcttaggaagaataagatgttctaatcttgattataattttaagttaaaagaataaaattagttcaatactaagacattgatacgttgcagtagtcagactgtcattacctcttttgacaaaatagaaaaacatgtctatacacaggataataagttcctgcattaaaatgcataatactataaatgctactagatttcaacgcaatcaagaaatcagtttatggaagctgaaatttgttaataaatatgctgctacttgagagtttaaccattttgcaaataattatagcaaacttccaacgaaattattttcattatgaatggagatactttccaaatgaggatataagaatagataataaacacatgaaaagatgctcagcaccattcttcatcagggaaatgtaaattaaaaccacaatgaaaaactattatacacatgttagaaaggctaaaatctgaaagactggtcataccaagtgttgtaaggatatggagcaagtagaacacataagcattgctgttggaaatgaaaaatagcataatcacattagaaaatgcttgatagttttttaataaagtttgatagtttttaaaaatataggtcatggacaaatagatgtatgctttacagatgctttatacatctatttacccataacccatagccaacattgtaatcccagatgtgtatcccagagaaataaaaatgtatgtcaacacaaaagacttgttagtgaatattcatggcagctatattcataatattccccaactcgaaatgaataaaacgtgcatcaataggtgaatggatagtggtccaaccatacaacggaacacaatttagcaataaaaagcaacaaactacagatatacataagactatggatgaatttcaaaccattctcttgaacaaaaaggccagacatagaagtacatacacattaatatgaagaccaagctctggtgacagaaaacagaccagtcatcgtctgctcatgggggaatcttctgagataaggggaatattttataccttgtagcttagaagaaatgttatagagccccaaacctgaacatggagaagtttaattttgaattatgagacaatctaagcattcaggcttcagagattttttttaaaaaggcgggcgggggggtggggggaggccacagtgtgggaacattggaaagttaggactagaagtctcttgtgaaaatagaaacaggaatgaatggaaaagcattcattcataccgtcaacaaccgaatagttgttagagtacaaatgatgagccagactgttccaggcattgagggtacagatgaagtacctggcctcatcgaacgtacacttacttagttgctgagacatacagtacacaatgtcaagtaaacatgatgaacacagatcagtaatataaaggaaataagagcacccagacaggaaggatggcacagatccatttttagagaaaccctggggaagggtgtaccaggtagaagaaagagtgaatgcaaaagacagagggtgacagagggtgacagagagctcactctgcttcagatttgtatgataagtgtggaaagcctacagaggcctgtttctgttggagcttgaaggctaccatatggtgtttgcattttaaccaaaataaaatggaaagctattgtggagtttcaagttcgagagttgcattatttatctgtgccttaaaaagatctcttttgtttaatgtgtggattgagggagggagagaggaagaagaagtagcaaataagctcgtaaagtctaataaaaagaaagcagggaggcaagttagggagttattgcaatgtgctggatagcaaatcagggtatcttgactcatcgaggtggcagtagggataaagggaagtggacagtttcaaaatacattttggaggtagacgtggaaggacttactaacaaataagatgtggaggaatgagtgaaacagacaaatcgaggagatccatgggtcttgcctgagattcttgccatttacaaagatggcaaggtctgggtgtataaggcagggatcgggtgaagagagactgtttacaaaggtgcagaaagtgtataaggagaacagcagtgatagtgatgtactcccaggcaagtaccaatgaggggtcattactatccttagaaaataagtagcaaggaaaatgaaccattagggtacttgtacggagaagccttctcctaggagatgaggtcttcagtagaggaacgcagcaagcccacagaaacctgggagaggagcctttgttcttatagctggggaacattctcattgaccaaacccaaccagaacctggagagacagggtgaatgaggggtggtgggaaatggaggatgagggggctggagtacttagagcaaatgagagtaaaactataagggcaaagcaagagacctggcacaatgcccatattctgaattctgtataatttaaaagttcagtaaacttttcctaacaatctaaattacagccaacaacatacaaattttgcaacaacatagaaacttttgttgccaagaagactaatttggaaggctttgctagttctatattagtaatgtgttattttttgaatacctagtagaggaagccagtcccctgaaaagtgtccttgtaagtagtcattatttagttaagaaataacccaccaggaaaaaaggaaagagaaattatgagatgcacaaaacctgaagacaactttagtgttatagaagatcttgagagtactagacagatggaagtggagaatgcatccgtttctttaccattaagaccttgcctaggtgtttttgacattttgagctgagataagagagtcgggttttattccatatgcttaaagtctttactaggtttgtcagtataacttaatgtttttagttaccacatgtcattctgttactacattttgctagaattgcctaacataaacagtatccttatgtttcataatacaagctattcaagggtcatattggctaatacaaactgtttagaaagtttgttttgccagaagtcactattgtcaaagcactgattttaatttttggtgatacccccatttaaaacagatatttaatgcttgcccagtatttgttgctcaatgatactttattgtctgttgctatgcactgattgattactgacagacagtaagtgcattggaagaaaccatgatttaaattgtgtgtgtgtgtgtgtatgtatgtgaatgtataaattattcagtgaagcaatagaatctgcatttattcagaaacaaagaacattcattgattccacaaagatttattgagtgactactatgtaccaggcactcttttagggacgtgtgctacgtcagtgaacaaaagagacctagattctcgtgcttgtagatataatattctagtaaggaaacacagacaacaaataatacatataataaaaataaatcatagtatgttagaaggtgatatatgctaagaaaaaaatacaacatgcacaaaatgaagcaatattcatcaaggtcatgaagcaacattatctgcactctaatctgatctccttgaattcataatggaagctgttgccgttttcatatacatcaattcttttttccctttcattttgtgataattgtacatatgtatggggtacagagtgatattttgatacacatataaaatgtgtaatgaccaagtcagtgtcatccatcaccttgagtatttatcacttctttgtgttatgaacattcaaaatattctcttctagctttttgaaaatatacattcaattatttgtaatcatattcattctacagtgctatagaacagtagaactttttcttactatatagctataaatttgtatttgttaatcaacctctacctatccatacgtcaatacttaaatggtcaaaccaaaatctttatcagaaatcactggtactttcatggttggtatgttaaagtttggatcactaaataaatttagagtaataggctgatcctaaaatttcattgataaacttgtcataattaactgtatttatgacaaagaaagcaaaacagaataatttagataattttataataaactagttcaggatatgtttatcctagctatatattggtgcatcatttgtcttactacatttgcatatgcttaaggcactgaatctggaacacaaaggaaataaatgcgcattgttcgttttttaagaaattctattcacatgggttttaatccacagagatgcctccttttagtcttgaatgcaaaaagaaattatcttttgagtgcgtgtgttagctttgaaaaaatacattcacatgagatttaattcaccttaaagtttcttttctattaaatctcatgaggaattgctgaaggaaagtttcatgatgccaagtcactaagcaaagttctccaatatgacagttgttagaaatgtgaacctagtgcagttgtccccttaagctatgggcaaaattcccagttttgaaccctgaactcattcagccaaaaaatctatattatgctagtgtctattacatgtgacttccttttgaccagctttttctatgtttagactctcacttttattccaaagtacactggaaaatagaaaaaaatcggataattctgttctgggtgatcagtaactttggaaaaattcaatttgtttgttttttttctggcaagagtttgaagtaaaacaagtttcttttcaacacattgaaacaacctattttctccagagcaatagagtttgcatctgatatcagataagtgattcttgtaatttgtctaggctttcaacaaactggtgaaaaaaaaatctcctttcatttactttccatctttcttcatgagtttcttttttttttttttttttatctcaaagtgttcttagagattgggggttgactatctagctcataataagaatctaacagaaaacataccattaagcatttgagcttctcagatcaaaatcaatatttaagaccaaaataatattatgcaagcttttctgatcataaaaagaaagatcgttagtcactttggacagaatgatgatatctttagtcattgaattaaaattcataagtgtaatcctcctgatgaatttttctctgtctggtatttttctatcaggtttataactcatgaggctaaagcaaattagtgtcaacgttttatcatgaccatttactcggtgcctttctgtttctttacgaaaataaagttgctttttaatgttttggtaaatttatataatttctttggaaacatcaccactaggatttaccatgaattacagcaatatacttagtgctgcttagaaaatatttcatccctttccctgttttttgtgtaggtttatgtccttttaatttctgtttaattccccttatttaaagcctaagtctcaaatattcatgattcttattgcgaactataaaatatgtgcttaatgccattatccttttaaaatcatcttgaatctttatagtttaatcacacatcttgcctgtaactaaatttaaaactctctggtaaaacaaaatgcctaaacatcttgtataatgatatgcctttttagcaatggttacacttctggctttataaaactatattacttagctttttaagttacatatgtccattatatgtatctaataaaattaaaccggattttagatattgaacatttttaaagccaacaaccttggtgctatccttggtttttcctctcctactgcctctgatatctaatccatcaattcctattagttttatctcaaaattgaccctgtctctgtccataagtcttctgtcagcctctttattgcaagcttccccactggtctctcattcattctccacacagcagcgaaagccactactttacagtaaatggtgtgaatcattcttctgcttaaaactgctcaatgacttcctggaatcaagtccaaactccttatcatggccgcctaaggccagtatatataactggaccttgcttctttctctgatctcatgtcctgccacttccctttcgggtcgcgtaccaagctcattttcatcttggaaccttgactcttggtcatctctctctactccaaagctctttctctgcatcatggtttctgccttctcatctctaaggtctcggatgccacctccctaaagaaaccatcttgcccgatgtagccccaagtcaatctctcttaaatctctctattctatttattttataccagggagcgccatctgaattacttgtttatttatttgtttgcttctccacctcccccaaccccattacaagtttcaaaagagctcctatctgactcagtgcaatatccaacatcctaagttggatcctggtgtataattcatgctgtttacagatttactgaatgatagtatattaatatgtcaagattcatggcaggtatcaaaaaattaatttattgaagcattcagtctcaaacattttcttttttttctttttatctttttttttttttcagatagagttttgctcttgttgcccaggctggagtgcaatggcgtgatctcggctcactgcaacctctagctcagagttcaagtgattctcctgcctcagcctcccgaggagctgggattacaggcatgaaccaccatgcctggctaattttttgtatttttagtagatatggggtttcaccatgttggtcaggctggtctcgacctcctgacttcaggtgatccacccgccttggcctcccaaagtgctgggattacaggagtgagccaccatgcccagccttcttttttttttttttttttcttttgaggtgagtctcgctctgtctcccaggctggagtgcagtgttgtgatctgagctcactgcaacctctgcctcccaggttcaagcagttcttctgcctcagcctcccaagtaggtgggactacaggcacgcaccaatacgctcagctaatttttgtatttttttgtagagatggggtttcaccatgttggccaggcttgtcttgaactcctggctcaagtgatttgccctcctcggcctcccaaagtgctgagattacaggtgtgagccaccgtgcccagccatgtctcaaacattttcatcttgtgaagctatttaagtttcctgaaaatcacctcactcttcttgtactcctcttccttaaaaccaacccaatggtctcaggcttttctgctcattcaagtcacatttcctcccagtaaacttaattttggtaaaatattcaacagttcaggagagatacataaatcatgcttgaactgccttgcaaatagcaaaggaactgactggccatgtgctatgatttcaagggttttgggaagcatctacctccaactactggtcctcactgagtcttgaaatcccacatttagagttttaatttcttttttttaaattaaacaacagaaatttattttctcacaattatggtggttggaagttcaagatcacagtgttggcagggttggcttcttctgactgctgtcctcattagaattttatttaagttttgactcatgttaagatagaaatactctcggaatgattaatgctttaaacttgtccagccacttagatgtaaggtctgaggatcttaaaaggtattttgggaaggaaaaaagagcaaacgtcagaataccaggaatctaaaatacaggcagaagagccacctggagggtggggaccattcggaaatcctgatctgcttgtaaggccggtgttagtctaacctatagcattctggttcttttctggctcggctcctactgtaaatttaaacatcccatttaatcattatgcaaaaaaaaattaagagatttagctgggtgatctctaaacaattctagatcagtgattctatactccataattttattcacaatcaaccctttctactactcacagatgctagaaaatattagaaagcagatgtaattaaatgttcacaccacaaaaatgagaactatgtgaggtaaggcatttgttaactagttagattgacccttgcacaatgtatatatacttcaaaacatcatgttataaacaattaaaacataattttaaaaagccagtatgatttctacaaatacaataacatgggaccaaacagcaacagacctcgagttcaccacatattttatatatttataatttcacatatactcacagtgtttcattccacatctattcccaaacttgaatgcatgtgcatgcacaaacaacatatacatcacctccttcactgagaaattacagcaccattatttattcaaaggcactaactctgacaagagtgaaacagaaggtacttctctattatatagtgtctattttctgattttctttgttatatttcattgtatttattaatattaggttaagcaagaatgtacaaagccatagcaggttgggaaggttatcaagagaccacctattctttttcttcaattcaatctcttttcagattaatcattcttggctattctgttttttaagtaatttactttttcttttcacttactcacctaattaatctattaacagagtgtcaacaattgctgtttcactaaaccagtaaaagacaactgctttggtgataatgttttattttcaagcaggtcatgattatacttatcacattattacacttactacatttattacttatcatatttattgcaataatcattatcacaaaaatgatccattgattctaactctcaggaggcactcaataaatatttagtcaatgagtgaataaatgcaatattggaattaaaacatactctcaacatttcaaccaaatgctttattacaaagcatgggggaaggaagcatagggttggactttgtgcactgaaacagttatatattttccgtagcactaaatctttttctcattaaaatgcatataatgtgcagctattgctccaggaggacctgctgtatcctgttaaaattaccgtcaccaatctgtggattagctaacagtaggggaggatatggctgatgtttgtctgtgtgtgtgtattttgatgattgaagaaaagaagtaatggggattaacattctgcttttacaagtataattgtaagtttaacacagggacaactttatttttagtgtaatacatctgtgaattatgaattatgatatgttcaggtcatgcttttttgcattcattttttacttttatggagttggagtaaactaacccaatctatgaatgaaattcaaaactgtacttgaaaatgaaggaaaacggcattatttttcaaatattgagtataaattatcacaacttcgttaaaaaaaaagatactttagaagtatacttaacttagtctattacttctccaaatagatgttttaaatgttttaagcatctgctgtaaaaattaacctaggccaatttggatattcagcaattatcacgttattagagcaaagtttggtagaattctacaattagagacaggtggatgattcatggcaaccttttctccataatcttgctaccaggtggtatgctaaaattaaagcaagcctgagattaaatagaccaaattctgtcaaatgtaccaacatttagtcgcaaatagggcacaaaagcagttattgaacttaagccttcaagttctcagtctcaatctgtaggaacttccacaaatacccttccaagagaggttcattatgaggaagatcagccagccttctgagttacatcagggacagaatcttccattaaatcgaatagagggtagaccaaagggagtttagacctagacctagtgtacttacctgatggtattagacttctagccttgatgagtcttatgcctcattcatgataaggctcataaaatctatatagcaactgaacattttgaacaccactcatttcatcaacaagtaatgatttcaagcatgccttttgtgaattaatgaaacctctctgtagattttgataatgatacttgaaattcttgggtggcatttttagagtacagattctggattagggaacataaaattctaaccaccttaggagtaggaatcaaagttaatatacagatacgtaacttacagtgaagtattttaaagtaaattagcacatctgttgcacaatagctttccggataggtttgaactataatgttacatccacattacggagatattaattgaaataagtaatacttcatagatatcctatacatgttatatatctatatctaaatcatctatatctatctattacatatttatcacctatttacctatctctatacacatatcattgtaggagtagaaatcacagaaaatgagatcatttgaaccaatggcctggtttgtgtcatttaaataatcttaaatttcaaccatataaactctcagatactcaaataatgcaaattctgcaggtatctggagtaatcgcttccaacattttttgtttttgagacagggtctcactctgtcacccaggctggagtgtagtggcacaatctcggctcactgtagactcaacctcctgggctcaagtgatcctcccacctcagcctcctgagtaactgagactacaggcacgtgcctccacacccagctaatttttgtatttttagtaaagacgggtttgtgctgtgttgcccaggctggtctcgaactcctggactcaagcgatccacctgcctcagcctcccagagtgctgggattttaggcatgagccgctggggctggcttctttcaacttttaactctgttgactgcatataactttttcatatttaagaaatgtgttggttgttgaagaagaccaagtctgaactcaaactgggttcttagaaagctttgaaaggaaaacagggacaaattaagtgtctgcctctgcccaaaggggaagtccctaaaagagaaaagtttaaagacatcaagaatagttctgatgcttgcctaaaagttaagtctagaagtagagtaataagtaaagtttcttggaaccttttcaatccagctagagagatacattatgaccactgataatggtgtgctttctacctctcagtttaccctttgtaaataactcaaatggtttgctttgaactggcatatttatttattttccctctgggaaaccacctctactcatattcccgaataaactgttttcctataatcagctatgtatgaaggctttagatatcaacagaactttccataatatctcttttaaggtgaaaggttcagaataaatctacctaagattaaatgctccttaggtggaaccactgagcctcatgctacctacatgcctatgacaaacaaatttttatttcatatgcatactctgctgaacaatgacttatatatccaaatacctactagaaatctactcctgaaaatccagcagacaattcaaccacaacattcaaagcaaaaataatggtttcttgcccagcccattcttccccatctcaattaatgtttgcaacacacccactgtgactcaagccagatacctaagagtcattctctatttctctccagcccttatacccaacagccaatctatcatcatttcttgtgagttctacctctgcagctattcttccagtgcaagcctccatcacctctcacctagaatgttgtatttgttatattttaggcctcctttctttctactctagctctgtttctttggtcaacacagcaaatgaatgataattaaaagaaaatgaaaggatcatatcacttccttatttaaaactctcttttagcttctgtctaaacatggaaggatcaaaatccctactaatgccctgcaaatcctgcatctccaatctcagtttctcacatcccatcaatttcctgttcactctggccacacagtctttcctcttgtttcaaatggaaaattgacatagcccaggcttaggagctttgcactcactgttgcctctgcctggaaaactctggcctctgagagtcacctgtgtggttccttgatatccaggtctcagctcaacttttacactactgtgagaacatccttaccaccttttcttaagtagctcagcaatgcccccaggcaggcactctctgcatccttaccaaccttctattttccaggggattttttactaagtaaaagtttcttgtttatttagttgtttggttactgtccttctactctaattataatgtaaattccctaaagtcaaagattttgcttctcttccgttgtactctacttgccttggcacatggcaggagcccaatgtgtttcataaggaaattaagattcctacctggtaaggttattctttcaagaaaaggagaatccaagtgacctttttccaaagtggttgaggtccttggtatcttgctgacttggcagaactgttctgagagcctcagaaattgaaccacgttatttaaattcaactctgaatgtaaagagtcaccaaggggccactaggatgaatcccagcatctctcatttcctcaggccccctcatccttctgtttgttaaatcaatgctggaggaagatgggtggcatcacattcaatgacaaggatgccctgtgataatttgcatcatctccaaagaggattaaaaggggctgggtgcggtggctcacacctgtaatcccagcactttgggaggccaaggtgggcagatcacttgaggtcaggagttcgagactagcctggccaacatggtgaaaccctgtctctaccaaaaacccaaaaattagccagtcgcggtggcacacacctgtaatcccagcttcttgggaggctgaggcaggagaatcacttgaacctgggaagcggaggttgtggggagctgaaatcgtgccactgcactccagcctgggcaacacagcgagactccatctcaaaaacaaaacaaaacaaaacaaaaaccaaagaggactgaaagggatttattaaatctcagcgccccaagccagtggttctcaaagtgtggtccctgggccaggagcatcaacacaactaaagaactttgttagagacacagattatcggggggctcagccctgacttggagtatcagaaactttaaacctgtttgaacaagctcttgctaaaatatgagaactaccatgctaagacaacagtgccaaccttgattgcaccttatgattacctgccaagcttttaaaatttatcaggcctgagcccctctgctacaagttcttagtcggtctgccgtgagtgagatctctgtattatttaatttctactaagtgatgctgatggagctccaaagtttagagtcattgccccagtgtgggagcagggtaacttcaggtttatccaggtactttgtagattttcatcctgaaaagaaatataatttggaattcaaacatggcttgcctctcggttttatagtaggagagaagggaaatgacttggcctaaaacacagcatatggttctaaatgctagtgttgtatagcctcatccaaagcatcaactcatagagaagtacattaaagcagtgtaatgttcaaaaccaagttccatagtaagcatctgctataatagaatgacttattccagaagggaagtttcatttcaggagagcttatcatgacatcaaatatgttttgagttaatgaaaatgcaggaagcaccaagttaatagggcaattttaaaccataaagcctaatttaactgcgctaagaatgacaatataatgctctgcacaaaaggaagtttcacaacctgattgatcaaatggagaattactaggatgctggatcgcatcttccttgaagaagctaagttgactaggagaggcagacttccttagaatgcagttatgtacttcttaattaaacaaagaatgattaaaaagagattttgctttataaggccacagaacagcttgtttgataaaattgttataagcctccagactttcatttctactttaatattgattccattttcagaaatagttaagtagaagttattcaggttcttctttatatatttgcttttttagttgttgttagacgtaagataaatttgaaatgtcaggaaggagaatgtttattttcacaataaaaagcttactctgtgtaatattgaaactatccattctgatataagataatgttttattttggctgcttaatttcaaattgaattatttaatagaacaattaaaagtcaatacaaatgaaacagctacttgtttttctcagtttatggatgttttataaagtgtaaaagcagctgtttcgttatacttttcttgaattgaatagccataagagctttcttaaaatcatatttgatccatagctctttcttttatagcttcttctatataatttacttctaagtaacatttcctttacatataaaaattgattattactgtcttgtgttaagaacttttcctgggtctccttaattcatcagaatgccaatattacgattagcaaaaccaattaggccatttatcgcagagaatattggaaatgtgctatatgcaaagcattgttttacaagtagttcaacattctaattttgaaattagactaagagcataatacatttagaaaatgtggatagttaagtttaaatttaaaataataaaaagtcaagaatattacaattttacttcctcagtcacactaggcacatttcctagactcaataggtgcacgtggctagtggctaccatagtggacagtgaagatacagaacatgactatcatcacagaaagttttgttgggcaggcagtgctgtataggctagttagtgaggaaatacatttttaaaaagcattgttccctggggcattacaggataaatttaagaattctgtttcataaggaaatattatgccacacatggagtctttcttaaaataactgaccctctagaagaggaggcctaagtgtacaacctgttcatttcctatcggagttggttgcctggaaatgttgtacatctcagtttcatagcaaggtcataaatgttttgtaggccgtatcctctgttctatctactatccccacagcacaaagaaataattatgtgcatagagtggacacccaatgaatctttactaaaagcaccaaagtaatatgaggcaaggagatactacacagatttcaacctttgaacttgaacagtagtttgtaactcctggcccagtctagtactagattgtagggtcctgatgaacaactgtaggccaggatctccctctgtttcaggtgccttgtggtaaaatcacatgaccactgaaccctcaaccactccctgaactagatgctaccaacaccaacacagaacccctttccccataattccttccttatccctggtccaggaccagccaacctgaacatagactgacaagcttctcatgattcaattatctaacttaagttaccatatgacttccttcaacaaaagttacccattttaaaatctctgtttctttctgtattataggagactcatatcccaaatacacacacacacacacacacatgcagacacacacacaaacacacacatttatatatatgcagaaaagcaatgataaaatctctcctgccaaattagcaatatagttttgtttcaaaatatttatgcataaatttcataaggtattctgacttttaatttgaaatttaattcaataaagattacattagtcagaaaaaactcatctttggccaggcgcagtggctcacgcctgtaatcccagcactttgggagaccgaggtgggcggatcacctgacgtcaggagttcgagaccagcctgaccaacatggagaaaccccgtctctactaaaaatacaaaaaaaaaaaaaaaaaaaattagccaggcgtggtggtgcatgcctgtaatcccagctactcgggaggctgaggcaggagaattgcttgaacctgggaggcggaggttgtggtgagccaagatggcaccgttgcactccagcctgggcaacaagagcgaaactccgtctcaaaaaaaaaaaaaaaaaaaaaaaaaaaaaaaaaactctccgtctcaaaaaaaaaaaaaaaaaaaaaaaaaaaaaaaaaaactcatcttttaatgttagtttataatttaaagacacaaaaacagcttcgtttctagattcaagcaaggcatgtatttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagctttgcaaaatgttactaagtgctagcatttagtttgtgaaatgttttaactattgagaaggtgatgttggtcagtccttaactaagatcgatcaaagtaagttcagtaggtgactgttttacaagtggcatggtggtggtgttcctcaaaggttttggagagatacaaaaggactctctagttgtggttttaagttatatactcagttttatatcctgttaaagtttttataccatattttaaaattgctgtttggaattacaggaaatgtttaattcacaaatcatttatagttacaggaaatataattctattattgatataatgaattgaatggtttttaatacatcgtagttttaaacacttaaatattcacgagtaatatttgggaactttaagaatagcatccaaaaggtctacgtgttcatgtgtatgtctgtgtttgatttggtgggggccattggccaaagtttgatcccactcatttgaacagcttgctcagtatgtgcatcattggggaaaaaaatcggcatggagcgttcggtagctagcctctagtagaattatcagaggaaaactgtgatggtgaaactgagaatttgaaaagccagattgatgttttccaagcttgatttttagatgagaaagtaaaagagtattttgatttaacatttgaaattataatattagtagcaataaaatataccagtgcttctcaaattatctgaggtggcagaccaggtttttaaaaatttcattttgctttaattttcaatctctcaaggaccaatactttggtaaaataccataaatatcaataactagaaacaacgatgttaccaaaaaaaagacatacaaaaatacaagccagggcttttaatattttttttcatttaacagatattatcaaattgctgtgaaatttactaaatgttcactctcagtttctatacttttattgtagaacaacaaaaggaatttgttaactggctgtgctctgtaggctttttaagtagaattgctctatgtcactgtgcattaaattttgtgtttggatgtatcctaagcaagctatgaggtctctgaggaaaaaattatatatatatatatatatatatatatatatatatgtgtgtgtgtatatatatatatatatatgtgtgtatatatatgtatacatatatgtatacatatatgtgtatatacgtgtacatatgtatacatatatgtatatatgtatacatatatatgtgtatatatgtgtacatatatacatatatgtgtacatatgtatgcatatatgtatacatgtgtacatatatacatacatgtgtacatatatatgtatgcatatatacatatgtgtacatatacatgtatgcatatatacatatatgtgtacatatatatgtatgcatgtatacatatatgtgtatatgtatacatgtatacatatatgtatatatgtgtatacatgtatgcatatatgtatatatgtgtatacatgcatacacatatgcatacatatatgtatatatgtatacatatacacacatgtatatatgtatacatatacacacatgtatatatgtatacatatacacacatgtatatatgtatacatatacacacatgtatatatgtatacatatacacacatgtatatatgtatacatgtatacacatatgtatatatgtatacatgtatacacatatgtatatatgtatacatgtatacacatatgtatatatgtgtatatgtgtatatgtgtatatatgtatacatctatgtatatatgtgtgtatatatgtatatatgtatacatatatgtatacatctatgtatacatatgtgtatatatgtatatatgtatatatgtatacatatatgtatatgtgtgtatatatgtatatatgtatacatatatgtatccatatatgtgtgtgtatatatacacgtgtgtatatatgtatatatgtgtatatatatacacgcgtgtatatatatacacacacacaatttatgtgcatgaattgtgtgtttttattttgattataacttttaaaaagtcatacaagtgtattctgcatcacttgactgaccaaaatgtacacttgcataacataagtgctcaagtttgtgtttatgtttacaatgaagtcaacaacaagtagcattactttaaatgtcagggtctgataaataaagaccagaggaagctaaagaaagaacatgatactttgaacaatcctctctattaaatgggaaaattgggctttagatctgagtgttttaatttctactttaatatgcttgattatagttttaagatgaatgcataccagaaatgaattgatttatataaatctttcattttaaagcagattttatcattttacaatgtgtgagaaaagaataaaatcagacccttgattgacactgttctttcaatcagtttatgaaacattttcctctgtgtctaccacttttatttgcataattaaaaattttaatgctaaatcagaaaccaaaaatggaatgtgcataaaatccccttggactatgagtttggagagttggcattttttctggcgtgatctgctataggcttactgttacttagggcccggagaggtgggtcagggaaaacattaaatgtattcagggtatgatccatattctatttttaagttttatgctgtttattttgagggaagagatactgatatagtttggctgtgtccccacccaaatcccaccttgaattgtaataatcctcacctgtcaagggtggggccaggtggagataactgaatcatgggggcagtttcctccattctgtttttgtggtagtgagtaagtctcttgaaatctgatgattttataaatgggagttcccctgcacaagttctcttgcttgctgccctgtaagacatacccttgctctttttctgccttccaccatgattgtgaggcctcctcagccatgtggaagtgtgagtccattaaacctctttcctttataaattacccagtcttgtgtatgtctttattagcagcatgagaacagactaatacagatacaaacatgtaaagtgcagaataaggtcctatatgtcaatgggccaacttgtgtgttttgtaattaaatatactagtttagagaaaaggaagctcaagctcaacatgaactggattcatcagtggtggtctcaccgaggaacatgaccaaacttcagtataaattgtgtttacatctcttcttaaaaaaataattaaatacatgttattattgtttgaaaagttatttaatactgagcatctacacattaatcatgatgaaaaaataatattaaacttttgtatgtcctgctagcttaggaagaatgacactgacaattatttcccttaaccattgtggtaagccaagtattagttcatagcaaatatttcatttgtagatttcagtttttttcactatttctacttttcatacaatatcattcttcaaatgataaaatagtacttagtgaaggatttgggagcatgttaaagttatttagcattaattgcagcattacactgggacacatgtacttctatttctgtaacatatcactcatcatttcactcagataaaggaaatattaaacattttatcagatggggaattcctggggtcacactgtagcagatgagttgggattggtataccttctccaagcttcctattagttacacacgcacacacacacacacatgcacgcacacacacacacactccagtttggaatctgtctagccaagaccacagtgcaagatgttaaaagcactccacttgctttgggcatatgccaggcctgaatgagtctcttaccattgggaaaacgatctatatttaaatttttctagatactatctattaaaattattctatattaccaaagaatggaaatattttccggaaagttcagagtagcaacatattccttaagcatgtttccacttcaaaagataaaaagtttagaagacatctccatgtcctcaaaaagaagtaagaaaacattataattattgattaaaagctgggagccctagaaagaaaccttggagatgaatgacaaggatacaaaaggatttgtcaaaatgagaaaagaagacaaggaaactcaagtacagctagcgatataaaagctgcattgaagtctattatagtcttatatgacagaaaaaggtgaagaaaattgtatataagtaaggaagaaatgtttatagatgaaaaattatatatatataaaatctatagattatatataatatatacaggaagagagagagagagggatggaggcagggagggagggagagaaatagagaatgagaatgtgatgaagggcagagaatagggatcagaaatacagctgattcagttgaaggaaccagaaaatgggagggggcaatatatttgaataaaataattacaaatatgtaataaggataaaaacataagtctttttctgttgctcttgctctatgtacatgtgagcacacgggcacacgtgcgtgcacgcgtgcacacacacacacttagaaagttgaaggctttgtagttaagtagggaatttgtagtatgtagggaatttcaaccttgattcagagtgacaggcaaagatttcaaatggaggtatatgtgtattcttcaatgggaggataaattgaaaacataagtaaggcataaaatgtatctaaaaaattttaaccttactaaattccaatgaaatccaattatgattttcttcctaaacttgacaaagttattcctaagtgcatctgaaaaatatagcaaagaatatgattataattttaaagtaatataggaggacttgccataccagataatattgtcatgggtcaatcatagtctttaaaacaatatagtactaacttcaggtgagcagacaagccaagggacataacagatggccctgaaattgactttatcatataaaaagactagtatttaattttttaaagtatcattaaccagtagggaaataaccatctaaagaatatatatctattagccatttacatatataaccaattaaatatataggtttgactatgtgtctccactcaaatttcatgaggagtcgtaatctccagtgttggaggtggggactggtgggaggtgattggatcgtgggggtggagttctcacaagatctggttgtttacaagtgtgtggcacctcctcctgcacttactcttcctcctgctctgaccatgtaagatgtgcctgcttcccctttgccttctgccatgatagaaagtttcctgaggcctccccagaagcagtcatgcatactgtatagccttcaggaccgtgagccaattaaacctctttactttataaattacccagtctccggtatttatagcagtgcaagaatggcctaatacaatatgtaactatttaaatatatacaaaatcattcaaatatgtatagaaccatttaaatacatatattaaattatatatatataatttttcaatttcacgtaatctagagagtttatattaaaattgaaacatgacaaatgagaaagctattggttaataaatctctagataaagcagaacttttcaagaatttttatttaaaaatgaaagggaaacactgggcatggtggctcacgcctgtaatcccagcactttgggaggctgagacgggcaaatcacctgaggtcaggagattgaaaccagcctggtgaacatggtaaaaccccgtctctcctaaaaaagtaaaaattagccgggcatggtggcatgcacctgtaatcccagctacttggaaagctgaggcagaagagcctcttgaacccgggaggtggaggttgcaatgagccaagattgcgccactgcactccagcctgggcgacagagcaagactctgtctctcaagacaaaaaaaaaaaaaaaaaaaaaaaaaaaatgaaagggaggatccttacaaaaggaaagatgattttgatgcattaaatagaaaacatttttaacaacagcaaaataaataagataaaaagattattggctaattaggtaaaataccttcaacaggtgtgatgcaatttgatttctgatacatgaattcttcaagtcagtttttataaagtagcaaagcgcatgattatgcaattaaataaataataagaacacataaaatagcaaagaaacatatgaaaacatactgaacatcatgagtaattggtaatcaaagaaatgctaaagtaataagatacaatctttcacctgataattttgtcaaaaatattaggtaaaatagtcaccctcatacactgctagtcagaataaactgtttttgcaggacagtttggtaatagctatagggaatcttaggtttaataatttgtaatcttgatctaacaactcaaattctgggagtacatccttaagaaaataattagacttttacaaagatttatataacaagaggtttatcactttgatatttatagtagcaaaaaaattaatttaccaaaatcataaacagtaaagtagttatctatgaccattcaatgaaaaactggcaacccttaaaaatatgcttaatggtaattttttttaagtaagtgaactaatcctgttttttggatttggattgtcttttaaataaggtcttacatataatcttaatctaacacatctaaccacattgtattaaagtaaatgtttccaataataccaatgttttaaaatttatagagttgcaataaggttcagtatgtttgttattaatttccatcaccgctccatgtgtgcttggaaaggttttgtattctgaaattgttgggtacataagatcaagtttcttcattgtgtttctcaaatcttatgtatggtacttattaattttaattttttgcctgttttatctatcagtttgtaagaagagtgttgaaaagctacaactaaggtggtttatttgtatatttctcttcatattctgtcaaatattaatttatacattttaacatatatattatgttcttaagtgaatgattacattttcttggaatatatcttcagtacacctttctggtaaagtgaaactcttacaattatgtggtgactctctatctccaatactactcagtctttaaagtctatttcatgttttattaatatggttaaaccagctttgtttgtattttctatatataaatatttttatatgccagcctgtatagttttaattgaggtgtgcctcttataaatccatttaactggatttgatatttgctttgttcctgtatgacagtctttgcttttcaactggaacttttagttaatttttaattgtaatgactagtgtctgtaatcatgcctaccatattctgctcctgcttttttttttttctttttttttggggggtggggggatacagtttctctcttgtcacccaggctggagtgcaatgttgaaatctcagctcactgcaacctctgcctcccgggttcaagcgattctccagccttgcctcctgagtaactgggattacaggcgctcgccaccatgccaagctaattttttgcatttttttttttttttagtggagacggggtttcaccatgttagccaggatggtctcgatctcctgacctcatgatccgccctcagcctcccaaagtgctgggattacaggcgtgagccaccgtgcccggccgagtttgaacgtttttatacttgatctctattcttttcatgatcctgcagaaaatttgcacatatgcttaacttacgaaatctacttttagctatatctttactcgccttcagaacaatgtaagtacgtaggagactttattcctgtttctctgtattttagtcatctttttttttctaattcacaaacgggacgttatcatcatttctttatgcagtcaatatttgtttaatgtaagccccatgaaggcaagaagtttttattgtggtggttgttcaatgttatactccaaacacataaaacagatcctacacatagttattatgcctagataattattaaataggttgattaaatatacccaagtcgttaacttttttttttttttttgctcatcataccttcctgcatccctctgtgttagttttccttctgcctaaaaagtaattgtttataatttccttcagtaagggtgtgttggtaccaaatactctctgtttatttgttgcctgaaatgttcatattttgctttcattcttgaataatactttgatggttatttagttctaaatttttttaagcagagtgtagtattattccacagatctttacattcattgctgcctgtaagaatttggttgttagttttattgttatgctcttgaaggtactctgtcttttctctcttattttaaaagttttctctttgtgtttaattacatatgatttcactatacatacatagcagcacatttccttttatgtattatttatttatttatttttattttattttatttcattttgagacagtgtctccctctgtcacccaggctggagtgcagtggggagatctcagctcactgcaccctccacctcccaggttcaagcaattctctgcctcagcctcccgagtagctgggattacaggtgtccaccaccacgcctggttaattttttgtatttttagtagagacggggtttcaccatgttggccaggctggtctcgaactcctgacctcgtgatccatcacctcggcctcccaaagtgctgggattacaggggtgagccaccgtacccagcccacatttccttttatttatcctttttcagattcattagtgttcatgaatctggaaatgtctttcactagttctggaaaattcttgcctattattgtttccaatattatgtcagcctcattctctttctcctcttctcatggaattccacttagaaataagatatattttcttattctatcctccatatctccaaccctagtctatattttccttctctttgatttgttcctgcattgtggaccatatctttagatcactgattgtttcttaggtgtttctaatcagctgttaaaatagccatttgttcttatattcaataattatatttttctttctaagacttatagagttttttatttccaagtctgcttaacaattttacatagtcttttgtttcttagtcacataataaaccccttcttttacttcttaaaaataaaaggtacttttaaaacatgcttactttataattaatttcgaatgatttaaatatcccaagactttgttagaatctgctgtctatattctctacttgttcccactcctgcttgtttgcttccttccttccctcctttctcctttctctctttctttgtagtatgctgcacagttaggaaatacagtctaacgtatagtgacaaaagaggggggtcagtgattctcctgttatatgaggtatggggtaagaggaacagagagaagtagaaagaagggtggatatattagcagagttctctagagggacagaactaataggatagatgtaaatatataaaggggagtttattaagtaatattaactcacacaatcacagggtcccacagtaggctatctgcaagctgaggaacaaggaagccagtagaacttggagttcaatgttcgagggcaggaagcatccagcacaggagaaggatgtgggctgggagactaagtcagtctagccttttcacgttttttttttttttctgcctgctttatatttgctggcagctgattagattgtgcccaccggtattaagagtgggtctgccttccctagcccactgactcaaatgttaatctcctttgacaacaccctcacagacacactcaggatcaatatcgcatccttcagtccaatcaagttgacactcagtattaaccatcacaatgggattaccaaagagcacaagaaaacttttggaggtgatgtgcatgtttctgatcttgattatgatgatggtttaacagctgtatacctatttgaaaacttaccaaattatacactttatgcagttaattgtatgttaattatacctcaataaacttgtttttcaaacattggacacatagataaccaaaatctttataattgttagtcttctacatggaaaattcatttataatttcactttcattttttcacttttctgcatgttggtaaaagcacaccctttaacacaggaatttcatttttcagaatctattctcaccaagtcaccagatgaacaatagatcatctacacagttataaatgacaatattgataagaaaaatgtgataagaagaaacgcttagaagcaacttaaatgttgtacagtaaaagtttgatagacagattgtgaaatatatatgctagaatataaaacagtcaacattatctggagaggactttatgatttaaaatgtttcagtcaacaaaatagcacaaaacttttagttgtttacactgtggtaataatttcataaagattcgaagagaatgaaataaggtaagccaaatgattaatgactgttactttggaaaagtagagttgtggataatttttatttccttttttatgcttttcttcatactccaaattctctaccatgaatatgcattacttttctcatcacatttttttgaaaatgactaaaaggaactctcccaaataattttccttttatctttcaacgaaatggcttttaaaagaatcctctcatagaggatttgaagcacgtcaagaaaattgttcagaacggctgagagtcttatggtgaatgtgacaaggttatagtccaagttttgacatgttcatcattaacgttctgctggtccctagcctgtctcagtggatggagatgaattcattagagatgagtaaataaaaaagtgattttctctctaaattaatataacgacacacttttatgatgaattttctaaatcatttcaggttataccttcctctctgtgagttcaattatctttgtcataaaaagcttcttttccatagacaagctttacccatttttcatagcctaatttaactgtaaagctgttaacatcctaatttaagctgatgataaatagtcttttaaccgatttgaaatttttgaaattaggtggtataatattcatagatataaccttaccaattgtgaggtgaaaaaaaattcaaagcataaatatggctttaaccttgaaacctgacaggcgtttgaataggaaagagatgagccatttcctgtatttaaatttctctagactccccgtgccctgtgtgccaccattttgattaatccttcttaaaacttatcttctattaaatgtgtgaaaaacatatgtttctcattgttaacatctcaatgttttactcaagaattggataatctgaggaagtttcattaataaaggaaaatatatatccgggaaatattatgtatgtatgtatgtatttcacacctttctctttgtaggttatcaaaatagtgtgaaaaattagaattaggcttagaacaacactatcttttactctaaagctctctagaaaaggtccctaaaattaatcaaaaatgggcactatgtcttctgttttaaataaataccttaataccttacaatacctcttttacaatgatgtcatcttcttactagccaaatgccaagattctgatgtaagagagtaaataacttgtgaaacaaagtaagagaatctaaaaaaaaatcagtttgcttggggctttatttgtatcattattttctagcattttaccaattcatttgtgtttcaatcatccatgatgcattttcttaatgctggctgctttcattttttattttttaatttttaaaataatttcaacttttattttagatttgggggtacatgtgcagatgtgttacatgggaatactgcatgatgctgaggtttggggtatgattgaacccatcacccaggtagtgagcatagtacccaatacgtagtttttcagactttaccccccttcccccgccctgcatctggtaatctgcagtgtctgttgctctcatatttatatctatatgtactcaatttttagctcccaattataagtgagatcatgcagtatttggttttctgttcctgtattaattttcttaggataatggcctccagctacatgcatgttgcttcaaagaatgattttgttcttatttatggctgtgtagtattccatggtgtgtatgcaccacattttctttatccaatccacccattgatgggaagctaggttgattccatgtctttaccattgttaatagtcctgtgatgaacatacaagtgcaggagtctttttggtagaatgatttattttcctttgggcatatacccagtaatgagatttctgggttgaatggtagttctgtcttaagttatttgacaaatcaccaaactgctttccacattacctgacctaatttactttcccacaaacagtatataagcattcccttgtctctgtagccttaccttttgttttttgactttttaataaagccaatctgactggtgtgaagtggtacctccttgtggttttgatttgcatttctctgatgactagtgttgtgatgcattttttcctgtttcttggctgcacatacgtcttcttttgagagtgtctgttcttatcttttgcccgtttttaatggggtaatatgttttgtgtctattcaattgtttaagttccttatagattctggatattaggcctttgtcagatgcatagtttgcagatattttttcccattctgtaggttgtctgagtactctgttgatagtttcttatgctgtgcaggagcttagtttgattagatcccacttgtcaatttttggttttgttgcaattgctttagaggacttagccaaaaattctttgccaaggccaacgttgaaaagggttatttcctaggttttcttctgggactctaatggtttgagaacttacatttaaatatttaatcctttttcagttaatttttctatatggtgaaaagtagggatccagtttcattcttctgtgtatggatggccagttattccaacaccatttattgaatagggaggcctttcctcattgtttaattttgtcgactttgttgaagatcagatggttgtagggtgtgtggctttatttctgggttatccattctgttccattggtctatgtgtctgttctcgtaccagtactgtgccatttttgttattgtagccttatagtttaaagttgggtaatgtgatacctccagctttgttctttttgcttagaaccgctttggctatttgggctcatttttggttctgtataaattttagaatagtttttttttcctaatcctgtgaaaaatgatgttgatagtttggcaggaataacgctgaatctataaattgctttgggcagtacaaccattttaacagtattgattcttccaatccatgatcatgaaatgtttttccatgtgtttgtgtgatttatgatgtatttcagcagtgttttgtagttgtccttgtagagatctttcatccccttggttaggtgtattcctacatattttatttttgtatgactattgtaaatgggattgcattcttgatatggctctcagcttgaatgctattggtatatagaagtgctattaatttttatatattgattttgtatcctgaaactttaatgaaatcatttatcagttctaaaaggtttttgatagagtctctagggttttctgggtatagaattgtattattggtgaagagagataatgtgacttcttgtttttctatttggatgcctcttatttctttctcttgcctgattgttctggctgagaattcagtattatgttgaataagggtggtgagagtgggcattcttgtcttgttcctgttcttaggatatatgcttccagcttttgcctgttaagtatggtgttggctgtgggtttgtcatagatggctcttatttttagttatgttccctagatgcctagtttgttgaggctttttataattttataaaatccctttgtataagggatgttgggtttcagcaaaagccttttctgtgtctattgaaatgatcatatagtttttgtttttaattttgtttatgtggcaaattgcattgattgatttgtgtatgttgaaccaagcttgcattccagaaataaagcctactaaatacctatatcaagaggttatacaaatctcaaattaatgatctaacatcacacctagagggactagaaaaacaaaaacagtctaaccccaaaggtagcagaagaaaagaaataattaaaatcatagcagaagtgaacaagatagggaatcaaaaattcatacaaaagatcaacaaaatgaaagatgattgtctgaacggataaacaagataaatagactactagttagatcaacaaagaaaaacagagagaagatccaagtaagcccaatcagatattacaaaggtgacattataacaaatcccacagaaatacaaaagatcctcagagactattatgaacacctctatgcacagaaactagaaaatctagaggaaatgcataaattcctggaaacacacaatctcccaagattgaaccaggaagaaatgaaaaccctaaacagagtaatattgagttctgaattgaagcagtaataaaaaacctaccaatgaaaaaaagccctgggccaaatggatttgcagccaaattctaccagaagtacaaagaagagctgctaccatttctactgaaactattccaaaaaaaaaaattgaggagtagggactctccctaactcattctatgaaaccagcataattctgacaccagaatctggtgaagacacaacaaaaaaagaagactataggccaatatctctgatgaacatagatgcaaaaatccaagaaaatacaagcaaactgaatccagcagcacatcaaaaagttaattctccatgaccactctttaaaaatgatatttaatgtgcctcattttccttcctccccccccactgaaatttgcttctatttcatcattcctgttgcatctaacactgagcaagtatcttaggaaacaatacaattttgtaaaagatgttctgcagtagcctctatgtaaatatcgtttatccctctgtcttattaccaagataatggatgtgctttttagctctctctgttatatatatcctctactttatgtgtgtgtatatatatatatatatatctcctctgctctctctcctttagctctaggtttcaatattcattcccaatatagcaggcaaacttttactttgagaaacttaaaactctaatcagacatttcaattcctacatgccatctcaagcctaatttgggaactgtgggagcataataacgcattgtctatttcttcctttctacttttgtacaatagcttttgacttggagggagtttacttctacttgctgcacaattatcccaacatccagctcaatttcaaaggtccatttagctgctttggtggtacactttgacagcctattggccttgtagattttaatgcattttgcattatttatctcagttttccaagtatagtttttctgttgaatttctactcgttaaccaattttctggaaatgtttcccaattgatctgcattgcacctgtagcttattttttttttggttttggcaaaactcagctgaaaggtgtatgaagtacaatgtgatttcttagcacattgatggtactaagttggctctaaatgtgctgatgcatatagtacacttctgcaatgatgtctctctgggaaaccccatttaacttgagttacaataagcaaagataacagcaaagctctcagtactctttgagacaaaggtctcatacaattcattaaaattaagatgattctggctgcaagttatagaaacccagattccgattgattaaaataagaagggatgaatggtctcacttgacaggaagttcagatatgggatgggcttcaaggaatgctcatttagcaatgtcatcaagggtccaggtgtttttctcttcctctgctctgtaattcttagtatcattctatgtgtggtagaaagatggcttacagcagtcccaggcatcatatctatatccaggagacaaaggtaacctattttttcttatgaatatctcatatgagcaaggagatgtccctgtagtccaagatgacttcttattacgctttataggtcaaagtagtgtcacacgctggttctagagtaaaccatgagcaatattcctcttaaaatgatcaggccctccataaaagtgggatgagttctgtttttactgggacatatggatatctggacttgggaggatatctgatcaaaattggagttctaatagtacaataaaagtaaagaaatgaatgttggttgggaaacaatgtccaggttgtgtcatcatcattgaacagtggaaaaaaatgcagagggcagtgagagcccctgtggcccactggctgtgaccagcatgggtttctaaagcactggtgaaggataaaagaagaggacaataagaatgcctatattttggcccgaggcgaaaataatgaatagaattccttagtgggcagatactgtagtttggcccactcaacacccctttcatccctcttctatagagattggaaaggaaagtttttgatttcacagcctctcttgcagcttggcttaatcaaaagcagaatgctggccaatgagatttaggaaaaatttatcaggctgcatttgctgaataaatgtcaaatttgtatttggaagcacgatatctttcttgaaataaggaagataagaagtcacttattaaggacgttggagtaggaagtaagctgtgctctcagtggcatcactgagatgccatttgagtcttggactatatactctcaaaggtctggtcatgtgagaagacgtaaactatagcagtagctgaaagcaatgctatcaaatatagagtgctcaagttagttacataagtttactcatataatattccaattaacttagccttttaattgtttcccaaaggccaaatcagaaaaacttctcaaacagtatatatcacaaatatcttaactagtgcgaacccagaatccacctaatcacactcccagtgccttagcagagacaaccgtggctaattcttcaaggcgtcatttatatggataaatgttacatccacaactcatatctgaaccaaggcaggtttcataaatcagaagtctagtttgagcccccacgtcagccttattataacattcaacgtaacaaaggacggtgtgttataccttatgtaaactgacctttaaattggcctgaaaatattcacatgcatgaatggggctgtattacagcaatgacattgaaaattatattaaagacactttatttagcagcaaatttaatataacatttgaactgctaaaagtcaagtaggaagtagagagtactttcttcatttatttgatgaaaaaaaagcacagactgctttaaaaatataacttttgactacatacaaccagatgaaaaaagacgttaactagagggaaatttgtttcatacccataaatagaaactaacttaaaatgtaccatggtgggggggaaattagttgagaattacaaaatcctcaactgctttaataccacagcttcattccatttgcctctcaactattcctgctggggcttctgctatagtttattaacaagtatcagtgtttccattaccttagaaaaacaaaaccaacaatcatttttcaaaagacattcaaattgtcagtatgtaattattgctaatattaagaattcagtatgttaccacatacaacgcacataccaactatctactcattgagataaacttatatttccgaaatgaaaaaaaagccattataattaagactcaagaaaacttttccagtataaatatactcttaattaaagttgagataaagatatatctgtgagatagtttaccaaaatatttatgttaaacatcaggctctactatatttaagagtgggtttccatcaaaatacctcataattatctagttgcctgcatgtacaacagaaatacaagaactgaactggatgagtacaaaagggctttcaaatgtgtccactaatacagttaaaagaatataagctgctacatgtataaatacaatattatataagtatattatataaacattattttcattttatcttctaacagctttataatctaagtgttatataagtattttatatttatatgatatatacttataaatatatatcaacacttatataaatttatatatacttatataaatatagtataagctactacatgtataatatactgcatgtataaatataatataaaccatatacatggtatacagtttattctcctaagtaacaccaaccattaactttgtagtatatcatatgaaagagatgatatggttaggattcaataatatacagaggtatttgtcactaatagatgtagtcaaaaatcaaagacaataatgctaacattttttatattactgtttttagcagtggaatattttctttaagccacaggttacaaggcagtccaatgtagaacaaagataaaaacagctgcgggttgaagcagagctgactattcagccatggggagcttctcagaaacattagaatcctttatagggtctcaaagagacttgggacctaagtgttttctcctatgtcctaataattatacctattttagcccccctctggggacattttaagtgaccaagaattgttaagaggaaaatgggaaggattctgagctccaaactacatttcatgctggccctcccatcctcctaggacatctgattatttgtataaaggagatgtattagaagtccttggaattttctaattagaagttccagctctgattacttggagtttgagtaatttttcaagtaagtattagagtcaaggcttggacccagatatgactataaaactcatacttttaactaatttttatgtagttttccactgatacactagtggcattctcagccaactaattaagttttctctgctgaatgttttgaattctttgtcttgggtaatctctccctttaaaatgtaaggttgaacctgtagagctccatattgtcacttaattatgacaacatagatgagaaaagtacaaagctttgatgtgtctttggtggagattatatgacatattgaagttttgtgagatggctcagaaagttcagtaatagctgacgttgaaaagaatcaactcttatttatgcaggtgaataataatgtgactaatctggtattgcccattagtaattgatcatttctctctgacttgggaactatcgcctgtaatcccagcattttgggaggccgaggcaggcggatcacgaggtcaggagattgagactaccctggctaacatggtgaaaccccgtctctactaaaaaatacaaaaaattagccgggtgtggtggtgggcacctgtagtcccagctactcgggaggctgaggcaggagaatggcgtgaccccaggaggtggagcttgcagtgagccaagatcacaccactgccctccagcctgggtgacagagcgagactctgtctcaaaaataaaaaataaaataaaaataaaataaaacaacaacaacaaaaaggaaacagattttgaagttacatccttactgaaaactttgttttattttcttcaggtcacttacaagaaaccacttactcataatgaatttcaattatggcatgacctatgtcattatcctgggatttaagggtctagatttaggctgtttttattcacatggctagaactgtatctatttagaaaattaatttaactttaatgtatcaagactattttatatagcattgatgattttctacttcaaaagggaaagctttaagatccaaagacattgatttccaaactgggacaggcataatcctgaaccttaatcattttattcttagtgcttcagctttctattgaattttagtgaaagataacatggctctggacaaactttcgtctcttggagagagcaagttgacacagatctgaagtattttgtacatttgttgaatatgccacccagtcttccacaatgtgggagtgcaacatttaagtatcaaaatgaagcgaagttatcttggtgaccttctgacttctagcttataaaccattcatatggaagccagaaaatacagtcaaagatttaattttccaattgatcttgtatttagcatcatttagaataacaatctggatacttaatctagttttttttttaaatttcaatcagtttgtttgaaatcatgtaaacaaacaaagcctatattgtgaagaaaatacatttaattattaccgcctctaaataaatctagtttaaaacacatgtggtgaatatttgcagaaaagtgcatttaacaagtatgtggcattgtaatattaaagaactaatggaactaacggtgaagatttactaggcataaattatagaagcagataatgaggttattaaaataatatgtatctgtaatttttatataaaagactttaaacatttttttgaacttcttttttgtgtgtttacagatatacactttttttttttgcatgttttggtctacataggcagcatttagatatgctgaaggtagtctagtaaagtcttctgcctgagtaggatattttattaatttaaattacagtataatgttttaaataagaatgtatgtttttgtaagtgagatgggccactcactcatggaatcgacatatatttgttcagtaccaacaggatgctgacatggtgccagacagtgagaaggcaaggattgggttttattcaacgtggcagcctctatagtgtttaaaacattgctttaaaagctgttggtattctgtaaatacttgttgaaataatgaaaaaagaaaggtcctcgactttggagaattaaatatgcaggtaataacaatgtgatactacagtagaaggatggttcctatatttatatagctcagaagaacttatagtggaaggaatggaaagtttccacagaggagaaagatgaggaatttgatatgataataggaaatggtgtggccaaaggcacagcttcagaaaagaataaagtagccatatgtgaagaataaagtgtaaatcaatttaattggacatagtctccaatgtaaaggaaataaacttgggaagattgtgcatgttcttgaatgtggactagggaagtttgatctttgtttgggaggcactggaggcttttgggcatatgcatgataagattaaaggtccttcctgaagattaatctagccgcagtgtgtaagatgggttgtcacaatgggagataaaaatggggaaatccactatgagatgaatttaattggtcacatggaaggtaataaataatagcctgagcagccagatagtgttcctgtatttgagactgacctcgtttttccaagatgcttcaaactgtgagatatttccagaagtctcaagtgtgaaataatcagtgttactctaaaataacattatgcaaagctacctcacttttctggaaatcaggcatccaaaagtgttaaaacactggaacacagatacaaatctgaacttcttgttgagaagactagactattcactttgcggaaactgaaagcatgtatatcttgtttttgtttcattgccagcaccagtgccttgaagagtgaaaactgaagttaggcaattcatgtataagactttctataaaataattagtttctaaagggtcaattcttagaagtacattttagctttctgaaagacatatttccagggtagaactaattcttaaataatgatgaatattgaggtgtcataatttcatatttatggaaacattgtctctccttgtgtataacttaacatgtaatttgagatttaaaaatgaaggaatttgatttcatttgctgttatttaagctccctatgtctgtttaaattttgctctgaagaacagctgctctaaagtacagccaatatttcttcctttgggatagctagttccactgaaaattttgatatcgtcaaaatgtgctgtatgtgtgtctatgtgtagccaatctccctttctcacatccccggatacccatgtccttatgcctgccactggttctcaaactttaaagtacataaatatcaccagaaacaattatttaaactatatgttcctagccctacagtccctggagattcagattccataggcatggggaagcctgagactgttttgataagctccactaggcaattctaatgcatgacttccagagatcataccttaagtggctgtaacttaagctctctctgccttacttgcatcagatgtcatgttcctgactttaagtagcagttattatttaatttaattaatgaataaagtcaaacaatgtggatgtctagaaaatctcctctactgaaagagcctgaaatagggtgtgttgccttactagagtctgatcggtagtagcgtcatcccacattgagagctgcagtttcatgctctcaatcctgagatgttttacagcagggtaaatgatctaatttatagtatgtgctgagatatttctaaagaaagcttgtgtccgagggtagaatgttttatgtgtttaattacacttgagttccaatccaattcgaagccatgtctacaaaggctggcgtttagtcagctaaacatttgaaagcttctttgttcctaagggggaaagcacaagactaatttttctaacaagtaattgcaggtgcaagttatgtttgcaatcttaaaaaaggaagtgtctcagtgaaggggaaattaaatgagagggttaaacgcatgacctagaaaggatgtttgaatcacttgtgtttttccatcttgtacaaaaatccatctttcctatgagatagggctaatttaccagttgtgttccttttaatatgaggaagttgggggctggagggagaaaaaggtaggaagaaattagccaaacacaatcaccagaacatgttttttttttttttaagccaggagggagaaggtgaagatctacacaataaaggagtaaataaaaacacttgtaggggaaaaaaaataatggagtgttttctcatccactaaaacagtaaaattccatctttaggtttttctttgttcagttctctttggaaggaactttctcagctgaaattttatttgctgtttttgtgtcatttttgtcatcagaaaatatttccaagttaagcaatcttacaaagaagtatctcaggactatcaacattagtgagccgggtaccctgaagtgaggtactctttcctcacttcatagtgtggccaccatagccattcttgcctttcttcagtttgctgtctatcggtgtccatcagaaataccttgttggcaaaaatgtcttccctgcccatcttatttggtctattaatgatttcataaacttcaatatgaatctttatgagacctcctactccaaactggaagctctaatcccttttgcctctcctcctttggcaaccagttcctctctttgatgtccctagtttcctttctctagatttcttccagttccatcatgctttccagatatatctccaccaaaaccacctccaaaaagctaaattcttattggctgccgcagctcaacagcggatgctctggtgaaataagcataacaacaatagttgctttgtatgtagcagggatcagcacagttttcctgtaaagaactggataataagtagtttaggctttgtggaccatgtggttttgatcacaactattcaatggtaccagacaatacttaagcaaatatatgtgtaacttattcaaataaaacttttctttgtagaccttagaatcatttcatataattttcacatgccataaactattatccttcttaagattttaaaaatcattttaaaatctaaaaataatttttgtctcacaagctgtacagaaacaaaacaggccagatttggactgctgaatgtagttcgccgactcgggttgagagttttttgttttcacggtgtccctacctatcatctcatctaattctcccccacagtcttgtgagaaagttaataccgctgccattttataaatgtggaagttgagacttggaaaatgtgactgtcttgcccaaagaaagagaactaataacctgtgtttctggaacctaatcctacattgtcatgcgtccaatcctgtgttcttacctccataacacacttcatgctagtgttatatctatgcctgactgacacagttcaaatctccaaaccaaccaaattccattgaggtggccatttctataaaagctgtcctttggaaaaaaaatttatccaaaacatcaggactcaagagtgtaacagaaggagggcttgttaaaccatcagctgctggacataaccccaagaatttctaattcagtggttttggggtgggggccaaaaatttgcttttcattttttaaagttagataaaattcacacaccataaagtttactatttaaagtgttcaattatttatagagttgtgcaagcatcatccattattatctaattccagaacatttgtatcgccacacaaggaaaccctgtacctatttgtggtcacttcctattctcccctccccacctccagcccctggcaaccactgattgactttttatgtctatagatttgactaccctgaacacttcatagaaaaggtatcgtacatgtggttttttgtgtctagcttccttcacttagcataaggttttcaagattattctcattttagtatgcatcagtacctcattcctttttatggatgactaatgttccattgtatggatatactacattttgtttattcattcattaattgatgaatatttgtgttatttcagtggtttggtttttgtgaataatgtctccatgaacatgttttcaattcctttggctatctacctaggagtgaagttgctgagtcatacggtatctctatgttcaactttttgaggaactgccaaactgttttccaaaaccagctgcattatcttacattcccatcaacactgtatgagttccaatttttccacattctcgtcaacacttgttattgtctgtctttttgactactgtcattctagtgggtatggaatagcaactcactgtggttttgattcgcatgtccttaatgactactgatgttgaacgtagttttgcgggttggttgagaatctgtatttgtaacaagctcccaggagatgctgatgctacttgttcctggaccacactttgagaaccactgatctaaaaattaccacttactcctagcaaatagaatatgctgtgtataattgtttttgtaatcatagtcattatggagctgtactttagacattgaatataaaggaagaacttattccacaagatttatcgagaacctgaaaagtgcaaggcactgttataggcatcaggaaataaattttttaacaacagatacaaagtgagagtttacattcaggtgcgtgaagatagacaatagatgataagtgagcacctaacctttcaagtggtgatacatgctatgaacaaaaatgagagagggtgtggctctagagaggggacagtggggaaaggtaaggtgaccagagaaggcctctctgatgaggtgttgtttgatcagggatttggaggcagtgagaaagcaagacctgcagatttaatgcacaagaaggtaaaagcacagtctttgggaccaggccaagctcaatacttagggctggccctccactcgtcctttgacctaaaacaaattacttaaccactctgtgtctcagattcctaatctattcaatgggaataatagtatttccctcataggattgttatgaagattaaatgaggtagtatatgtaaagcatttagagagatgtgtggcacatagtgttacataagacgcggatatatatgaggctaagaaagctaaaactttagtccctctcacttacatgggcctcttctgtggccttctattaaatattgtatacaaagtaccatattcttttctagaaagagagcctccaagttgtctaagctgtaggccctacatagcctagacctgtacctgatattaactgctatttattcatctctgggataaatgattccagacaaagggagcaggagtgtaaaggcccaaaggctgggagaacatcaggaagacattgtaactggacaaaagtcagggaggcacaaagggagaggataaggtgagaccaaaagggacagtacttgggggatgggaatcgtaggcatagagcaggtcttggtaaaatactttgtaattgtgaattagattaggagacactggagagttctgagaagagagtcatgaactgctttgcattttaataggatcattttggctgacctttagagactagatgattaagaaggcaaaattagaaggtggaaaactcatggagaagcagtaatctacagatgagataatggtaccaaggactaaggtagagatggtacgatattgatagtttatgtatatattttgataatggaacagacagaacttgttgatgaatcatatgtgggattgagagaactgttaaggatgattgaaagatttggtgtctgaggaactgacaagtgaggatcaggactggatgtacatgtgcagtggaaattaagagtttgatgttgaacatgttagttttgagatgcctattttatctgtaagattctattttatttctatgatatatagccctgatggacattttttggaatctctacagttagactattttatagttatatgcccatcataaaattctatgcagaatgtaccatatggacttttggtgctataacacagatgacttttatggaaaatcagacaaggtaggtcagagaatttctttatggccagctccaagacaggaaggtggggagagattagagtcctgccggggggaaaaaaagaggaggtgaaaagagggtacgagaaggtcagaaggagagattttttctgaagtctgcttctgaggcctgcagcaccccaacattataaccaaagatggtcttttatctttattgctctgaagcacttccaaagctgcttcaggaaccaagggcaaatggccaaatattttaacaaaaggtatgcttattgttttaaacacttaggaaatgacaagagttatgagccaggaaccatggacaaaaacctacacacacacacacacacacacacacacacacacacacacacacacacacacacacaatgttattacaccctccatggaactatgatggttctgtcctttttatgttacatgacatggaaggtttccatttaaactgtattatctaactagtagataatgctagcaatattagtaaaattattgtgttctctgactgtaaggacttgaggacatgtttcctcatcttcataaactactgcctgcccctatgcttgactatggtaggtgctaaagatgttacatgaatgaaagttacaataatctgtacaagaatgaggtctttcttttgggtattttatttttgtttagaagggatcttatactcattaggcactgactatccataacagcttaatactggacagtgtagtcaaaacacatgactacaagttccaagtccaccaatttttggctttattaatttgacaagtcactaattatctgagcattacttataaaatggaattagtggtattttttctattttacagtgttatacttaggattggataagataatatacagaaaaacatgatctacaaagtaccaaaaattatattaatattttgatctaatctagaaaaattttgattgatagtgtctactgcttaatctgagaataacataccttgctatagtttccaaacacttttcatagaggatgtaaaatggattttcaaaaattacatttcctcaatataaattacaatggtttgatcacttaacatcaactctcattaaaatatgattctctttgtaggctgaattagctctcttttgagattcatatgtagaaaataaccaagtataaaaaggcttgctgcaaatgtcctctgatatttgattttgagtttgacatttcaattcaattattctgaatttaaggtgtcttaaatcattgaatacattttgcggataatatgtccctgtacccttgcatatttttcataacctcttatacattagccaaaattagaaaaagaaataatcctcttccctgccttaagctaaactagaatagttggcacatttaaacaacaaatgatgagaaaaaaatgacattgataaaagtttcactgagtcatcatgaatctcattgggtgagcaattctattgagggagcatatatgaattttcatatactttaacactttaattgtgctaatattttaagtaatatttgttctttaaatatattttcttatttttctgtcatttaccaagtatagattcatcatttaccaattctgactcttttttttttttttttgagacaagagtttcattcttgttgcccaggctggagtgcaatggggcaatctcagctcactgcaacctccgcctcctgggttcaagcgattctcctgcctcagcctcccaagtagctgggattacaggcacccgccaccacgcctggctgatttttttgtatttgttagtacagacggggtttcaccatgttggccagccttgtctcgaactcctggcctcaagtgatccacccatctcggcctcccaaagtgctgggattataggtgtgagccaccgtgcccggcctctcagactctttaaaaaagatagctgaatgggactgaaccaaccagtgcagatccccaagggcaaaatttgggagtaccttgtgtccatgtctctagttatatggggatagagagacaaaattgtgtttaaaggagtttcaggcctcaaggctagaaaaattggcttatccaaataggttctcaaagcaacatgaaatgagatttaggagatgcgttttggaaatggccctaagagctaggaaagaatggagtaaagtataatggttccaaatttgaatttaaaaggaaaattagagacaatgtctctagagactagggactctgtcttgttcacagctgtattctctgtgaatagtgcttagaacataaatatttcttggctggcaaaacaccgtttaccaattgtgtttattacatgcttctgctaaggtattgtgtgagcaaaccagacacaatgaaagggctcaggaaagaaagaacaagatcctggtatcaaaaacaggtatataaagtgtggctcttaccctccagtaaaaggcaattaagtccccccatggaactcagtttcaacaaatcactactcatattgtgtgggagagaaggatctcagaggatgcttataaagtgacctgaagatgagacaggaatggaatcccaggcagaagcaaagcaaaagtatgtgcaaagtcttggagctgtataaaaggatggtttgtttggaaaatctctcgcagtttaatatgaggatcatgagaaatgacactggggaaatagacatgaatcagactataagggttttcgttgttgtgctaagaaatttgggcttggttaagactaagcttcaaatagttaattctaggatattgacatgaaactatagcccagatatgttaatcatgttacaggaaagtttagcttgttagcaaaagtataatactgacctaaaagagcatacttaagtcctgaaagtggagagccttgtctaaggaggagagaaacaaatatatatagtcagaagcagtgataaaacagaaacttttcccctaccaccccaacagtatttagttaaaatatattttatatcagcctctagggccattatgtcccaatatgcatcccctctagttttattatataagtttattaataacctcttatgtatttatgattgtagttaatatacaaagagaactaaatttatggtagttcagttttaggtattgcttatatgattttttccataatgctgtcaacccgtgggacacctgatgacattctttttcaagaaccaacatcacaactaagtttgtatgtgaccttaaagtagcagaaggagctggtcatgagatgaaaagaaatgctattctacttctattagattattctcaaggactgataaatactttggattctaggtatccttggtgcaaatgatttaatgaacatgtgccatgaagaaaaataagattatagagaatgaaattaaatccgtgctctacctgacttaaaagtgtgcatattatttctctcttccaaaatatctagcatccttatataaagaaagaagtccctacataatcattcctttcccaaccatcacattcaaattatcaaatataaactctgttttcagtttggagaaagaagatatagttgctggcaaaatttgggggtgtgagtcgggaattagaggcagaaaaggcaagggatgtaacagaaaagctttatgaatatatctttctgtgccaaaggaaatggaacacatcttgcatgaaacaaaatgtgacttgttaggcagcctaagatcttatcaaaggagtggaaaatatcacccactgctgactggctagtaaaagggaattgtgctcaaatgggtcaagactcacttctcaatgtccacaagctttttttcctccttatttcctctgtaaatgctgtttttttgtttttgtttttttttttttttggcatgcaaagggacacacacacactgaacacactgacacacacaatgttatgcagagagtttcctcccagatctattcatggtttaaagccccccacctccctttacctgtaataaatatctgttggctttgatgttcactgtcagggataaaacaaattcacaaatatttggtacacgctgctcctgtatgtgacattgaacaaaatgttgatcattaataaatggtgggggaaaaactcaaagactaataaatgtcattgtttctgatgaagtagaacacaagaaggtaaatacccacaactacccccctgctaaggtacaaatatcagtaaaaaatgtgtatatttgaagtatttggtctattacaattcttcagatataaaacaagcactataagcattatggtggtgttgattttaaaattccaacttcacaaattcttccagaagtaccttatgaataaaataatgtaatattcagatgacacatatatacacatatgcacacatgcacatgcatgtatgtagtaggtatcaatagatgatagatgggtagatagatattcttctctctaccttgctgcattcaagtggctgtcatataatataaatcgtatttagtatgtatttttttttaacttggggggttctggatattttgacccacattcatatttttaaccacggtgttgaaaattctctaagtgatcttactgttccacaccttattacattaatcccctataaggcactttcccaaggagtccctgaacacttctgggagaattataggcagcccatgctactctgagcacatttaaaacatagaaacttatttacatgggcctaaatctacctctagaacacctgggtttattctacctagggctcacttcagaaatggtatgtttttcaaaaatgacaaatcatgaagtctccagtatgatttatatttcaaatccatctcttgagaaaattctggttaatagtgactgactagagtgttaggaacaattccaaggtgttttcaatctcatcaggaaaaagagctgctgtgatccattagtgatgcctgctatgggcagggtgtaggactagccaagttttgagtctatttcttctttcccataaaactcccttaaacatgtgcaaataggatccatgtttcatctaaggaatgtattctacccaaatctgaactcttttcagctacctcacaacacatgggctggcattctctgtagcctttggcatgatgtagcttgtcctatgaatatccttgtagccatcgcctccaccataaagcacagagctaatctaatctatgtttgcagtaattccatagaaaaatctttatttcaggatcacaagtgaagcttgaatacttcttaaaagttcctctgagctcatatgtatgtgcaattaagtgtactgaaagcaaaacgttatcttgtcatttgactgctaagagagcttgccataaacatcaaaaacagcttaacaatgcattcttattttttattctgcttttaaagggcattgctaaaagtcaactccatggtctggttctaccttgaagattttgtatctttctatgtctctgtggacatagttaaggatataccgatgactctagtagtgagtgcaacagcacagttgacacacacacaaaaactgcttacatttttaaaatggaaatccagtcatagaaatatcacagcacaacctctcaacgctaccccttgccaagaggctgtgaaagaaaaaggattttttttttttttttttttttggaattttgggtgatgctcttttaagagctagtgggacaaagtggaatatgttaccacttttggttctacttgagaccaaattccatgtgccctcatataatgtacttccaggatagccctgcttcaataaatagaacatcaaatattatactttgaattacaaatacatcaatgtaaaatgatttcaattttgaatatcctccattcatgctacatgactggttaagcaaaactgtgctgacatcatgacagacaattccactcacattttagttttgaatttctggtatatttatgattctagcttttcattttatatgctgggttatcttgtatcaacaatgtatataaaactgttcatgtttcctattatgacagctgcaccaagtccatgtctcagagctgtatatcaaagtggcaaacataataacacaacacagatctgttttgacactaatatggatttcatgcttatttcacatccccttggccaaacattcaaaaacattgtagttcccagtaaataacattccagaaacaaaatccagatgctgtgtctattatttcaagcacacattatcagatacaagaatgcacaatgcttttctacaatttacttttcattttgtatcctgtttttagtgctaaagcacttcattccccaaattctaaatattactgaaggtgaaataagagcctttagagggttctcttactttaaaaaaaaactgacatagaaaattacatgtatttatcatgtacaacatgatgttttgaagtatatatacaatgtagcatggttaaatcttgttgaaccattcttacatccctgggatgaatcccacttgatcatggtgagtgatcttttaattgtgctgttgaatttggtttgctagtattttgttgttgacgatttttgcacctatgtttcttgaagataattgcgtgtagttttcttttaatgtgtgttttgtctggttttgatatcaggataatggtggcatcatagaatgaacttggaagtgttccatcctcttacattttttggtatagcttgagacaaattagtattaattattctctaaatgtttggtagaattcaacagtgaacccatcaagtcctgggcttttctctgacgggagacattttactactgattcaatttcctttcttattattggtcagtttaggttttctctttcttcataattcaatcttggttatctgggaatttatccagttcttctaggctatccaacgctttggtgtataattatttataatagtctcttataatacgttgtatttctgtggtatcaattgtaatgtctccttttatctttgattttatttgagtcttctttttttttttttttttttttagttagttagtctaggtaaagggttgttgattttgcttctcttatcaaaatagccagtcttcatttcatggatcttttgtattgtattctagtctttatttatttctgctctgatctttatcattcccttccttaattttgggttgagttttttctttcttttcttctggttccttgaggtccattgttaggttgttgttctttttcaatgtcagcatttattgctaaaaacttttataactgcttttgctgtagcccatagattttggtatgttgtgttttcatttttctttttttttttttttttttctgagacggagtctcactttgtcgccaggctggagtgcagtggcatgatcttggctcaccacaacctccatctcccgggttcaagccattctcctgccccagcctcccgagtagctgggattacaggtgtgcgccaccacacccagctaatttttgtatttttagtagagactaggtttcaccatgttggccagtatggtctcgatctcctgaccttgtcatccgcccgccttggcctcccaaagtgctgggattacaggcatgagccaccgtgcctggcccgtgtttccattttaatttgtctcaagacatttttaaatttttcttttaatgtcttcattgatccatttgttatttgggagcatatggtttgatttccatgtatttttcaggtttccaaagttcctcctgttatggatttctagttttctactattgtggtcataaacgatacttcattctaatacttttaaagcaaaaatataatgattttgtcagcacattgatagatttttttttctagctttctatgtgctgggcacctatttctgcactattgtttaagttttgcaatgaccctattaggtagattatattattactccccgtcaccagtgagaaaaattgaagctcatagaggttaaataatgtggccaagattcaaaatttgtaagagtatagtcagaatttgaacccaggaagtcaggttttagtgcctattgttatcaacatatcatgctgccctgtacataaaaattataatgaaggtgggccaggtgcggtggctcatgcctgtaatcccagcactttgggaggccgaggcaggcagatcacgaggtcaggagatggagaccatcctggctaacacggtgaaaccccatctctactaaaaatacaaaaacaaaattagccaggcgtggtggcgggcacctgtagtcccagctactcaggaggctgaggtggaagaatcgcgtgaacccgggatggggagcttgcattgagccgagttcgcgccactgcactccagcctcagcgatagagactgcatctcaaaaaaaaaaaaaaatatatatatatatatatatatatatatacacacacacacacacacacatatatagacggagagaaggtgaagagttgagtaaattactaaagtttcttaagcccctagtatgtatcaggaattatgacaggcaattaacatcaataatcttacttagtcttcacaacagctttatttgttagaaaccaacattaccccattttgtaaatacaactcataaggttaagcaaacaagcaataaaattaggaaagtaagaagacattagttacacccctggtaagggaaaaagctggatataaactcctatctacttgcatctgaactagactagactttctgtatttatatcatctctattctaaaacagaacctaaccttaataaagtggttgactaaattgacttacctattttctcacttccatgatatttatgtattgaaagtacaagaagctaaaggtctttggatgaaacagaacatagcactgtgtttacaacagctttaagccacattcaaaacactttagcgtcatctcgtgttatttatttatttatattatttttgcaaattgagtggcattgttagcactttgaaaggcagaaaatatagctgcatattatatcataagaatagacaattataaaaagagtgtaagatgaagtacctttacatgagctgtaattgcagctggtaattaaactgaagtgtttcattttctcagtcagctcatcagtgacaccagaaaataaacaatttgaaagtgaaatccttaggggccaacaatagtaattaattgcattttccagggaagaagcgttcctaaagtctgtttggggtgacctcttgagtaatatacacagtgatttacactgtgagcagaagtgtggggttcagaaccaaatctgatttaacttgaatattcatgaagtctccagtatgattcatacttccatttccattgtcaagtttattgtctcctaggttaacaatgaaagcaaatttatattctgaataattcacataacacaatgagatgatcagcatggaaaaactttaccaggccagtaacacataaagtgaggctgctattaatcccttccaacttggaatctcctcaagtatcaagagcattgttttagagatacttgggagctgaaaagaaaatatttatgtgtgtaaatttggatccatatctcataagcctattggattaaaatcataacattcaggcagtctagtttgccactgttcattttcacagagaagagctttgtttgagatttgtgcacatctttttagctattctgatcacagggaacaaactgccatgacttatactctaatttctcttcttgtttttacttatgatatgaacatggcccttggactcagataggcataggtatagaatccagccccacttcttactaacaccttgtgttagttagctcataccagataacaaagaaccttaaaacttgctttaaaacactaaccctttatttagattatcattctacaggaagacaatttggggtgggctcagccaggtggttcttctggtttaggccaggctcatttggtctcagctggggctcaattatacacctgcaggtgactgccagattgggtaggtaggctgatctatggaggcttcagctggcatggcttgcctctgcttcctgtatcttccattttccagcattgcagcctgagcttttccaaatgatggtgtggcagtgatcagtaagagaaggtaaatccaaatatgcaagtctctgctattgttccattggcaaaatggccaagcccagagacagactgaagggtactgtcaagaaataatagtgatactaaaacccatgaaaaaatcgggggccattattacaacaatcaactacatatatgtataagaaactatgagccagtttcttaatccctcaggcccagttgctgctcatctcatagagttgttgtggagattaaaattaactcatatatgtaaaccaatgggtcaatcacctggcacattggagacacataataaatgttggccctcttttctctgacagatatttatgcactcccatttattggttatacaaagcaaatattctaatatgagaacaacctgttaatgatatgtcatcccactgacctctatagttattcagttatccggctagtgaggttagtgtctccttccttaacaatttcatattaatctgctgaagctatgcattaacctggaggatcaacttctgcacagaagtatattcctaaaattacgtattatgcatgtatgtttgcataatatacttccataaaagctgaaacttggctgggcacagtggctcacacctgtaattctagcactttgggaggctcacgcctgtaattccagcactttgggagaggatcacttgaggccaggggttcaagaccaacctggccaacacagggagaatttgtctctacaaaaatattttttttaaaaattagccaaacatggcggtgctgcctgtagttccacctactcagggggctgaggcaggaggatcacttgagcccagaagttcaaggttgcagtgagttgtgatcacgccgcaccactgcactctaacctgggtggcagagtgagcctctgtctcagaaacaaaacaaacaaatgaaaacaaaacaaaaactaaacttttattgagccattgatttagctatttttaaaacttccttacaatgtacaatcagaggcaaatctgtgttaataaagcctatatgttgcactggggggtcgcaggctagaagaggtcataacggtttaaaatttccaaagtgtcgattatggccattgaagaggctgagtcatcttaaagtcggcttgacattacaatcaaataatcagaaaagcccgtaaattgaattctactttggcctgattgtcttaaaagctggctctgatattaacggacggatgttcacatctttaatttggatcagggccactgacacaatagagtagatgagcctccataattttcaagtgaacacatgcttttccccattgatctgtggataatagatcattctattggctcccctgcagcatttaaatacagtctgcctaattcaaaattggtcagtaaatgtaatactaaactgccttgacctgaagacgatagaaatgaaaacccattttaaaaaatcccaggaaatcactgtacttgtcatatctactgcatgaaataaaaaatatatttcaccaaaatacacttctacctctattattttatagattattaaaacagtgcagaacatacaaggattaatataatgtgcaaagagatcttatatatatggccagggtctttcatgactgacagaacctctctgatgtttgctgactttttagccaaaaagaaagagaacatttggttaacacaggctcagagatagatagaattataataatacctgacagccctttgatacttggtagttttatggtgcagggaagggaaagattttgaagacttcattgggatcaaatgttaataaggaacaaggtgaaacatgcctgtaaaaataatattgattatatcacaatattctctatcattccaatgaataatccaataaccaatgaattcctaatagcaacattaatagggtgattaccgttttgtgaacatttattaaagaagaagaattttaaaataaagctatccatgaatttgctgttatgtcttaaaatactacataaacaccacaaggtgtctgaggtgtgccctatattaattttatgtttgtttggtaactccagtcatggtctctatagccaaagtcattcttcaaatatacagttatttgaactactcaattgaagggaaaatctggggtgacagataacaatgctttacagagtacatgtatatttaatcatagaagctcaagtatataggaaaataaaatgttagttacaaaatgtttatttgataattacacatcatgacaaagaatattataggaagtaaattcaaaatttaaatatattcatacagccaagatatgatccatatttattatgttgtcatgttttgctttataatctatcgtctgtttatgtgctagtttgtttaagtaaaaatattatcttcattttaaaaaagctgagcatgtaaaaaggccaaaattcggggttttggctatacttgaatagactgcatttgattttctttttgcaagctatacccttgatgacagttaaactgaacgagcattcattgagcaactatttagtttatagtcactatactagaatatagtgatacaaagatgataaaccatgatccctgtcctcagaaaagatggacgtatacatagcaactgtaatacggtatgtaagaactatacaagcagtatgaattgggttactcagaacaatcgagtgagggattcttctggcgcaggaggaatggaagtggcttcacatagaaggagctgagaatgcagaatgatgtaacagggctttccaaggttacccccaggttcagtgattcactaagaggactaacaggactcagcagatagcatactatggctataatttattacagcaaaaggatacggaacaagatcaacaaagggagaaggtatgtgtgagatgactaccagaggaaaccaggcccacgcttttaagagtcctttcccaggggagtcacacagaatgcacttaatgccttcagcaggaagttgtgacaacatgtgtgaaatgttttctagtaaggaaattcattacagactcagtgcccagagattttactgggggttgttcatgtaaacgccctaaaccatactgtctgcacaaacagtttaggcatagtaaacccatttgttatcagaaaatgctgggaacctttctgatatctaagttttcagaagcataaatattatggcaatgtactcaaaagaactgggcctccattttaggattccagctgaatgctaaccttgcaagcagtcctttctaaggacagcagcctcaggcctgttagattaactcttttctgcacaggtgaatagatctgtccagatatagttggtggagaaatgaattcaggctgtggaaatttcaagaaagggctcggatgtgtggaaaaccgttcaaaacatttcattcagtgagatgtttaatcttaagtgtttctgggactatttggagtgtcaagttcacactcctgaggcctgacatgatttcaggttccctgaacaggccccatcttgtaaagaggattaaaatggcaattgtgttaattcgaaacatttggcctctgttgtgtacttcattcatgtgaagatgtgattctaatttagaatatccagatatttgttttagttcagtgttttgttgtcacagtatataaagtttctgaccataacacctttgaagttgtatagttcaaaggtccctgttacagtgcaacggagacttcagtttcctggaggagagtatgtactttcaaagacgacatttcagagcatagtacattcatacaagtgatcgacacaaaatgtcatttttgtcactagtacttgtggcattaactataagctgtggagttgtgcttttgttttccccccagccagattgacatgcttcagtgcctttcagatcctacacttgtacaacccaaaacagaactatccctgtatttcactaggagaaaaatgaaaactgttaagcttataaatatttcactacagattgctgtatattcgctgctcactgttgaattcagctgctatgaaatgctaataactctctactgagggcttgagaacaacctctatttcgataaatattatggcgtgtactgaattatgagttccgtacattcactgatagacaagatggaatgttagccttattaatgcaactggtgcaatgtactcaaaagaactgggcctccattttagagatttagctggtaaggtacatgaccactgtaacatgcatgggccttagtagtataaaatagatatgaaatattgtacaaataatatctctgctgtggtttggaaatctattggaaaatatatacatttgtcttatcttctgatttgttaattactcttaggacattatgagtgaattttagaactaaaaagtcagtataaaaacagatggttacattttgtgattattagcttcctgtgactgctataagaaattgccacagacttagaggcttaaaacaacacaatttttttatcttatagttgtggaagtcagtccaaaatcagttttacagggctaaaatcaaggcgtaggcagggcttggtcttttctggggactctagaaggtaatttgtttccttgtctttttcagcttctagaggctgcctgtattccttgacacatgactgtttactccatcttcaaagccagcagcatagcaattcaattctctctctttctcacttctctctctctcttcaattctctctctctctctctctctgtgtgtctctctctctcatctctacttccatcatcacatctccttccctgactcggaccattctgcctgcctccatcttataaagatccttatgactggacccacccagatattccaggcttgtctctccatttcaagatccttaatcacatctgcaaagtctcttttgttttgtcaggtaacatagttacaggttccagagattgagattaggacgtggacatgttttggggatcattattttgtctcctacaaccccaataactctattttgtgttataaatactgtgaattattcagcaccaatacatggtattcaatcagattttgaccatgtctgtctatccatccattcagtaaatatgtattgagaacctaatatatgtcaggcaatgttctagatgctgaggtgcagtaattaacaaaggagacaaagtctttgttctcatggaggttgcattctagaagggaacacatataaattaatattggatatgtcctgaatatttggtctataacaaaaaataaggcaggattagatggcatactgtgttagtatatgtatgatgaggggtgccattttatcactaagtatggtcaatgatgtcctctctgaagaagcaatgtgatatgttgaatagtggcccccaaaatataggtccaagtcttaacccccggtacctgtaaatgtgatcttatatggaaatacagtcgaccttcagtatccacaggttttgaatccatggatttagccaactgtggatcaaaaatattctaagaaaaaacaaaacaataaaaacatacaaataaaaacaatgcaatataacaactatttacatagtatttacattgtaataggtattataaataatctagagatgatttaaagtatacaggagaatgtgcataggttatgtgcaaactacataattttatatcggggacttgagcatccttggattttgatatccacagcgagtccaaaaccaatccttcttggatacaaggaacaactgtattgtaagatctttgcagatgtaattcagttaagaatcttgagatgagattattctggatttgggtggagctaaattgaattataagtgtccttataagagacagaacaggagaagccacagagacacacaaagaggaaagccatgtggtgcatttacatgccaacaaatgccaaggattgtgggcaaccaccagaagctaggagagagacatggaaagggttctttctctgagcctccagaagtaacgaatcctatagacagcttgatttcagagttctggcctccagaactgtgacagaatacatttctgttgttttaagccacctagtatgtgtaatttgttgcagcagcgcaaggatactaatacaggcaatgtttgagcaaatacctatttgaaataagaaaacaagccatacagatactgaaaggaaaagcagtataggcagaagacacaataagtgggagactctctgtggtattcaaataacaacaatgggagacagtgtgactagaacccagaaagccagggggaagagtgtttgaagatgattccagaactatagtgctaaccaggtcgggtagggagggttttgtgggccatggtaaggactttgaatttaattctgtttattatatataagctagaataattatgatttactgaaatgtagtgtttctgggcatgacagttttaactgccagaagcaaataatcgtgacacaactgaatattaacacaaaacatgaaggttgaattctggtgagctccattgtgttcccagtaacttaactatcacatttttaataatgttggtcctggcctgaataacaaaatatattggttcctccacccccaacacgcaactactgtattaggccattatcacattgctataaagaaatacctgagagtgggtagtgaaaagacgtttaattggcccacagttctgcaggctgtataggaagcatggtggcatctactcggcttctggggaggcctcaggaaacttacaatcatgcagaaaggcaaaaggtgagcaggcgcgtaacttggcagaaacagcagcaagagagcaaggggggaggtgccacacttttaaacaaccagatcttttgagaactcacttagtatcatgaggacagcaccaagggcatggtgctataccgttcatgagaaacccacccccatgaaccaatcacctcccaccagtccccacttccagcactggggattacatttcacgtgagatttgggcagggacgcacatccaaactaatcaactacttatttctttttgtgtctgcatatataaaatctgttaggtttggctttccgtgcaacactgtttcatgtgttattagtatcgctgttacactctgatactcccacaagataaccctacccatcaatgagaattgaggccagtactgcagaatgaggatcctacacaaaatacagaaaccttacttgttcaccaaaggtgtgaaccagtagtaaaatgaatggatttgtttcccgtccccttgctggtccctgctaactctgactcttaaaagccataacattttagccaaagaggacggaagaaatagactcaaaagttgcttattaaaacttgcaatatgtgtgccaataattgctagaactgtgttagaaataaggacattgtaatgagataggatgttatttttctaacatgatgtctctatgttaagagataaaggtcaagtcctaggaaatgaagggctactttttaatggcgttgaaaccacgtaatgggtaggattgtctctagaagatcagtaatgcactgatacataatcaatggaagtttcttaggagatactttatttcttttagcattggttcctctccctactatgtcaaatataaatatttcacattgtatagccattaatcaaagtaaaactaaccacagtctatatatatatatatacatatatatgtatatatgtatatatatgtatatacacacacacacacacacacgtatatatgtatatgtactctgtatgcatatatacacagtgaattttagcttatgtccctatgggcagggaagagaacaaaagatgcatataataattcatctctgctcattttcccatgctccttcattttgtgtatcatctcacatgcaaattaaaatgttctaaatgacaaaagaaaatctcagttgtgggaaattaagcataaaatgtggactgaatcttgattttgaaatcctaagggttactaaaaatagaacatttcacacccctttcaagggagcacctgctaaattcatttgagtcaaatgtagaaatctctgtaattcgagtagataaggataatctagaaataagaccacgagcagaggaatggtcaatgttttttgtagccaacagctttgaaatatgcttatagaaaacattgcttaaatcaggactattttaattcagaaggaatctacccatggcctactaaattatcatcagagaggtggtcaccacacattggtttagtgaccaagcttgacatcagaaggcctgaattctgcttctgcttttattattagtgagataactgatctcatgcaggtcatttaatttcactgtaattcaagttctttatatttacactgagttgtgtaaaaattttaaaaaacaaaatacagcatcattttaagctgcataaaaggtagaaaatatatcatttttaaatatcaccaatgttatcaaaatcatatatccagacaagggatctaagtaatttatctatatagatggcatagatagactacatacactacttatgttcctcattttgaatgtgaacagattagccatagcagtaaattccatcgctgaagaaagttaaatacctttaagaaaaatacaagcctgtccttccagttgtaattttctttcttaatgtgctttatctttgatttgacataatgaaggtttttatcctgtgcccagaaatacaaaaacatgagatctaaatatcttttttggttacttccccgtgctttttcattttgttttggtttaatatacaaattaaaatgttttagaaaatattgccaaatttgtacattttgaagttttattctggaaatatgatccattctgcttattcttttaaaatactacatattttcattaaaaaatgatctgatgtaataaaaaaaagtttttgcttgagaattgtatcagtagatacaattctcaaatagaagagttcaactctttacagatgatcagaagtatatttcctttaaaaaagtgaaacttaaaaatcacacatttttagatgatgacagtttcttttgtaggagagtgtgtacctttacaagatacaaagagaaagaacatttgttatcacaatcataaatgcaaattgtggactcagcctagaaacttaaaagatctgtgtagaatgatttttctccccttttatttccagtttaattgttttctgtcatagacttttattgaaacaaatacatgctactgattcttccctaatcttacgtggctaaagctaatctttcttactatttgcttagtagaaaaaaagcaaacagcaccacatattttttttcttttccaaaatatagcaaaaaaaaaaaaacatcctattatttcattccaaaagcagtagtccttttcagacttgtgcagagcagcttatcccacagggatttcaaatagtaactcattggatgcaggtgataaggactttctatgaaaggccaaagcaactaaatagttatggtttttgtttgtatttaatattattttgttgtggatgcgttagtcatattttttcaaagggaagcaatcaagtgtgatagaaattatgatggaatgcagactggactactgtcaagagagctgagctctggtctggactctgtcactgacttagtatgtgcctctagtttccatgtttttattttattttgagacagagtctcactctgtcacccaggttggagtgcagtggtgcgatctcggctcactgcaacctatgccttccgggtttcaagcaattttcctgccttagccccccgaatagctgggactacaggtgtgcaccaccatacctggcaaatttttgtgttttcagtagagatggggtttcaccacgttggccaggctagtctcgaactcctacccttaagtgatccacccacctcagactcccaaagtgcgggggttacaggcatgagccaccacaccctgtctccatgtttttaaaataagaacagcaagatttgctcttaccaacctcatgggaataacagcaagaaaaaaaaatgggtaagctaccaaaaaaatcttttatttttaagaagaaatgtagttttctatttttggtatattatcaaattctcccttatgttctgacttacattaaaccattacatgtaaacatgtaaataaatattgatagtctgtcttgaagcctgactctgatacctgaaacctgaaatacagtcctaattctatagactgtatagtctgaaatgtattataaggaagagactcttttaggtgctgggatacctggtgaccaagataacccagttcccctacaagtttgtattctatgaaatagacaggccctatacaatgaaacaagcaaatattttctcaggtattgattagtgctgtaaagaaaagtaaagccagctaactgaatagaaagtgtcagaggaggggggacactttcatgaagattggtaagagaagacctgtctgagatggtgacataagacctgaaacctgaatactgagaacaactgagctatcgaaagctttagagacaaacattccaggcagagggaacaacaggacataaggctcttgaagcctgaagaagcgtgacaagatggaggaacttgaggcttactggcctggacagaaatgaagggggaagagagctttggatcaggtcgaagaggctgccaggggctagatcagacaagatcttgcaaaccgtgaaaaggagtttttattttattctcaataaaaagagaagtcattggaaaaataagcagattgttaaaatgacctcaacatgacagaattgagttggggagggtgtcctcagagtattacccagagaacttggccccaaatcttttacagatttctcttcctctcctcaaactttcccactcttgagtggctaaaatcttaatctctttctctgtctctctcaacaagagtgaacccgatgcactgcttttccttttaacatcttctttggcatttaagggcacctgagtgtagtcccttgggaaagtagattttcttcttcttcaaataaggtcatcacattcttcaaagaagaaaattctggtgagtgaaattcttcctttctgcccaccatctacctacttacttaaaccttagcagtcatctgtcaaggggatcagtgtttatttgtgcatccagtagcactttcttgtcatagccccatgaccctgctccttcagattttctcaaggacctctggagatgtttccaggttaggcatagccatgtgtttcaaaatgcagtccaccagttccaggacccaggacagaaagaactgcctgtgccaaatcttgttgaggcttaattgggaccttaaggacccttcaggacctctaaggcctttccaaagagcaagaacatgtgattcccggatgaaaagcctcatggttcacggctgccacaattgaggtggtgcagaccaccctctcccctgctggagcccgtaaggctcggtgtgggtggcgactgtggaaagcagggcaggaatacattgccttccagaaggaattcaccttattgctgctcgtggggacagtgttagctggtatgctttggcttcaggcagctgtgcctcagttcacccttcagccagtttttatttttcagtcttgagcagcttcacagacagtaacaatgcagcctatattcttccactaaacgcagtctaagattattcaataatatttggctattagttgttcccacaataacttcatctcgaacttcgagccttccaaattcagtgttttgtttcatcctggatagaccttgatgagagttcttcctattctttatgtaaataataccaagaactttctccctttcctttgaggaggtaaagttaggaatttgacatctgaatcccagtatctgtccagattgccatgttcacctttaagtcagtaagaaaatatgccttcaaaactgcattttgattcgtttctaatggaaaaggtggggcagtggcataaacaaaaatcttgaagaccctcatatatacagtctcagtacttctaactttaaaatcatcttgacccatatttctgtatctctctggttgtatttttaaaaccaccaaggctcctgtctgatttatcatgcccctttatctcttaaatcctggagttatgtcagccatgatgaaaatatacaataagctcagctttttatccaagttgtggctggatacctttgggacacaattctgaaaaagtagtcccaaatatcgcccgattatatagtacttcccctcaaaaggctggtaatgcacccatgcaaacaagaacaaattgaataactcaatttccagaaggccactgaaataatgtagagccctgaaggagaatttctataggggatttcaactggtttatcatactgaaattattttcaagaatccttctagacatttattggtttctcaaaattgtcctgtttaaggcagtaaccaaaacatcttgccttttctgtcatgcctacccctttgagttcacttccttcgtttctgtgcagtgatgctctgtcttggcttatctgtacataggtcactctcagacatgcatagacctgggggagctgtaggtccttttctgttctgatggcttttcttgtgggttctatctccttttcccttccccactaccatgcccataattctatcaaagaaaaagaaaaataatagtaaaaacaagaagctgttctttgttgtggctcattggtaagcaaaagattccatttactttaacaaatatatatagattgcctactgaatattatggactgcagcaatcagaatagcaagttattcttaaaacatagtgatgctcttaaagtgttttagctttgaattgagctgtctgctttgattcaaagtcacacagagactgctcttggaaattttcccataggcccaggggccactcctcggatttacagcaatgaaaacgtaaatgaatctgctcacttaagggagaccaagctgtgcagaagtggtgaatgttaagccaacttgccagaaactgatttataaaccagaatgctgattcattaaatgaaatgggagatgaatctggtaagataaccggcatcaatcatttgaacagggtactccctcttaatgaataagctcattgaagaaactaaattgcagatcagaaggatttttggtacagggaattagaagagaaaaaaaaagtgttaaggggcattcccttaaactcagtttactcaatttgttcctccccattttggaagtctttcagtctacgaatctggcagcagacactggaatgatgtcactcttgggcagttcttgcctttcatctaactttgatctcttcttcattcataccaccaaactttttttgggacaacaaagccctaacattgttacacaaatttaggtcagagtttattttgtattcatgacagttagtctcctgtacctttaggagataaactacagaatccagtaaagagatttgggaagtaccttaaactcatcagcaactatctatataaaccatttttttatagtcagttttttcaacagatgaataaccatgtctgtttcagcttaatgcttattagcttcaattttcaagaggtgactattttcctcattcaatttagcagctacttactgagctcctcaagagcaagaaaagtctccagaggaaacaaaaatgagcaaggcaatcctttatgaagtttacagtcagatttgagcaataacaacaataataatgagcacaaataattatggcacagaattaagaaatcatgtaagagagtctgttccagaaaatgaggcaatcacacagctgactgtgagaatcctgtggcttttgacttggaccttctagggcacatggggttttaccaagagagataagaaactgtttcatgcagttgaagagaccttggtgagacacagcatttagagagaaaagccccagacacattcagagaaaataatgggatggaccctatttgaagactgcaaggagtacatgtaaaaactgatctgccaattctattatggctttaaaaaaaaaaaaaaaaaacacggccaggtgcagtggctcacacctataatcccaacacttgggaggctgaggtgggaggtcccttgagcctaggaattcatgaccagcctgtgcaacaaagtggaacccagtctcgaaaaaaagaaaaaaagaaaaaaaaattagccaggcatcatagatcacttgagctcaagaggaggaggctttagtaagccgtgattgcacaaacgcactccagcctgggcaaaagaacaagaccctgtctcataaaaaaacaaaatctaagacacaacaaaacaaaaaacaaaagccctgtctctccttagaaccacaacagatcaagttatctgatgctttttttttctttttttacttttatgggtaacacttgtatttgaaaaagaaaagaatggcaattaaaagttaattattaaggcaataagcataacatttattaaatcgatttagaagcaacttgattataaatcttttttcagtagaattcagtcatcaatcgctgttccatatataaccatctattcctgatggtgtaaaagaaaacatgcaaaattaatataagttctttaatttctgaattttggcaatccctttacgctttgggtgactgattatctgtcattttctattatatgatttcactcagaggagctattttttgtggtgttataattagaggaaaaccaataatcgataagaagatagtttgaactgagcaacaagattgttttgattcaatgtttttaactgattaaaagtgactaacgtattttgttttcatccgtgacatgtaaacaatagaagggaatctcgctgtatctaacttttttccccaaacccctctctcattctccttccaaattttcgaggtacgaaggatgactttctgacttcacataaattgcccctgaaacatttctgtagttagtgacagctgtcttctacttacttccaggagaaagactttattcacacaccgttaaggctctttttactggcttgagcagcttacaaaagagagaaaaatgtaacgttatcaaagactttcttgtggctttcactttatgctgtcttccaataatatatactggtacctaaacactgagcagcatggagaaggagtggcctgacctgggtgaatttaacttacggagacagggctttctaagatgacacaggaaaggtattgatgagataaaagccactgaaggaataaatcattcatatgatattttatttttattaatttctggttcagctaaaagtagagaaatatcagatgaatgctattccacctagtcgtcagaattgacaagccacccaaggtcaggattgggggctggtctggttctggaatcagatggctacatttgaatcccaacttccccttttcactaactgtgactttttgggcaagtgacttaattttatacccttaagttaattttttctcttattcaatggaaatattaataatactttcctggtttagagtaatgattgaattatatggtatatataagacatcagtacaaagcgaggcacagagtaaatcaagcaataaatggcaactattataaaaaatggggccaggcacaacggttcacccatataatcacattttgtgggggccaaggcgggaggatcacttaaggtcaggagttcaaaaccagcctgaccaaatagcacacacacacacacacacacacaaaattaacgggaggtattatttctctataacacctatttaattgttctgggcaggcatttgtatacctctttatgttctatctgtcttcgtaaattatagaacacccatggctgtcactgaaagacaacttaagcagacccttcaccatgcccagtgaagaaacagaaagagaggaatttgggggattagtatccaagccattgaatcattaagacagaattgattgataaaaggatttgtgtttattaccccagatagtgaatttctctcagtagaaagagtgtcttttcatatcagtgtaggaggaaattcattacccattaatttcttaatgagacaaatggtaggcatctactggaattcatctatggaaacatgtttgtgtatgtgcataaacacaagtacagaaactcacatgtacgctcatatgcgcatgcgtgcacacagaacgggagagaaatttgttgactaattcttttatctttaaatatatgccatttttactgagatcacactcactgagtgggaatttgagagttattttagggttatttttggtgtatataattatctcaaggctctagataaagatcctggagttttaagcccatctaccaacattctggtttgaataagttatttgaaccagcatattagagagaagataaagtcttaagatgtgaggttataagattcctttttttcacgagggcagctaatgctggaactgcacgagtggcagaggtagggtaggagttgacttttaaaagcaataataccccttagccccaattttgggttttttttttcaacatgtttcaatatccatatgttaaaatgttgaatatttctacatctaccatattcacctatgcctgcttgtgaatttgttgtggagggttaaagcaagcaggacaatgtctgtctcatgttaactgctcagaaagtggtagctactcttactgtctcagacagtacctgagtctctcagttatccaccatcagtgttattttcttattaccattagctctcaaatggtaattttcaatcttttctacatcaaaaaccccttggggaatttgatgaaagctatgtatcctctattaaagaaaagtgcgtatacctacatgcatataccatgcaccatttccatacatagtttaggagattcacctattccatgaattgagagttttggtacaccagtctaagagctccagcacgagttgagaaactgctctttcatcttttaaggatacattccaagtgacttatatttgattttagaaaatactggtgaacatactccaaactacttccttgaatcttttctcttgggtcttgaggtaaagcctggaatccttgatgctctggaaactcttcagacagactaagattacttaaatccgtcagtacctcctgggagctggtacaagatgcaattcagaatttaaaattattcagaatgtactaagatgagacagtttatatatgcatcatgtattacatagcatccaagagagttcagtggcagcatcacataacgaaacagattaatatttcttcatcaaaacatgtgaatattcatattaagtgtaataaggactgtagatagcctcacagtagtttcttttgctaccaaatgagtaacattaccataaaaacaactttcagttatcagagcttttagaaattcagaattgcaaataaggatttgtggatctgtagctgaattcatgtatccagggaatcactataaaactcacatccctttatatttctcgactatacctaaagggttataaattgtatactacaatcagccttagatatcttgtagtttgccaagatggatagtttataaatttatgaattacacacagactacatgcatataaagtaatatatatgcataagtgtatattgcattacatgtattagtctgtataattcttcttttagcagtattcagcaatgcatccaagtagctctacttaaactagtatatattgcttgcctagcccaataaggacatataaatcattaagaaaagatttgaaaattatagctggaaattagaaaactgtctgcaatggcatagtttcatagaaacagaaaatggattgagtaccatacttgaatctggagcccctctcagcttcacttgaaataattttgcctgaaaattgcataacacgagttcactgataagaaaagcaattaattttaataaaataagtacgtctaaatttaaactatcttttagatttcaaatagcacaagagaaaaacttccacagaagtttaaaacgtactgagaacattaaaggaactgccaaataataataaaacataataataaaacccctaaatttaaactatcttttagatttcaaatagtgcaagaggaaaaaacttccacagaagtttaaaacctactgaaaacattcaaggaactgccaaataataataaaacaaagtaaaccaaatttctatgtctatgtccatatttctaactatcatattgtcttcaagtcactgctaaaataaagtgctatcaatgtaaaaatgctgaagactgcttctcccttcctttcaaagaaaatctgacatttagatatgaagaatgacaccttcttatgcctccttcatctcccatctatctagaataaattgaataccttgcaagggaggcaaaactttatcttcacccttttagggtcttcagctggcctgagaactaaattgatataagacagattgagaggggaaaagcatacaaatttaatatgaattttatttgacacaggagcccttgtaagaaaatgaagaaccaaacaagtggtaaaacctaaatggttttacactagattggacaaagggaggcaattctggaaaagtgactgactaagttgtatgaagaggcaaagagtatgggagacaaagagttattttcacaaggtctgtttgtacagaatctctaggctttgactctccatctctggtgatgagaatgtttattttcttctggtataggaaagacatctttcacttgggagtttcatcgcttgctttcaggaagaaaagggggagatcagaatgttcttcttgtacttgctgttttccaagtgcctttagctcaacataatccttatgccaaagtggcatagttgagggtagcaaattgtgccacccttcaacctcctggtgttccaaattttgctttgtgccttgaaggaatctaacagaagtaccagaaacacccttctatgagaagaatttacagtctatttagaaaagatgacactagggtggtatggatcaatacagcacacaacacacaatacaccgtaaagtgttttgcacatcataaaaactcaatacatatccgttgcttgattatagaacgttcactttcacagtacctctgaccttttatttttcaatttagtctctctgcagttcctaggaccacatatactctggggagtgcaaaagagacttttacattaaaatatatggaagtgccactctgtaagcctgaaaaagcccaatgccagccattttttatggttcattgtggcataagaattgttctagaatatgttaccctaggtcagttactcttttattcatcttctaacctcaatcttggactttttgtattagagcaacagccacctcctacccgcaccatgaatttgttcctaaaatctgtgtatctcaagatcttcccagtgataattgtttaccctggagcttggatattacctggctggacatctggctaataggccttgtgtcagttttcttttccctccagacttgcacatccctgagagagagtgttttgtttttttttaaattttgttccctaggctctttatttgcctcattttagtcctagtcctgcatggcatcacacttgatcatcaaccctgagctgtctgaattcagccatccaaattccactgaaatgttctcactcctaagtgggtatttttcaccctaatcatattacctcctctgcagcattgggcactgtgagtcactctatccttaccaaagctctttcctctgttagcaatcatgaagcagctgccttgcttctctgtacatctgtacttctctaatcccacaattaccacttaccttttgaatctacccaaggcctggtcccctctcttcttttcattttaaattttctctgggcaatctcattctggaatggcttcaactgctaactacatgatgatagctttgtaaaccccatctctagttgaaacttctattctcaactgccatctcaacctggaggtatcacaaaggtcataggctcaactatttatcctcttcaggttttttcttttacagttggtaacaccatccagtcacctaaattaagactttggaatttacctctgatggctctccatagccaatctaccaccaagtattttctttcttttttccctaaagccttcttaaaactgtgtttttcctccccataccttctgcacttgtaatggagatcaccaaaagttacccaaagccctcctcagataacacctctgaatgtgatttttcccttttcacctgagaccagcataagaaccatctagaaactgatgctgtgatagcatgaattattttcatacacctttgtatgtaaataatttccacataaaaatttctatattacttttttatgaaatgtgttaaaaattactgaaataaaatacttctactttgaaccaatttatgaacaatatttctagaagagttatagatattctatacaaaatgagttcaattgtcgttggtttttaccataagacattattgataaaatcctaatgttggaatctaataaatacttacacagaaagggtccttaaaaagacattaaagtgccattgaatgtcttctagaagttacatttaaagataaaatacattgatatgcttttaacttatttgggcattgaataaaagacctttcttataaatgagcataagacgattagtacaagagtggtgaggactgaaaaacaattcaagataggaaatcctgaaattgatgttactttataaactctatttctaacaaagaaaattgaaaaactttgagtttttgaaatgtataattattctaatacattgagaactgtttatcaattatgaccaaggatacttcacaaaggctagtaagcatgtcattctatgtcaaatcaccctcccgataggtattgcttaagaacctgctaggaagagtgatgtgaaaaataatacaaggaacaatgcattgtttttattccaaattagcttataatttagtgtgtcaataaaccatataaataactataatactctagtagcatatgatgcggcttgtaaaagccagtcacagagttaactgatgtgactttttaagttagaattaaatttttttttattatacttgaagttctgggatacatgtgcagaacgtgcaggtttattacataggtatacacgtgctgtggtggtttgctgcacccatcaacctgtcatctaccttaggtatttctcctaatgctatccctcccctatccctccaccccctgacaggcccgtgtgtgatgttccccctctctgtgtccatgtgttctcattgttcagcttccacttacgagtgagaccatgaggtgtttgattttctgttcctgtgttagtttgctgagaatgatggtttccagcttcatccatgtccctgcaaaggacatgaactcatcggtttctatggctgcatagtattccctggtgtatatgtgccacattttctttatccagtctatcattgatgggcatttgggttggctccaagtctttgctattgtgaacagtgccacaataaacatgcatgtgcatgtgtcttgcacaaaatcactctgtcaccttagcacctctttctttttgtttgcctttggaaaattctgttgaaaaccctttctaaattcctgcccacaaaatattataaaaggaggagggagataaagaataggagtaagaggaggagaaagtaatgaactgtggttaaagattaaagctttttcagaaaagcacttatcaaaagtttctaaagagctcaggagttaatgctgtactttttaggcaataatggatgggaattgcttttggaaagcactcttttttcttgaagagtgcaaaaaatgtattcctttgagtgaatgaaaatcaatgttatggtcaaatatagaggaattgaggagaaaacaaggacaagaaatgctctaaagagaagactttgttgcctcttttcttcttcatcttaggaataggatatcaatatttgaatcatccatgggagcttttcaaaacccctattcctgagctctacccccagagaaatgcaatccaaatctctaaggataaaactcaggtgtcagtattttaataaacttcccaggcaattgtgatatgtagtcacagttgagaaccactgctacaacagatctaaaaggcagaagccaagtaatgctttaatgaagaatttgagaggaggaatatacatcaccctcagctactgtcacctaactagctgatcctggtaagactggtagaaatatagcatccaaaataagcaagggataaaagactacaaattgggttcagtgtatactgcttaggtgacgggtgcatcaaaatctcacaactcaccgctaaagaacttcctcatgtaaccaaaataccacctgttcccccaaaaacctatggaaataaaaaataaaataaaaataatgaaataataaactgcatttctcagaggtgcaaaatacccaaaccctaaatttaaaaaaaaaattagtgagaaaaaataaaatttccctagctgttaaatccgtgatgtgatatttcttcttttaatctgaatctaaaatgttcagtcttggtccaataataaacacactcactgaaacacacagtaaagaatctaagcagggtgagggccatggctcatgcctgtaatcccagcacattgggaggccaagatgggaggattgcttgagcccagaagttcgagaccagcttgagcaatgtagcaagaacctgtctctacaaaaaattaaaaaataaaaaaaaattaaccttgtgtggtagagcatgaagttgaggctgcagtgagccatgatcacaccaactgcagtccagcctgggcgacagagcaagaccctgtctcaaaaaaaaaaaaaaaataagaataatctcagcatttgagaagatgataatatggaaagtcaggtgtgaggtcagcatgtgggtgaataatttcaaaagctcttatttcttaatatcagtaaatatattcccctcttacagaattcatgcatggtattttggggtgtgtaaaggtacctctcacttattctcattctgaaagtctttcacttccttggtggatgaaaaggaaagctgcagttggttataaaaacgtgacggatgatttaggtggctgtattcagctgtaagcaataaatgctgagctcggcagaaagtactataggcaaaaacgtgtgatttactagctatccaaagcacatgagatttataatgcatgagaccctcaggcccatcacttctcttcagtaatgggaaacaatattgtgggaaaaaatgacacatttaatttcaactttgtgttgtaaaacaaaaacgcagcctaattttcattttattattattttttttcttttcgtaaagcatctttgcatcttattggaaatacaaatggcttcttaagaagtaggaacaatagagcatgttcaaaacaatatctatcggtagacatttattactggctgcatgtttgtacgtgtttggtgggatgaaaatgagaaacccggagtgctgtgacagactcattgtgttctgatagactctcccgaaaactgattctagaagcttagtgttctttaaggcagatgtttagccaggtgattgccgtggttacctatggataccggataccgaaaagagtcttggcatacttaaaaaaaaaaaaaaaaaaaaggctagagaaaaaaatagtagagacattttttacccactgaactgagggtgaaaaatgtagtcacaaaagaccatgaactcaaatcccaactctgttaatgatatataatgtgaatgccataaactttctgtatctcattatatcatcctgtgaaatactgacctattttgcaattgcaatgtgagagataaatcaaacctcttctaaggtactttgaaaatagattctgcatttcagaataaatattaaacaataataatgatgatggaatagctgacacaatgcaaattttaaatagagcagagtaactttctaattatgagctacattttattctttgtgagtgtaattagaaagcgaccatgttcctttaattagaaagttaattagactgtgacctcttttcctgtcttactgtcttggactacaggccaggagtaaattgcaaatcccctgacctacatgactatagccccccaaaatcagactgtttaaatagaaataacattataaggaataacattgggacttgcaagtcagatggggacttcataggctatagaagggttctctcatgagagaaaagtttatgtggataaataaaaaagggttctctcatgggagaaaagtttatgtggataaataaaaaagatacttttccagatcaagcctatagagtaagttccctaaattgtattcaggatgttggttcctttgtccagtgactctattactttagtatgcatgcaagagaattacctgaaggacttgtttctgggctccacacatacaacttttttttttttctttttttgagacagagtctcactctgtcgctcaggctagagtgcagtggcacaatctcagctcactgtaacctccgcctagcgtattcaagcgattcccctgcctcagcctcccaagtagctgggattacaggcgtgtgccaccatacccagctaatttttgtatttttagtagagacagggtttcaccatgttggtcaggatggtttcaaactcctgacctcgtgatctgcctgcctcggcctcccaaagtgctgggattacaggcgtgagccaccgtgcccagctgcacatacagcttctaattcagtaaatgtgggactcgagaatttacatttctaacaagtttccagatgatcttggtgacattggttgagagaccacactttgagaactactgacttagaatattaatagtgttaggccgaagtattgttttgtgatcaaataagtttggaactttcaatgttgaacaaagttaagcaagtttgttttttgtgtgatacctcaaaacctttgaatgttaatatgctttggaaatctccaagaaggatagactgcattgctcctgaagggggtggcccttacaaatgttttggctctctttatctcggagctacaaacagaggttttgctatttcacatagtgttcttagaatgggttgttagaatgctttgttttttagcattaacagaagaatgtcagaaatgagtttccattggtgtaatttgtggtttccccatgtgtgtactggccaaaatattgtagagacattccctactcttgtatgaagagggtatacaaatctagtaaggtttcaccctttaatgtgagaaatggtactgtacatttgattaccatttttggaagtttcttgattgcctggctcctgatagcctaattagctgaattatttctctgatcttatcatgtttacctcatatgaaattttcatgtaaaatgacatttggaccactttaaagaaatgtgtgacttcatagagtcgactgttttgagctagcttgttcgtaaatgtctaaagaaaaatttgctgtgaaatttgctcacattacaatctagaagcaaaattcctagagcgagaggttaaccctctgccacttctaaccagtggcaattatagatacttatcagaaaagagcataataagttgtgcaagatgagattgcctgaagtcagattaaaacactgcccctgctccccactccaatacttgtttgagtccttgttttcaaaggatttcatgcatccagtgttattcaaaaacacttgcgaaaatgctgtgtgattatttttaacttctcagaacaaaaaagaccgatgtcacaggaaaccaagcagcattagtaaactggtctgtgacatctctattgcactctgtgaaaattccatgaaaagcaaaatgggaatacaagaatcacagagaaacaaacaagtggagaagaggcaatgacttcatgtttatgttcttggtagcaatttcctagggaaataataacttcagagaaatagtcaatttgccttacctggtgtgatatacgttgtatattgtctaaaaaataagtgctctagaataggcaaaaacactttgcctaaaaagttgtgtacgtgaatgatactggaaaattcaatgatagcctttttgtctgttctcattttgtgtagttgagagcaagatgctcacaagtacatattaatattgagtgaaattaagaagtctcatccccagaataatgttgctcacaaaatagatgctcaataaatgcctgtggttgcattgggctcatttctgttcatgtgctgtttttttcttttcttttcttttttttttttttttttttgacagagtcttcctctgtcaaataggctggagtgcagtagtgcgatctccactcactgcaacctgcacctcccacattcaagcaattctcctgcctcagcctcttgagtggctgggattacaggtgcacgccaccacgcctggctaattttttttttttttttttgtatttttagtaaagaaggggtctcaccatgttggtcagactggtctcgaactcctgacctcaagtgatccacccgcctcggcctcccaaagtgctgggattacaggcgtgagccactgtgcccggccacatatgctgttttaatttcaacttattacatggcttagaatatatttttaaaaagatattttgatgacacaatgaccctgatctataggaatgccatttttagccagaattaatatagagcactctgctttgggattagctttgggttcagtttttggccatatcatttaccagctcagtcatgggaaggataccttggaacatttaataattttttggagtttcagcttgattctcccaaaatgtgactgattaaatcttacctaatacgtcattcattcattcaacaaacatttaatgaatgtccagatgtgacaggtgctgctccaggactgggggccaggagtaaattaatgcattagctgctctcatggagcccacatctggttgcacaagacaggaaagaccaccagaaagtacgtagtagaatatcttgggataatgagcaccatgatgagaaataaatcagagtaagggaacagggagaattataaagacgctcttttattaagaatcaggcacagcctttctgataaatggaggtttgcaaagacgaagtggtcttctgtgcacgggacaaaatgagataaagcatacacaaatagattgtgaaatatttgacgtggtgttaggtatgaagcaaaaaaaaatctatttcattgtgattaccattaccatattatcactgatgttgatgtattttcagaaacacctatctcgtgtgcatatttggtagacaaacctgaggaaagaattcctaactaataaaaagcctcataaatcaaatgccacttaacaaagggaccagtcttgttaacattgctgcaacagaactcgagctctcaccactgctttagtgagatcattaatatgatcattgcaatagtttgtgctcctaggattattgatagagaaaatgtgtatgataataactattaaaaatgatatcacccatcaccatcaattactgattcctctgtatgcatcatacaatgtgcatagtgctttatattttctattgctgttagttctcccaacaatcctataaggtagatattcttaagatgttgtcaaataacttgttcaggatcacccgggcaactttgtaatcagacctgggatggaagcctggagcagagtgaaaacaatgcccatggcctattgaccacattcataataaaatatatattggtaaaaaaaaaataaaattacaagactcttaaacttttatatgtttcagttaacattatgaaatagacaactaaacttttgccctgatttggaacccagacttctgtgtgctctttgttttttaatgaaaaatgtgttttaaatacttctgtggtctgaaagtatcccctagaattcctattttgaaaatccctagtgtgatggtattaagaaacggggccttttggaggtgattaagtcataaagatagaaccttcatgaatgggattatcaaccttaaaaaagagatcgaagagagtggcctaggcccttttttgccattccaccacttgaggacacagcattcaaggcaccatcttggcagagaccagtcccttaccagatactgaacctgctgataccttgatcttgcacttcccagccttcagaactttgagaaataaattctcgtttataaatttcccagcccctatagcaacacagactaagacaaataccaaataaacataaaataaactcttggagaacacatttgcacacccaaaacttcctgaagatagcaattcctagaattcgaagcactgagagagtaaacaatttactttaacttttgaaaccatgcagcctcccctcaattccatgttttatccctcatctgtcgatagtgcatggtgctgtaggtcatgatcaaacttccaaatagaatcattcatacaattctaagtcatcattaaggccaattcagaacgtggagattttataatttagttgctgtttgagaaactgaatacctaagacagcttatttgattattgaactttatttagtggaatgacctctggtggcacaaataatagaaactgctttcaaattatcattcagggtagcttgtagttggccatgaatagagagacaattaagtagcaaatttattacaaagcaaattccccagtgacctactgtttttcttttctagtgaggttcctcaacgcataatcctattacttttggcttgaatgagctagtcactgtcttccaagctgaactatgatgttacatggaagtttaattttcatcttatttaatttgaccttaagtgagctggatcatgaaaaggcaacataatctccaattctcgacgttaagcgtcttttaactactctacccagtaatcattcccaagagacattgtgaaattgtttaaaaattggtcacaaatgctaatgctaattttatgcccccagatattttggcatctctttcttcttattgtgccttttacactgtgaggcacccagcaggacattcctatggatggatggacttaaaataataaattccaaccaccattctctctggctaggccccctgctctaatgcttaacacaatgcgtggcacatggttagcactcatttggtgttagttgtctgaatcacgaactcaacgaattaatgaatatacaaatcagctaacaaacagacagcagaatgttgaccttctactttctctcatttgtttgaagtgcaattcaagaccggagaaccaagtggacaaaatactgcatatagatacagcagcaaatgcttaatgacttaaatatcctggaaatatttttatatcttactctgacttttcacaaacattaaaccaaaggaatgcttaactggcaattttaggttctcactgggcaaactcatgggataggcagtgtggagaggggcttgcatatgttttttgcatcatttcaataccccacatctgagagtgtacaatttgggttagatttccactcaaccggttggaatttcaggttttggactacgtcctctctatttcctctttatactttcatatttggaaagcatgatatgagtactgtcttagggagaggatagacaggaaagggaagctactgaaagccttcttttgaaataataatttcttaatctatgcactaacacacaagagtttatatctcctggaattttaaagtaataattgtagtgtgacaaaacaatgttaagtcataagatacatttcaacgttttaaaacacacacagaatacatcagtgcccattatgtgataactgagagattaatttgcaaccaataatatccttggtattttagcgttgtggattgtcaaaggcttgcttattgcaggttaagacattaaagggcccacattcccacttcttattaaagggagactttacgaaaggtaggcactgtctctacacttctgggaagaaagcctggtgatacgtaatgctccccctagcagaaaaatagtggtcaccagaagcatctctccataagataaggtgagacaaatagtgctgggccaaaccttgtgaactatgggcttcaacaaaagctaagagtctcatcatataactctcacctagactcagactatttcaagcaagaattaaggtaatgacatgaacttcttgccacagttatctctttattataaaatgtccttgactacaaggaggtgtaaataataactgccattccatggataatcagggtaagctctatacattgtctgccaattaccatgtactacttgaaaattgttaatttagttgaacttgaaaaaataaacaagtggccctctttggcatagtctagaagagactgcataggaaaaatgggaaattaaggtggaggatgatggatggggttctctgagtacagcagagggggcaagcagaagagttggagcatcatgaatggggtcacagtacattagtatggcttctttggcttgattgtggaaatgtgagagacaactattgtgagattcaaagacagtggtaacatatataagaagtgactgacaagatgacagccactcaggaaaactgcctcagaaggcagccagaaaggatcaattctggaaaatgactggcggaagctattaggcatattgaatgggtctgacttagtggttgatttgacaatgagagcaaaagatagatgttataaaacatcattcagagtcaatgaatctggctattgccaaagacagagaaatgaaagaataaaagggaaggtatggggaagaaaataagaaaaaaattaaatgattatctttagtttctgcattagttcttctgctttggaatctccctagctgcctgcagccaggggcaaagatagtttcacctagagggtcctgattgaggctgaggatacctaggctcaatcacagcagtggcacttcccattcagaggaaggcttaacattaattatgagacatgagatccaggtgctgaactgacaaatctattctctctcccaaggcttcccaaatcacagctccgataggcagttatcctagcttgtattagtcataattccctgtagccagagcttccacttttccttgcgttctgattttgatgctatcttatagattaccctcctaattacaactcactgcttacctggttctccaggaatcatagcatagttttttgagtactctgtctcacttgcctggtcaggacacactacctcactttctattctaaccatttctcaatgccgaggactcatatctcagactcaagacagttatattgttttatttttaaagtcactaagatatacccatatcttggtattccataagcaagaaggaagtgagatgagaaagtggttgcaaccacagtgttaaaaatatggactggaaacttgtctatttgcagatggtattagatttctattgctgctgtaataaattaccacaagtttagtggcctaaaacaacacaaagttctcgtcttacggttcagtaggttagaagtctgacatgggtcttactagaacaaactcaaggtgaggctgaactcaacagggctgaattcctttctgaagctctaggaagagtccatttccttgccttttctaaattttagaggctgcccacattcctcagtgtgtggccccctttttccatcttcaaaaccggcaacgtctaatctctctggcccttttttccatgctgtatctctgatcacagcgggacagattttctgctttaaaggaccaatgtgattagattggacccaccaggaaagtctcccatctcaaagtctataatgttaatcatgcctgcaaagtctcttttctcatggaaggtaacatatgtacaatttctgaggttcagatgtagacatccttgggggaccattattctgccttccacaaagatattttctaaaccattgagaacagatgagagtctcatatccactaacaagagccattttgatatgcaacacagcaacccaattgacaaggaagtcctcagagatagtgtagactgtgatactcttcatctttaattctataggttttacctgcgtagtgtctgacctgaaagtgacaaagtttcccacaccttgctagatattcccacacattcctatttagcccatctagacattagaagggaagctttcctatttatgattcctatttaattggagtgaatggatttctgtcatttcctgttgttccttccatagccttatgattgtgtggtaatttgaaatctagacctttttcttttcttttttttgagatggagtcttgctctgtcacccaggctggagtgcagtggcgctatctctgctcactgcaacctccgcctcccaggttcaagcgattctcctgcctcagcctcccaagtagctgggattagaggtgcccaccaccacgccgggctaattttcatatttttagtagagatgtggtttcgccatgttggccaggctgacttgaactcctgaccttgtgatccgcccgcctcagcctcccaaagtgctgtgattacaaatgtgagccactgtgcccggcccaatctagacctttttctaagttagttataaaattttacatttttccctccttgcaaatttgttcccatttgaagaaccatctgcaagaagaagaatacataccattcaccaaaccttctatccgttgggtctatcagagaattagtattggtggtgtcttctagtcctcttgcagattaacaggttatccacttgacctgattatccatgacatcaatttggtgtatcctaaacttcatcagagcagaatattcctcagaaggaatatcatgtcaggtagcttttcagcactaagcctataaatatcctgcctgtgtaggcacatgggagtcaatcctgagaaagcagctcattgaggcaaaaaggggagatttttagctgaatcagacaattactcaataagtctgctttgtggatgtttgtgtctcccccaaaattcatatgttgaaagctaattcctaatgcaataatattaagaggtgagacctttaggaggtgattaggctctaccctcatgactgggattgatgcatgtataaaagaggcccaagggagtttccaacaagtgctgggctatctgctgttagctagcacttaagatgtcttacctgtaaagtgtctttcactataattagtctttctgactaattgtcagattcagctaacaatctcttctttttgcctcaatgagctgctttctcccatttgcctacacagaacataattgtttcatacactagaattagatcagagtagattcaggctcttcattacaaaatgctcatctctgctggatgttaatatcaaaatcagaattctagttctatcacatattgactgatataagaataagtttagtttaaaataaaaggtgagagaaagaatggaaaagtaataatatggaacatgagcagcgtctcgacttgtttctgcttcctctctttttcttactaattaaaacagataacaacaaagccctttggtcacagcccacacaatcacaagtggttccctttgttgatgtgatgtcactggaggggaaatgagcagttgacaggctgtgcaaccaagaaggcaaaatgagctcaaccatttgaataaaacatagcaggtctcccactccatgtcattgactgacataacccaccagacagtaccctttaaataggctgtctctcttttatgtagcaaataaaaaaaaaaatgtaacatgtaaatatcaggtgattcttcttcagcatctgtggttgccagaaggaatttactgccttttcattgtgtggttcaacttggtcttcaggtggtgtgccccaaaatccacaattagtgggatccagtggtgctgtggatgtttgtgccccccccccaattatatgttgaaagctaatccctaatgcaataatattaaaaagtgagacctttaggagttgattaggctctgccctcatgaatgggattgatgcctgcgtaaaagaggcccaagggagtttgttagaccccccacttccgccctgtgatgacacagcaaaaagtgtaatccgtgaagcagagagctcacgccagacattgaatctgctgtcacattaatcttggacttcctagcctccagaactatgagatataaatttttgttctttataagccaccgactttgtggtattttttgttataacaacttaaatggaccaacacaagtgatgatgtttctagagtctgtgtatgtgcatgtgcctaagtattttgccaatttagcgttaatgagtacagcaatgccaacaatggatccattctttgcctctcctattaccgcaggtctccttttcacagatcagtatagataagggtagtagagataaatattacgaggttatctgttagtgcctgttcaatcaactcttgattttacagtagtcttcctgtgtaccatgacccagacatcttataaaagcaaaacacaaattgcagttttaaaatgctattgctctgcaccattattttcctcttcccactaatttgcttgcgattcaatgtgttttctagcatctctcatgtcttgggttcttggccctcatatttccctttggattgcttcattttggtggattttgggaattcccccttggctaataaaaccttggttattcctttctgttctgctgcctagatgactattccccattccaaactttaaccctgtggaaccccacccccacacaggccatctatagacctttgttcttcctaacattttcaacagggcaatgaagtgtttcataaatatttggggttttatggaaaaaaaatgctctaaggcagcttaaagctattcttcaaaataagaaaagtattctatattttaaacatgtatatagtcatcttctttactggggaattaatggagtactctaagctattgcccctcccactctcttctcttcagctacccaaagtgatgatgtggaacttccagattttctcctgcaagttcatgctttatttattccattatgaggtccacatcaaattatattaccattcctgggattctggagttcagatctttggaaaatcacagtgtcaacagaaattataagataaaggcacttatatatgaggaatgatcccttgccctgcatttacagattcagatcaaaaaccaatgcccacatattttatctctagcttttactaaacagtagagtccgtgacttcattcacagtaggtgattgatacatttcgacaaaagtattttgcaaagacgcttcctgcagcatcaacagtaaaagagatactgaggtaggtgctatatgtatcttctggatacaaatttccaccaaaaaaaatttcatcttagcacatatctttgacttatggtgttcaattttaaatataactggcagttttgataaaatgcattcctttccattgtttctgttacaaagaatgcaattttaaggttttctgtttttgtaaattggagcggtggatacaacagttaccacccccacacatacacttctctaacacatacatatatacacacagttttaacattcccaattctttaaaaaattatctttgatcaaattattgtttatatgatgtaaatgccttggacactactgcctgtcagtgatgcgagtcagttcttctattccttttattggctcctcagagatttctggaagtccatctataatagaatcattatttcataatgataacatattttaaaaactcatggtttcagaaacatgagcaaattgccttgtaaaagcctacattgagggagttgtgcagactttaaaacacctcagcttctcactgcacattggatatggttgagtattgcaaatacagccatatttatccatgctatctagcattagacagtccttatcatcaagtgatctgagggcctccttcatcagcttcccttggaatgcttgctatcaaagtactttcctgagcccgctacagatttaacaaaccagagtctctgtgcacccagagaagggagtttgctccagtgattttcgtgcacactaaggttggagaaccattgtccctcagagccattagaaattcagcttgcatcagtctagagttctacaagaggcaatcacaacaacatgctatctacgaaaatcctatatttccatccctgactcagaatctataaatttcagtttaatttccactaaatgtattatcccgggaaaaagggcaggaagtaattatggaaaaaccattgaaacgtaagcatggtgagcagatagtatgaatatgagtataatctgacacttttaatatctcagagaacagaggaacaatagggaaagcaggtactgaccagccccagttcacgtttgtttctgccctcttgggctgtgcaactgtgtgacttgggcaagttacatgaccttgatagtcaaaatgtgaatgacagtatgtgtatattagtgatgttgtgagaattaaatgactgatataatgtgtccaccaagatagtagacagatagtaggcccccgtgtattagttacctttcttgttttctaccactactacccaagagggaagcttctaaactctgaaggagatctgttgatagagtctaatgtgtcatccagctttgtctctgggtcatatagagatacagtttgtatgccaaaaaaaatgtagtcctctatacagttcagaaaattaccaccaatatgctttatcaaacagcagctacagtgtagtatatgccaacctcagagtgggtctcctcttaaaggttcccaagtatccagtcatgtaaatgaagactgcatctaaggagttagctgtacagagaagagtctctgagaaagcgaaatagggttatagtctcctctagtccttactttcgctttaaggaaggagaaaatagcaaagagtgaagaggcctggaaaattgcagtaaaacagagcaaataggataagagactaataaaataagtggagcacagagaaactaaattgaatgacaacacatgagaaatgtactcaagttttgactcctgatttgtgaaccagaatctgccaataacaactaccaaatagatcagcccaaatatctattagtaacccccaagaacagtgcgatgtagtagagtgacccagcaataaacaaggccccatctctgccttctagtgttttacagactaggaggaagcctccacaaatttggcacagttaatgggtagctaatcagaaaaaattaagcttatatcaatgtacttaagctgtgaagaaaaagcctcatacttcttgttaaaaataaatatagtttgattgctcaaagagatcccagtccacagattaccacagtaaataattgcacgcccatctcttttgcaaagcacaaagcaacctgctccacgcgcctcagatgcctttctgaatcaccacagagggagacttttaatcatttcaacaaccagagcaccagctttgttctcaaacaatgctggaaggtttctcacacctctactatccatagtattataatttttcatttttcataggcaggggttttgttttatttggttggtgttgtcatatcccagaaacgaaacaggcctgcaaaatcaatgccacacgtacaactatgtatatattctcccctgtaaatctccattagcttgattgggactccatagtggctggaggtattgcctgcatctgcctttcattcttagtttgggcaaaatgagtggtgaatgactcttatacctgccttttaaaattggggatctcagatgagccctggctctaccactaattgcatggaactacttggtaagcagcatcactgaggcatcagcatcccatcatatttatttctagggaagatgacaaattatggccaaattagcatcgatatgaacaagtttgtagaagggtcaaaatataaatacaatatacaaataactacagcagtaatgtttttaatcactacattttcaaaaatattctaccgaaaagggtgattaacaaattattattatgttaacctagaaaaagaacataatcagtatataatcactaagaagacattaggcacatttaaataagtaggtgtttgcatgttaatacacacgtactcttagctcaggaacatgatccattaaccgatagaacgagtaagatgttagctaattggtgagttcttgcagtgagaaatgtctaatgtgagtccctggtacctgtgattttcaaaattatttaaacaggaatcaaaactgttttaataatttttgaaagcattcccatgctttagaattttggtttaaggcttagaccaaaatcatcatggaaaaaatgtgtgtctagtgctgaatcactttgacttgtattagaatgtcagctccaagaagacagacatttttgtcaatttttaatcatcaatgtacccacagtgtttacaagagtatctggtacactgtagggttattagcaaatattcacaaaataaacaaataaataatacttacctgtttcattacagtttctctgccagaattgtaatcattggtcaagtttgatagtggacatgggcctctttcttgggaagtaataacaataggaagatatggtactgaatgctagcttatgggaggtgtgggttaagaggtctcagggatgccctgtcttataaagagctctgcacaaacttaagcttaaactaactggaaaattaggacagccatctctgtcatttctctagcgtcttctaccctctattgctttccagatgcaactcaggggactctccttcccattttcctggccctttgctttctttattgggaactagttaccttcaattctccccctttgggtttatatgcattttagattattatggttattcttcttgtaacctcatttgcgtggtagatgcaaaacagaatttgagacattgccatgaacaaaaatggagccaattatttgtatttacatacttttctgaagtctattcatcagattttctgattcttagtgaggacttacttaggattattcagatgtggtcaagacaaaagcaatgaaataatcatctgaggttttgtattatctacagatataattctttatatttgctaaataacaaaaggaaatatttttctcttgttctctctgaatgaagggcaattgtgctgtttttctgtcactgtctataattttacttctaagaaatggcatgaaggtatatcagttacataagagggcttttatttgtcctttttggtattttttagtgtttggtttaatgattaaaatatattgtatctcttagatagttaactatacacttaccatatgacccagcaaccttacttctgggcatttaccaaagagaaatgaaaatctatgctcacacaaaaacctgcacatgaatgtttatagcagccttattcatgattgccaaataacttaaaaaagcagcctacatagagttcattgggtgaatggataaaaaccaactgcgatacagacatacaatggaatagtacacagcagtaaacaccaaagcagactcttgatatgcacacaacatggatagatctcaaagacattaggatgagtgaaacgatctggtctgaaaaggttacacactgtataattccatttatatgacattcaggaaaagataaaactatagtaatagagaacagaacagtggttgcctgggattaggagtagggagagaatgccacttcaaaggaataataggattaagactttgggggtgatgaaactgttctgtaacctgattggggtgttggggtggtagttttatatatgtgtgtgtgtgtgtgtgtgtgtgtgtgtgtgtgtgtgtatatatatatatataatatttgtgtacatgtgtatctgcatgtatttgaacatatatacaactgtataccaagagaaaaaaaggtaatttcccagtatgaaaattttaaaagtaaaatttaaaatatatcaaaaatatcatattgttccttataaatctataagcatagagaaaaagctggaagggtactcaagaaacgttatcatctgtgtggagggacttcaaaataagaatctatttcttttgtctttggaaaaaaaagctatttccgttttaaaaatatcgtgaagtcttttgtttagaattggtaaaggtgcttttctaaaaacgctcattttcttgtagcttttggttaataaaaatactcaaattattactgattatttttatacagtattttttctggcagtattaacagtatttgtatatggtgagtgttatattacttctgccaagcttgaaaacagagatgacaagttccgtaagtgtaaaaaaataaatgaaattaatagtttcgtgcctaagagcctctctttgcatatgagattagtacactgttctcatgcttattttgtattataattcacttcttcagaaagctcactttattccattcagttgcaaagcttggatggttggtatgcctataataaatttagaaaattaagttattactgcagtgaagttttcaaaactccatccactcacaggtatttcagttataattttgataatggagaagatggaaagatagatactatcaatattttttcctttgctacatttattcccttatgccttaaaaacgagggcatgatatgatattccatatgctaacgtgtgtatatgtaaaagaaagagaaaaaggaacttgctctatactttaatttcagaatatggctacctttgcttatgttagaatgtcagcaacagaaaattaaatagcccatataattaatgcttgtcttttattccagagtaagtttctttctgtgttttgcacatagtgtaacacaagtttgttgctgttgcttttttcattgagaaatctttaaaatgatcatgaagtgtgcaagtcaaagtaaaaacaataaaacgaggtattcaagtagatactgagaggtaaatgaattatgttcgttttatggcaacatccaaatattttgtgtttccattttatgtcaaaagttaagctttagctggaataaaaaatttcctctcttggtaaaatcagttgacttagcagttttatgcaagaactgaagtattcaatcaacatttttttttccatcaaacttcccttttgacaggaaattctgtgtctgattctttttttctttaaactgcattcaaaagaataataaaagagcaccacatgtcctctttgctgaaggagtttttaaagagataccacaataattattttcttgcttggaagctacctttattaagaggccaattttatactggaatctactattaaaattatgtgactaatgtttcattatgaatcatgatcacaaacagagtcattatgtatgggagacctgagaaatgttcgccaaccacattcaaaaatagatatttgtgtgtgttccagttacattttatttgaaagatcaccttcctttttttcttccaaatattccctttccccctcccttgtggtcctcctcacatctgagctccttttcttttcacagatggtgatactctttgaggtcaggtacctatgacctggagtgtttcttgaagcacttccaatattcggttctactttttcaatactcatgacagcacgcagtctaaggcaaaacagaagtgagggttgattgatcataaatatagctgacaccaccaagctgtcagggagcaggacactgaattgatcaaattttaaaagtggaggatgtgtggagccaaaaggaggtcgccttattttggagtcatcagctgagggctaagaaaagaaaattctggaattctgctctgtcaggatatgggatgggcttttagaagaaaataaggaaactgatttcattgcaacatgacttttggcagttgttttaccttaccttttgctaaaatgtcatccccgcacccccctcatgaccctttactattctccttctctttatttttaattttgtaaattttaatttttgtggtgacatagtaggtatatatatttgaggggtacatgagatgttttgatacaggcatgcaatgtgaaataagcacatcatggagaatggggtatccatcccctcaaacatttatcctgtgagttacaaacaaacaactcgattacactcttaaaggtattttaagttattttttacctcagaaatctctggttcatattatcagagacttaataatatttattgatcagaatttaacatttgaataatttattcttttcttatatgtacagtagtgattgggtgggaagagggctgagttcaaatatttactctcccacaagctacttggcaacttaggtagttggaacctcatgatccaagctctgaaatctttggaaactacattgtaagagacaattggttctatagagggaaacccttgcaaaagttacatgtgctctactgatatatcaaatgtatgtgtgtatgtgtgtgtgtatagtagaactgatggtagattatttcaattatatagcattaatgacaggtggactcaatttattttctctaagcagctgaaaattctcaccaagaaacagccttcctgtattcaccacctttatttgaagttgagaaataaaatgttgccaagtatatccagggtcatcccatttttctaaacacaagttttctctgcactatgacactcacattactgctgctaacatgacgagcttcagatattatcaggaggcattttgtatagtagttaatagtataagttcgggtactagtcctggattcaaattttgggttggctactatccagcttataatcctggataaattatttaattgctctcagtttcaattcctcatcttccataaactggaataatactagtactgacatccagggttgtgaagagaataatctacatcaaatgtcaacagtcattttctgtaacagaccagacagcaaatattttaggttttacaggccatataatatagtgtctttcacaactactcaactgtgcctttatagtataaaggtggacctatacaatacataaacaagtgggcatggctgtgtttcaataaaactttatttacaaaaacaggcaggaagactgatttagcccactggccctagttggcaaacctctggtctatattaatgcttaacacagttctaaacattaattttaattaatgtaaattaaatgttattagttctgtggcatacatttcaacgtatgccattattcaagaatatgtcacaatcatacaggccatactgtatttctccagaaactaaaattactatatcctaaaggaaactaccatggtttgaagatttgtttgtgagaaattctgcagtagcatctggtgatctggtgagagggacataataatcagtaaatagtttgcagtaccttcttatcaactaaatagatgaacgatgctataaaaatgaaacaaaagtgacttaatgaaatcttcagtaacgtagggtcacacatttattcattcttcaaagtagttatcctttcactataatttccttcctagattttgctaaacatatacaactggtagaagcctaatgtgctgttcctgtaacattatattcctgttccttgacttcctgatataatgaagctgattatattccgtgtttgataatgttcatcctattaggattgggaaatccattgaccaccgagcacaaccttatgttcatgttcttatcattagcaccactccagctatggagctgtcagcattttcagcctaaatgctgctttcaggggcctgcaattcagtcataaaaattagctgcaggcagaaacttgatatatgaagtccagatccaagagagaattttattacatttttaacacagagagagaagtacattagaccattataaaaaaacatacaaattagtgtagtgaacttgctctgcatccttttctgttctgacgtaatttaagattgcattcatatctgcccccttcgttttccatgtatccatgaaggaatcttacggatttccagtgccaggtgactttacgacaagttcccttaaggttacatttaagattggaacagagcagcttgagtctctatttgtcaatgggaaaaagattttccagccttttatgaattcaaaattaattagaataaattttctgccataatgcagcaacacagggtatgacctgcatcaggcttcatgttttatgattgagttttaagaactggcttgtgtgcaaagacttttctttgacgtgagattgaattaaggaaacttaattaacattttctaattaaatactgcattgtgaactcaatcgcattgtactctgcaactatgatgagattgttctgtctttatttaaataaacaagatggctcacagggttgagagcttggttgataaccatccctttctttcctcagttgtcacctctgcttttcagaaatattattagccactcacctaactgcaggaatttggtagacacacatttctcaaaaatgctcaaggatactaaaaatgatacctgatctcatgattgacgagagtagtagtctacccatttaatacctaattccagttcattctattcattcgagacaaaccctatttttattccctttcaccttattttctccatggaatatgtgatgtataacatgtatcatgtaatacacaataggtagcgtataatatgtgatttccagtgaccaccatggtgttcaatttaatagttaatgtgccatcctcatcttacttgccccgagagctgcactggacaaagtacacaccatttctccatgatactcatcttcccatggctcccaggacaccacattctcttagtttccctcccaccattctggtcactccctctcactcttttttgctggttagtcctcttccccctagtctcctaatattgcagtgccccagggcttaatccttggtcatcttctctactctccctactctcattccactgatgagctcatcctatctatatgccagtgcctccttaatgtatatactctgccctgacatttctcaaatcttgcatacctaactgtctatccgtctctgctggaatagacactccaaactccatatgttcaaaatcgagttcctgatcttttcctgcggacctgcaccacccacagccttctctgtctcagggacggtaactccagttgtcagttgctgaggccagaatcttagaaataatccttgactttttattctctcactctttacatccaatctgtcaggaaattttcatgcctctcacttgaaatttatccagcatctaaccacttatcacttctccaactcttatcaacctggtataaggcacttaccacagtttgttgctccaaagctctctgttttacattgtcagcaacagtccttacaatgatctacaaggcccaatctgggtgaattcttcatccccccgtcttagcatgtctcctcctctctgactttcttatgccacaacagccccactggccttcttgctgttcttctgacatgccaagcacacttccttcttagacctttgtactcactgcctgcaatgaatgcctgcaataacacatcctcctggctaactccctcacctccaagttttttctcaaatgtcaccatttcagtgagtcctatttcgatttctatttaaaattgcaaacctattctactgccagcatttctgaggtctaccttttctcctttccccatatatcttatcacctttgaacagattatctaacttttgtctgtctgtctaccccttatcatttgcccaccacattaggatgcaagtcccatgggggcggaaagttttgctttgttctttcgtacatcccaagcactgagagtagtgcctggcacatagaagtaactcagtgaacatcagaactattaaaagcatatacaatcagacgggcatggtggctcatgcctgtaatcccagaactttaggaggctgaggcaggagaatctcttgaggccaggacttcaagaccagcatggacaacatagtgagaccctgtctctacaaaaaatgaaaaaataaaaaaatcagctgagtgtggtggcatgcacccgtagtccgagctactcgggaagctgaggcgggaggttcacttgagcccaggtgttcgaggatgcagggaactatgagttcaccactgcactccagcctaggtgacagagcaagaccctgtctcaaaaaaacgcatatgtaatcattgaagaaaattaaattataactatgaaaattcaagcagtcacaatatagtgcaaaactgaatggtttattaaagatgtttaatttgaaggagattttttacaagtaacatttgttttaaattattcttattaacattttaaaagattgattttgcatgatacaagaaggatggtggcttcctatattacagaagtaatattttagagaagtaatagttccagtcattgccacagagttctaaataaaatttgcacatggaaaattaagcatgtaaagcaattgcatcctcatgatttagctaagaaaatgtccaaaacagttaaggtcagtcgtagatttaactcagtgtttcaaaaccatttgattcattggtaccaaaagcaagcgttttacatttttctccaaatctttggatgttgttatttcttctttaagcaccataaatttttagctatgcatgcttactagaagtaagcaataagcaataacttattccttttcatctgtggcttatagaacctcttgctttgtgcatatgttttgcccctctatttcactccagaggttttgatcatatcaagtttcacttaataaagatgagtagagggcaaaaatcagtagtaactttggggaaaagtagaagttccccttaggcattgaattataatcaagtgaggaaaagctattattgatactcattcagaatttcatattagatcattgaaaatctttaggaataatgattgcggagtcaccgctaataacttaatgacaattgaatatgttaaaggctttgaaaaagataaaatagatgtagatgacaactcctgactcagatgactatagtaatttttcataattaccattcacagaatacaatttagatagaaataagagcaagagttaaatgcaatacggagtagctctaataggacctagacatcagggttaatttgaaaattatagttcctaaagtaattgtgttgcagaagcctatcatacaaaatataaaccatgaaataaaatttttatgaacttcttactaaagctgtttttatacccttgttttgatgatttacatttctaatttcacaactttagcccttagttgagccctaagcaaatttatgaaaacatatttcttattagagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatcgagtgactggttgttccacagtgtttttaaaagacgcttcttgttagtgttagtaaataaaggtgtctatgtttttcagcttagctacctctttttggctcaaatcagattctactatccagtttttaatcaaattttctcttatctataattaacccttcaaaactaaactttaaagttcaacttgtttcctttttatgactagctgaaaattttttaattgtaaaagaaaaatgcttataattttttctatatgcatatgattgattttaaaatgtcattgcaaaaacgatggcctcatggcatataggttcatgtttttttgtgtgccagacactaaaattgaggctcctttatattattaaattgaaactcatgtttgaaataaactaaatacagcctataaggtttagattcactgcagtttactgctgattggaatacttttggtatcgagtttaatatctgacacaaactttcatcatttgtgatattcccttctaatttatcttgcatatttccaccagtttgaaatttgcacttcaaacttcctatttttattcatgacccatttcaaaatatgatatattaattatcctttactgtaaatatatgtactcaaaggggtttggtaataccctctttgtaataagtatgaaaagaagtgtccaataatatggattgattaaataaatataatccatataatactctgtagctacgggaatgaaaaaaatagagttacttgtactgatagaattttgtgctttttagaagatatatgtgtatgtgcgtccatacatacatgtgtgtatactgtatatgtgcgtatttctatatattcatgtacatatgcatatgtttgtcatgtttgtctattattatacacacgtgttgtttatatatgtagtattagccaagaaacatacagaaaaaactgtttccatggttacctctgagctctggggagtgaaaccaaagcacagaatgtgggtaggagctctttactcttcatcatctatcctttttaactgtttcaattttttttttactatgaccatttgatttagtatgaaatttgttatatatatatacacatacatatgatatacattcatacatgttgtgtacatttatatcatatatatattacattatatatgtatctatatacaatgtagtagctatcttcaaagaagattttttataactaaagataagaatgttaaaagtgaaggaaaacctcaaggcccaaataactttgtttgtagtatttaaattctgctttttctttctattctctcactgtctattcccttcatcacttaaattcattcccactaaaaatgactcacggacatagtttggaactagttgccacatcacctcaaagttaagggcagcagcttctctatttacagctgggaaaacttgtaactaagagggaggccatagctttagttaaatcggcatccaaggaaacaaaataccagaaattaacaatggttgcaaaatggagtcctagcctaatccctctcctttctaattactccctaattgtttcttaaccatgtgccgccaggctgcagtggttggggtatggagagtgaagaactttttgaataaggcaattcttactctggaaggactaacgaagaacctgattgtaactaaaatgagggaacagttcctactatttccatcaaattcattctgcccaaggaaaaagatgatgatttgattttaattatgctaacagcatttcaatagcctccggagaaaatgcctgctttccaaaatgcagatcactaaattatactgtgcctcctagcaactcctactactgagaattcaaagcttatctcaactttactttgttttaaccatcctaagatttcagtccacagctttcccataggctctacctgccttttagtgtctagaacacactctcacggcatctgggtcttcaaacccacacagttcctgtgagctattcaagataggtcaggttccagctgaggtcaggcattgtgatcactcaagttaaccctcctctaaaccctacctctagtgtcctaaatttgctttttgtctcagcagataaaacccagaggttcccaaacctgctgtgcatctgagtcatgaggaaagtttgtgaaatagattcttggtttctcagctacactaatacacggcaaggcttgctatcctttcttccagttcactgcttctgggtcctgcatgctggagcaccaccagtgctgcctcacctctggcctcctcctgacaaaggggtctctacactctgcactctgtcatctgtaaccagccttcttaggcacaagctgccttctattttttaactcccagtttcgtttttatgaactattcaaatcaaataattaagaataacatcaatgatgccagcaccagtagaataaggcacacctttgctttaggtcagatttccttgttcctctgtttcctgatgaaggcctatgcttctggactttcccttgattcaagatgagtgttctgcttttccaaatggccatcagcagggactaatggtggtcactattagtcttcactgacaggctttttagtccaaacttggagacatggctattgagcccagagttctcctcacaggcactgaggcacaggattctatgagcctcctctaataggtttcattcacagggataatgacatggatggatatggttatattcatgtaggttttagcaagaaagatgctgtccactgagagctacctgaaagattatgatacacactcttggaaaagaataagaggagcagattaaaataaaaatctttgcttaacagtttgagttggatggcttgatgaattgcaacacctaggaaaagaaatcttcctaggttatcttacagttatgatttttttaagtataaaggagatgagaacaataccaatgtaattcatcttaaaagactttaacctgtactaaagatttgtgaaattcttcattaattatgattgactattaataccatctcaaagattttgctagacctagaaaggctttgttaaataattttccatgtaccccatactctcacagatttaaaacctaacactgggagatagtctatcaggcaaaattatgaacttatatattgatgtaggcatagttgctcataggttccaaaagttaatatatacatttccaaaagttaaatataacattgtggttttgattacatatcacgttttcctttcccgctcaaatgaagttttaacatgattgcctagatttggtttcaaatttacctgccttagaaactgtcactcaaatgtacaattactttttcaatgttaagaagaatatgttatgataagaggttcctaaagaaagcatttcatagttctctggcattgaattttttttatttgttaccttgtttacttgtgtgtgaacgagcataaagtgaaccctcagaggacaagaaaaaatatcaggtatttctttatggatttaatctctgaaaattttccatcatcactaatgatgtcccaggagtccttgaagctaaaataacaagatatacaatttacacatttttatttagatgcactcattgtttgcaaataactttgcaatctgataaagaggcaaaaagataaactataggtataataaacttgaataaatggatagaatttagaatgtatctgggggatatatcaagggtctgtttggcaacttgggaagatgattggagaaaaggacagaaatacttgaggaaatctttctgcatggactggatcaagtctaaattccaaaatactgtccagccatggaatggcaggttagatgacagcttagagcgaggattggaaatgggaaacaatgtgaggatggcaaaagagggtatgtctcaagatgagattcaccagagcagagcaaagcagtgaagagccttcacttcattggacagcacttgctctttctccctttacatagattaaccttgagtttagcaatgcttatggagactgctagagaatgaagggaaacaagacacaatctgttaagtaaagaagcctagaaacattgggtatgtggaaatataacatgatggtgctaacagtcattatggtgactctcatttgtagaagactagttctgtttcattaagagataggtttcagcttgtcacctagtagatcttatcttaatcatggctgtgtatgttgactcacataccatttttactagtatgcacatccaccgtttactgagctgttgctctgtgctaacttacagtgtgctaagagctttatatactgtattcatacagttaatccctataacgaacctaggagtgaaatttttcacacccagttttgcaaatgagaaaattaaaatatcagaataagtgacataactttcttaaggtcaaggagataataaaagataggcttctattttgacatagatttagctgtctcaggggcctaaattcgagccaccgcatttatgttttagaatagcgattgcaaattgttgactggagcaccaaaatcagcctggggacctgctttactgattctacatactatgttttcagacaatctgaatgtgcatttttatggaggggagtgttaactggagtcaccgtgcatcattgttttaaatcatcttgacgtttaagatttcagtttttcatttaaggttacaggttgaataatatttctccctactttatcaaaatatatatcatatatatgtataaaataaactagcacaacagttatttaaagacagttcaattgtttgtactgagatatacaaacagaaacatttgggagaaatattacaatattcgtaaagaagccagggacattggttttgcaatattgaggtgacaagtttccaaaaattaattctatactgatttcagatcctattttccatgaatagacacagccagagggattcccttctgtaatcctcatccgtatgcctctaccaaccaattaattgctcattactgcatcaacataagtgtgaatttgttgacagagagacatttaagaaagaggttgtaaatatgtcccaatggtcctacgtactctggaatgtgggggaaaccataatcacagttaattcaatgtcaaatttcttattcaaatatgtatttccagttacggtgataatttttcattcatgctcgattgtgatgatttttgcttttattttatgttattctccattacggaacttcattttgttttacacaaaatagttaatataatacttcgcagtaagggcattttgaaagaacagtggcttaaaaacaaaatttatctttgtgtttcctacgaggtggtaagccagttagtattcaacaagtgtttataaaattatttcattttcttaaaagcctataataaagatattaactggagaaagaacgttgaaaattcagatgagatgaccagtggttttaatacagaagagacagttttcatatttttagcacatagaaaaaattgtaaaatgtgtttgctaaattccatctgaacattatcgtaagaaaacctcacaaatattttaatttcttaagtaaaatagcttatttcatttatgccctttactactttattttcactagataaatcatcaacgttttacttactttttcaaaaatcccagtagaacaatcatgtttgttttgacaaactctagaaggtttttatttctattaatttaaatagacaaaaagaagacacttgaaagcagcacgaaatccccagcacctttttacgagattataacttgtgtataaaagtaattaacattttctagtatcatattttaaccagatcagagattcttaacccaggattcttggatctacaaattaattttaaatggccttaaaattgtacacacaaaaaatattttcatggggtggggaagggggacaagggctctaccattcatctgttcttttttttatttttgagacggagtcttgctctaccacccaggctggagtgcagtggcatgatctcagctcactgcaacctctgcctcccaggttcaagcaattctcctgtcagcctcctgagtagctaggactacaggcacccacaatgcccggctaatttttgtattttcagtagagacggggtttcaccatattggccaggctggtctcgaactcctgacctcaggtgatccacccacctcggcctcccaaagtgctgggattacaggagtgagccaccgcgcccggccccattcatctgttctttaagagcgtttgtaactaaaaaattttaagtcagatttggaggaagaaaattagaggttttggggaggataagtcttgttcactgaagagtccctttcacataatttaaataagagctattgtgtatgaagctgggcacagtggctcatgcctgtaatcccaacactttgggaggctgaggcgggtggatcactttaggtcaggagttcaagaccagcctggccaacatggtgaaacctcatctatactaaaaatacaaaaattagccggggtgtggtggcacatgcctgtaatcccagctacttgggaggctgaggcaggagaattgcttggaggtggaggttgcagtgagcaagatcgcaccactgcaccactgcactgcagcctgggctaccgagcgagactccgtctcaaagaaaaaaagctattgtatacgaattgggctgctattatttattctcagtatttaatagtgaagaaatgtcttttctaatcatgcttatttatccattcactttctgataagcatttattgagtgcttaatgaatgctagatattgtttaccaagataggaactcagaaggttgagcaatctggggagaaatatgactaatcaaattgctgacacattgagtgtgagatgcttgtgggatatccaaatggagatgtccatggagggcagaggtccaagccaaagacttagatttgaaggtcagtaaatatgggtggtaaagtcattaaagtgtttgatgtaggtaagcccattcttgcatgtatagtgtgagtagaggatgaatgagagaaacagccaacattccctaggtgcgtggagggagtaccttccagagaggctggaaagtggttgtaaaaaaagccagcagagaaagacttccaaaatgagggaagagtaagctataccaagaatgtagaaagatctagtaaaataaagacataaccattcaaactgggaatcaattttagtggaaggctatcagtggacgtcagactgcagttagtagatgggaaacgactttcagtgtgctgtatgtttaaggaaatgattgattgggagataaagtcagaaaggacctcattacttagcacctggtatgtgatattttataaataccaagttaatggctttaactgggaaataataaaatcattttcctcctaatcccagaagacaatccactgagagaatgggatacttaaccaggggagaagacagtgataactttggcataacgtgtatcattcagagttcaaccagagaagtagagcagtagggtattatatatgtatcctattaggtgtgtgcatgtgtggagtttgtgtgtatacacatacatatagatagatacacatatattttacagagaatcggtttacaccattatagatctggctaagcagtctccacaaagctgtctcttcatctaatatcagagcctgaagttcacaggcaggcagtcaggtgggaagatcacaagcaggcttgaattccactaggatagactgaaacctgtgttttttgttgttagttgttgttgcctctgaccacggcagtaagaatgagcacacatacctctggcccagaaatcagacactgaaggaagatccaggggggaagagagcaatcccaggtccaaatgatgctttatgtcaatgaggcaagtcagcataccagcagcagtatgcatgtgtgcacacacatatgcatgcacatacacacatactgcaaaatggcaactgccttcctaacatcctccaactagtgtgaaagaatttatcgtgtagcctaccctaactggacacatgcaagaaaatggaattctggtaaatgtagtttgacctagcaagttggcacattacagagccaatacaatgcgtactttcagagatggcaagccttagaggctactagagtaggggttctgggtaatcattgtgcttcatgaaggtcctgtcacttggtagataagtgaaggaagttatgtagaaatctgagggtgggaccatgaagatcagcttgtttatcctctcagttgttctaagggcattgctgccatccctgttaacaaggggattaggaaataactgattcaatttgcctctctactacttccaccattcttaataataaaaagaaatgaccagtttctatttatttttttttcaggcaatatttttataagatgaatgatcttgattattacagtgaaaataaaatgatctctcagaatgttctgaaaacagttgtacaagtggaagttacagtgttggcttaaagaagagaacataaatactattcacacttctttagctgtactaaaagagctatagaatgtagccttatttattgttatgtaaaccagtaaaacttatccagcaagtgacaggaccttcatcctgtaccaaatccctgtttttggagtaagatgccaatggaaatagtggagctagtttaaaatcaaacatcagttcaaccaaactgatttaacattttcatttgtgttggggaagctcacggtctttaaatatcgatgagaaaggtgtctcttctaatacttgcttatgtgctgttaatgctgtactcccaaagatgatcgctaatctataatctaatctatacaactacacttttcaaaggatgtttagagtcacagacctgaacctgacttagggaaaggtgtttctccaagagcttttctgtgactacagattgttggagaaaacaggtagtgaaggaagatggcgcatgatctgctgcgctaccatgaagtagaatatatggtgatattttaaggctatatgtttacttttgcctaaattataaaagcaatatttttatattataaaaatttaaatgttgggaaataaagactcatataaaaaagataacaaagaagtaactgagatatgtcacaagttctttaaagcttcatccgtggaatcttaagaggctctctcctacttcagatgagaaagtcaggaagcatatcgtttgactaaacagtgatataaaaaatactaattaagtgacatttcagaattgcagttttgaaatgatttgctgttctgctcacaagaatcgtagttatgtttactaactttattcattttgtcttaatatttgctatagctgccgtgggcatggccacggcaaatgtaagctatcagactgaccaggttgatcacatcaatgaggaatattttcattaatccaagatggtgtttgattcagaatgcgcatcgtatcagcaacacttgccatcgaccattaaatgtgaggaattccaacagttagttagcaccaaggagttaacgatatgaaacatcatccagaactgaacaaatggctttactccttcctgtatcttgggctgtgtggaagttgtcagggtttcctggaaaagagttagatatgcttatatagattaaatatactaaagggcattccccgtaacagtcaagtaagtgttgggtaaaaggcaagtttattcatgtaactacagatagaatacgaatagtgtgaatgattccgtaagtattttagggaaagtattcatctttatgcaatgaaatatataaagtggtcattttcctaaagacaagaagacagttattttaattgacttccacaacttcccacttagagagttgctagtattaaaaaataaataaaatatcactgccatgaagattaagagtgatagtcagaaaatggacttcagaaaatgatacactttctttaggtaggaaagcagtaaagctattctcaagtgataaccttttattagatgctggcaagtctgaaatgctccttgacaatctcttttattgaacgaatcttgaggactataaacctagatcagtgccttataatccttgcataaggctgttgtgattaaaaaccaagtgaaaaacttcccaatagctcacagaagagtaatcagtctgtcttagtatttattagggtgtgtgtgtgtgtgtgtgttttaatgggatactgcttaagtatacaggccaggagtaaaggtaacaccatgagggagggtaaaggcatggaaagtcagattgggaactccaaaaagaaagaaagaattttgagggttgtcagagcttctcaagagatcacacgtttagagacaattcaaatacttttaaacaataataacaaaaaaatctactgagcctttagtttcatgatcagaatgggggatcaaagtcagaataccaggattagtttcaagtgattttaaagacaccaatattagaatggactgagacaggagatacaggttgcaaagagaaataaataacaagtcttcctcaagaatgaaaagaactctgagagacgtagctttggtcatagactagaaatgagaataacagtgaataattttttttttttttttgagatggagtctcactctgtcgcccaggctggagtgcagtggcgcgatctcggctcactgcagcctccccctcctgggttcaaatgattctcccacctcagcctcccgagttgctgggattacaggcgcctgccaccacgcctggctaatttttgtatttttagtagagacagggtttctccatgttggccaggttggtctcgaactcctgacctcaagtgatccacccacctcaacctcccaaagcgctgggattacaggcgtgagccaccacacccggccaacagtgaattttttaaatactgaaaatatctatgaatgctaccaaattctgaaactcttcctgattaactcagcacagaaaattccctctcattttgagcttcagttgttcaaactgcttccatggcagttcaaactgctatgtctccctctatcaaatggggacaacaaagccaggcttcatggtatattttaggctcagaagctgtcagaagcattttactgagccagtatggagaagagacaagcagagcaaacttctgcctgaaaaacaagcagttaacactgagtacttctaatataatggcgactaacaaaaatccttctaggcagaaaaggagaaaacacaaaacagtgagttcactgttacatcttaaataataaacaacatgcattagccatcatgatttcctgcacttgccacgttataagcttataaagcttcctaaaaatatttcattagctttgaaaactaataaatctaatgattacaatttatatttttaaaaacataagaaaagcaggtttgtgcctaagaccttgagtgtcaagaaagtttagagaggataactcattaaagtgtacagcgaatcataaaattcaatttgaattgaaccttccattttggcccaacctatccatgtaaaaaccagcaaaacaaatcattctaagtcacaagctgctgtatgtgttttagaacagatactatttactatattacccctaaataaaccaaggtctaagtaaatggtttctagcttttctctagttaagctaagttctttcttaaaaggaaactcgttctaattcatatttttcttctcgaagagggagcttatatttttctgtttctgcactttgaacatgagtattgtgggaaagtattaggggattagcaggagataaacgtggtttttgtcttcaccactaagtggatcaaattagtgggtatatggccatgattttattctgccacactatgacctgtgagacaaggtggaaaaagtagattctagaggcactgatggatacaggctaagctgggtaacaaggataccccaaaatgtaatgtctttgatcaaattgaagtatattatttctctcgataaataaaccaatagctagcagccccagaccagtcaggtgattccattcaattaagtcattcagggactcaagtcccttatatgttgttgctccccatttttttcctcgtatttctggtggaagccagttcactgatacatctgctttccagtctgcaggaaagggaaaaataaactccagggcatgcagctttatcataaaggaaatgaccaggaaattgcacacatcacttcttcatacatctcgttgacccggtctcaggcacatggccacatgtagctgcaagagaagctaagaaatgtggtctacaactgggtagccacgtgcttacctaaaattctagggactatactactaaaaggaagaaaggactaatagacactgggacacatttagtggtctctgcctcaagaggtatcagccagggtttggagatgacgtattcagcacaaaaaagataaggcagtgtttggacagggttacatgtaagttgtgattctcttgaacagacccctagtggtcactgacatttgaataaactgctaggggtatttcactttcaccaccactaatattctttactttcctcctcctttcatttttctttccgtcttgctcctccttttcatattccaattttccccccatatttttcctttttgtttcaactgctcatgatactgaggtctaaagaatttactgagtaatgagcacagatgtatgctttctttatgcatttttaatggctgatttaaatatacttggaggctaaaaatgcaataatttgctttaaatgtgtaggactctggaaagatgagaaagcactgtaagagttaaataaatcaagaaaggatttggaatagtgactatgtaattaaaagagcagaaataaaggatgtgccttatcaagatgtaatcacaaatattggaggataaaaagacctctgtattaaaacctaaagatatctgcattacaaaaaatgttcactttgtggatgacttgaaaaactttcgaaatgagtacaattataagcagatctgatgtttttgtcagaaagcaaatcacgaggtacttcttccatccactcaactcaagggtaacaatggctgtactttctgcccttcatcatcaccaggagtttctgagtagccttttagagcaaatcaatttcctggcaggtgagtaatttctactgtatagtcatcattttcccgcatcatttatctaagacccatcttctcaacactcaggtgcaacatcacaccttcccaggggtgaggtcatcaagggcatctgggtgttaaatgtttgatgttaacaagagggacaccccctcttctggctggtgtccaccgattgttctagacaccatgaacttttgtttcatgcaggtagaaaacagccatcaagagctaaaatttgagcccttacaagaatctttttactacccagcacaatgtggtaataatattcccacttctcaggcccttttccttcaagtgaataagatttcctctctattctagaggagccatgctactgcctctcttcatttgattactgtgggaaatcccccagcagcttattccaagttcactgcgcagccctctgattcctgaaaggcataatttggcctaacttgatatatatactatatatcatcacttacagtaatgtttgtcccataatagtaatactactactaataataataataattgctaacagtgagtgagcactcaccatgggtactataaatttatattaacttaattaactccaagttatttgttgttacttaaattctcttataatctattgatcaaacaattgagttgctttgttcctaaaagctacaaaaatatatagtaatgtagtataaaatctattttcataaagaaatctgacactacagctgaattatggttagcaaatttaaaattcataccttgttttcctcttgtgattttgtctccttgaaatttgagcagatgttgttatatctttcagcaatcacatcctcaactatgagcttaatataacgtacccctttcattacttttcctttcttttagaattcttagataaatctctgatttccaaagaactatctgtgctttgatattggcaactattatctgctgtaggtcctagtacttatttaggtaaaagatcttaatgaagttccaacgaacttcatttgtctccgtgtgtgtgtgtgtgtgtgtgtgtgagagagagagagagagagagacaaagaaattcttctcttttttcatttctgaataaagctttctagaagagccattcagtgtaactaatgacaaaagataaatatgttttgtaaaccactttgcttttatcttaaatggggagtcttcggcaaaacatttatctttaccatgaccgtagagtaattttaatatacatgattaatggtgcaaatgaaattaaaatccccctactattcaacatcttagttaagaacaaaatgctcactgtttcctaattgcaaagagtaaaatgtctggatgttgatgctttttaattagaggagaattttctttttaattaaaaaaagagagcttttttatttttcagtaagttagagagtgtcctctagtggagagagactctgatctcatagttttagaaatggctatatgatacccagttagaactgtgctccacttagctgattggaatctactggttgaagggaaaaagtattgtttttcctctaagacccctcaaatcatggcctagttaaaaggctgcagtgtgacaagcattgttctcattttagataggaatgattttttatgatcaattttagcatgcttccttctgaacctgttgaggttgagctgactgtgcacctttctgccaaaaaggaggcagaagcatttagtgcaatttactgtggcttttacaggtatcaactggaggcagcaagaataccattgtcttcaggactgcagacctggctgactgatatatttgatgtgtgcagatccctaggccatagcttaaatttgtttcttttattatttgaaggaaaacaaagaaacaaaattgagagacaaattaaataaaggtctctcttctccttaacttgtcgaattctaatgctaatttcctgtatttctggttaaatgtgctaagcagtcttagctctatcacttgtgtatcagagatgagaggtggaggagttttttcgatatctaaatggaagagggtacggaagagctgtggtggttggctctctgaatcacatactagaattgccttatcagaaattgcttattacagcaaattagagactgaaagaaaagaacgatagttgctcttgataacaagctaaatagcttggacttaaataaagataaaaattttattgctgattctttttttaattttaattttttaagttctgggatacatgtgcagaatgtgcaggtttgttacataggtatacatgtgccatggtggtttgctgcacccatcaacccgtcatctaggttttaagccccgcatgcattaggtatttatcctaatgctctccctccctttgcccccaaccccgacaggccccagtgtgtgatgttcccctccctattccatgtgttctcatttttcagctcacacttatcagtgagaacatgcagtgtttggttttctgttcctgtgttagtttgctgaggatgatggcttccagcttcatccatgtccctgcaaaggacatgatctcattccttttttatggctgcatagtattccatggtgtatctgtgccacattttctttttccagtctatcattgatgggcatttgggttgcttccaagtctttgctattgtaaatagtgctgcaatacacatacgtgtgcatgcatctttatagtagaatgatttataatcctttgggtgtatacccagtaatgggattgctgggtcaagcggtatttctggttctagatccttgaggaatcgccacactgtcttccacaatggttgaactaatttacactcccaccaacagagtgaaagcattcctatttctccacagcctagccagcatctattgtttcctgactacttaataatcgccattctgaatggtgtgagatggtatctcattgtggttttgatttgcatttctctaatgatcagtgataatgagcttttttcatatgtttgttgactgcataaatgtcttcttttgagaagtgtctgttcatatcctttgcccactttttgatggggttttttttttcttgtaaatttgtttaagttccttgtagattctggatattagacctttgtcagatgggtagattgaactttctcccattctgtaggttgcctgttcactctaatactagtttcttttgttgtgcagaagctctttagtttaattagatcccatttgtcaattttggctttttttgcaattgctttggtgttttagtcatgaagtctttgcccatgcctatgtcctgaatggtattgcctaggttttcttttagggtttttatggttttaggtctaacatttaagtctttctttaatccgtcttgagttgatttttgtataaaggtgtaaggaaggggtccagattcagttttctgcatatggctagccagttttcctagcaccatttattgaacagggaatcctttccccattgcttgttgctgattcttatatttgaaaaaaagggggataaggagagtgttcataaaatccttcagtaatccaacaaatgtcagagccataatgaacaataaggcaaatatattcccttttatagataattttcagaaacatgtatagtcgtgactcccacacagatggaagaatgaatacatgttaaaaaattttttgctgatgtgatatgaggggaccaagcagatgttatgaccagttcaaaggaaatatcaaagcagcagatttacacagattaaagaaatgttgagatgaattgtaaatggagacaaaattgtttttttccccaggttataggggggataggagaggtgagtcaattaaatcactatcagacaggagagaatttgtacccctatcagtgtcctacattttacagagtcaaaatatagttcaaagacagtaaaaaagcctttgggaggccgaggcaggtggatcacgaggtcaggagatcgagaccatcctggctaacacggtgaaaccccatctctactaaaatacaaacaatcagccgggcgtcgtggcgggctcctgtagtcccagctactcgggaggctgagacaggagaatggcgtgaacccgggaggcggagcttgcagtgagcccagatcgcgccactgcactccagcctgggtgatagagcgagactctgtctcaaaaaaacaaacaaacaacaaaaaaaaaaacataaaaaagcaggaatccaataatctggaagggtgtgccatagaccaatgagtagttttccaatgaaagatatttctttctacataactttgtaaatatatatatatatatatatatatatatatatatatatatatatatatatatatatatatatttctgtagcctggttgggttgccagtgacccagttttatatcctactttcttgtctacaccagctacttctctacctacaactgccattattgtgaaccctctttctctttcctcttctccagcctccctgtccttgcttcctgcttacaggacctgccctaatatttttcaattttgttgcttttctgagccccagttccactttaaacaaattccaaggtaaaaacaaattgttctggacagttaactgtaatcacttgcatgaaaaaatcacctgagggtgcttgttaaaaattcaaatccctggaactctccagacttgacttgctgaatctaaatctggtggggggtggaggtaaattttttgacaataaatttggaactcactgacttaagtaaaataagaaaaaaatgtaacatctaagccatatgactctaagctaaatgacattgtagaatatatgggagtataaaataaaaactgatatgaaagttagtggaaatatgcaagaaaaagcaaagttaatggtagcattagtaattgctagtaataactttccctaaagttcctatcacaatctatctagcactaattattttcaagttgaatatctggaatgtcaatctattaattttttaatgtccattctagatgctatgctaagtgagttttaaaattatttttcctttttaattgaaagcatacccagacacacattaaataaacacaaaaaataaaaattcataatcattctgttttttctttgtatcactttccattctactgaattttactaattataaatttaaatcttttaatcttgcacttttttgttatttctagacttcaattttaagaaattatttttcctccacatatttataaaatatatactttctcctatatagtatatttatttcatagtaatatttaactctaataaatcccacatttatttttctatattatatgaaactaatttttgtttttagaaaataatgcaattctgataactcattgcctggagttaaatctggtaccatatctgagcactacaattgatttcaaagagttgtaccactgcctgcgggataaacatgatgttgtttttttataattgttttaaaatacattttgctctttgtttagaccaacaacgtaatgtccagatctatcatcattacacttctttaggatagttgttgacaatatctacctacttaaatttctaaataaatatagattttgttgagttctacatcttattggacttttattagcattagcattacatctaaaatgtaacttgggaatggatttgtttaattgtttattgctagtataaataggatctcttctattttctaattagtaactgtagaaatcatggatgataatgatttctaaatatcatagaccataactaactacagagtttcttcttaaggctggcaaaactatgataaaaatcagtgtctcttagagaataagattaaaaaaatttaaatcacattaactatagctaaactgtaagtacattaaatttattgctacaaatcatgtagtttaaaaaaaacccctcaaatttgccagatttacaaacttaccccactatggaaaactggctttcttctgaattgccttcatcaattatttattgctgcagggttgcaataggctgaggtagatgctcttatggagtatctaatatttcatattaggcagatagtgtttcatttttaaatttcaagccttgtgcctgtaatcacagctactcaggagaggggaagaccgcttgagcccaggagttcaagaccaggctgggtaacatagcaagaccccatttcaaaaatatatatatatatatatataagcaaacttttttaataattttagaatctatgctcttaagacccacattctctcttggttttattttgcatattctcttttgagtttcttaagggtatttttgtctggacctaaagttctatccaaatatattgaaaaaaatgggtagcccctcctttgagaattaccacatagactccatttgatctataggatagtgagtcttatttttacgtgattatattttgtttaaaataactcaaactatagagaattttatattttggaataccaatacaaaagaatgttatatcaaaaggacaaatttttaaattttgctagtaagtgattacaatatatgtcttagatttgaatatttaaaataactttttaaaaagtcaaaatatagggctttttaattggttaagtatgcaatcaggttatcttcaaacaatgtttttattgaaattggttcaatatatgaagcctttatttggcaattttcatctttatgcactttccaaatgttagctagttaatctgcttaacaatattccattaaacagttgtacacattttatgttcatacactcctataaactttaacaataataataataatgatgcttttatcagctttttaaaacatctcattgctttgttatatcctattgtattagtaaaacttctaaaacattatcatattaaaagaatgctggccaggtgcagtggctcatgcctgtaatcccagcactttgggaggccaaggtgggaggattacttaagcccagaagtttgagactagcctgggcaacatagggagaccctgtctctatttaaaaataaaataaaaaattagctaggcacaccaacctgggtgacaaagctagaccctgtctcaaaaaattagccaggcatggttacacatgcctatagttccagctacccaggaggatgaggtgagaggattgcttgagctcgggaggttgaagctgcagtgaaccgtgattgtttcactgcactccagcctgagcaacagagtgagaccctatctcaaaacaaacaaacaaacaaaaaactgaaaagaatgctagtaggcacatttctatataccaacaacatccaagctgagtgccaaatcaagaatgcaatcccattcacaatagccacaaaaaataaaataaaatgcctagaaatacagctagccaggagggtgaaatatctctacaataaaaattacaaaacactgctgaaagaaatcagtgatgacacaaacaaatggaaaaacattccacactcatagataaaaataatcaatattgttaaaatggccatactgcccaaaacagtttaaagtttcagtgctatgattaaaaagtcaaaacataacagatgctggcaaggttgtgaagaaaagggaacgcttatatactgctggtgggaatgtaaattagttcagccactgtggaaagcagtttgatttctcaaagaacttagagctaccattggacccagcatcccatttttgggtatatacccaaaggaatataaatttgtttttaccataaagacacatgcatgcgtacgttcattgcagcactattcacaatagcagacatggaatcaacctagatgcacatcaatggtagactagataaagaaaacatggtttatatacaccatggaatactatgcagccatcaaaaagaatgatatcatgtcctttgcagcaacatggatggagcgagagaccattattgtaaatgaagggaaagaaaaccaaataccacatgttctcacttataagtggaagctaaacattgagtacacaatacaggtatacttgagggtggagggtagagggtgagaggaggctgagaacggaaaaactacctaccagataccatgcttataacctgggtgatgaaataatctgtacaccaaacccctgtgacatataatttacctatataacaaacctgcacatgtacccctgaaagtaaaaatttaaaaaaaaaaataatgcttgtaggcatatttctattgaatttaaaggagatgatactgtgagtcccattgtatattcttgtttaacatatgtttacttttaaatatttggaatggaatattttcagtatttcttaataaagcaagcctacaataatttatttagttcctaaaacttgccaagtaaaaatatagtctgattttataatcatacattttataaatcattttataaattcattatagtgtttataacacaaaagtaggtaaataaaaagcattttagatatgatgttgacaattgcatgctacgatccaatgagaagcctttttatcttgatgttttcataattttgaacagtactggtgattagcaaaatagctatatttaataataaaattttggtttaatatgaatgttagggaccacaaagagatcctacttcactctcactaggatggctataatcaaagcgacagatgctaagaagtgttgacaagcctgtggagaaactggaaccctcatacattgctggcaggaatgtaaaatggcacagccactttgaaaaccaatttgttatttcttcaaatatttaaacataagattctcttatggcctagcaacatcactcctaggtatgtacccaagaaaaatgaaaacataatgtccacacaaaaacttagcagcagtattcacaatagccaaaaagtggaaacaacccaaatgttcatcagctgatgaatggataaacaaaatcaacatatgggatatattcacacaatgggatattactgatacatgctatataacatgaataaaccttgaaaacattaaactaagcaaaagaaaccagacataaaaggcaataatattgtatgactacatttataccagatgtccatagagacagaaagtagaagtagattcgtagttgctaggggctaaaatggggagtggctgccacttggtacagggttcctttttggggtgataaaagtgtcctaaaattgattgtggttctgattgtacaattctgtgcatatacagaaaaccatggaattgtacaaattcatgctatgtgaattgtatctcagtaaagctattaaaatatgcatactatgtatgtaaaaaataattttatagacagtagcatctggtaaatgtttaacacttggctctaaatgtagttctgccaagaatacagttcatatttttgtttacattagctaataaaacaatggaggtgcatatcagaactttactcactcatcagtgatgtaaatgagttctttgcggaatcatattttagtaggagaatattttcttgatgtttgtgctattcccaatatggcagctatagacacgacatacttttaatttaacctgcattattaacattttccctgtcacattttaagtacagtcagtcaacaaaacaataaatcatagcctgatttgtagcatttgccaatgtatggagtaaatactccccctatcgtctttttcaagctaccaacataatgtcattaaacatatagttgagaagagatgtgcagtagtacactattgtatagtatttccaccatacggatactatagctgtaaacaatctcaaaagatgagtgaatgaatggtaaaatgtagcaaaataatttggaagttttgagtatctattatttttgtttttaattttttttgtatttctataatttaattttcaatgactgtgcttaacagcctgctcacagaatttctgaaaatgtggtaactgacttttgcaagctggtgtggaataataccactgaaataatacctgaatgaggaggctctgtacttacttacaatgtgaagcctagtttacacgataaatttgggctgtggagacatgtagacatgtagcctttaattaatgaagctttaaaaaaagggaaacaaggtaaaatgaaagttcaaaggatattaagcaggttattcattaatttgagattatgtattgagttcttaatatattcaagatgctgtaatgggtcctggtaatacgaaggtaaataaagatataatttctgcctttggggaatgcatagtcaagttgctgggctagatatgtgagcaaagcagatactgaaaggactatattatgataaaacagaaatatgttccaaagtctatggagaaaggagaagagaaggaggaagaaaaattaaatgagtattttttgaaagcgcaggcctgcattttggaagaagtttcatttgaattggatttaatggatgaagcgtgtattaggtgaaaatgagaatttaaagcaaagaatataggcttaaataaaatcaagagactataaaatggaatatgaatgggtgactcccaaaattcagatgctaaaaacctgttgtgtaattggcatatcctagttcattggccaaaggtacaaacacagtcccatcatttattactttcataactactatttatcctttttaatccttatttgcccttatttggtggacatacatcacttattcctaagctccaccctgctccatgaatttctatcaagtcctggttcttattgagattcagaggaaaggataatagtccttcattcccactttcaaacacaaggtaatacagttgggttccaacgtcacagctctctgacacaggtgtgattaattactttttcccaataaatagtacctggtgaatccagcttttctccacaacactaaggcccctggttagagactcaggtgtgagcttgacctcacctggcctgctctcagaattgactccattggactcctagtgtctaggctgtgagcagagcaatgcataagaagtgaagtggtaactttgcttagccgcacaaatttgtacaattaagagaaaccactgaaaagcctcttcacagaacaaagcactgctcaaattgactttctgttctgcctatattgagaagcaactggcagttcccagatctctttctctgtgtgggtgacacagtgatacacacacacacatatatacacatatatgtatacatatataaacacacatatatatacatatatatagagagaaaaatatatatattttctgccttaacaggattcctacttaatgtctggtttaagaggttccctattatcacattgataaaaagcagagtgttctgtaattactgctaccacctatgctttatcactttaagaaattatgtggaaataatctgatctttgcagtgcttattccttatgtgatcccagagtattgtaacattctcaatccttgattctgtctgatccaatctcaggtttgaaaatacagtaagattgttctctttagaatagagatgtgattgcgtcagtctcctatttgaaatcttccctcaacttcccattgccctgaaatggaagtctcacattttccacatgccatacatagaacagcgctgctcctgctcttgcgtcatcagggtccattcgtctcctaatcttccctctacttgcccctcgtctacactttagcttcagccccttcaaaactattttattttccccaaagctcccaggctttttctcactcatgctctttcctctctgtccagagtgtttttctattcttctctccaccgtcttctattccttccttgaatttcactgtcttacccacagcaagcccatctcaagactggttagagttctcctaggtgtccccatagcactgtagatacactcagtactggagccccaggcagggtggggtagtcaaagaacaggtgagccaagatggctgagaaagcagattgcttcttacatgggtgcaggagccattttttaggtgtggcagcacaaggcctgcaggtaaaagaaaagaaatgaattataaaattatgaaaaataaaagtgaataaaaatgaatttcacagttgatgtcggaaagaaaggagggtgatgtgagacagtaattcaggttccaatgaggaggtcaatcggcctctctgctaaggaatgtcagattccttatttatgatttttaaggtcccatatttactaaaattgtaatggaaaattaggcaacacctggagatttctatttatgagttccaggcattaagtcccacctaaaaacttaaacttggtcttataaaagacagtataaattattaatatatacatttttaaaactgtaatacatcttgattccattggcatataatgttaatcatcatactaggtagtattttgagacttattattgaattcgtgactaccttggcactataacagatagtcctggtacaaaaaaaaacaaaaacaaaaacaaaaacagtgctcttataaaaatgtaaacacaaagaatatttgatttgaaactgttttgtaatgttggttgacacttgccgtagaaatctgcaattgatttccaatcaatggaattgacatttattcattttgtaatgtaaatattctctaaaggagagggaattttatactaaaatatttctgtacaaagattaataataaagaaacctccttggagcctcagtttgcctcttaaaagtttgtagatattttctggacttgccttatctggtcatcagtgatgactatcacataaaaaatccggctggacgtggtggctcacgcctgtaatcctagcactttgggaggccaaggcgggcagatcacgaggtcagtagttcaagaccggcctggccaacatggtgaaaccccgtctctactaaaaacacaaaaataaattagtcgggcgtggtggcacgtgcctgtaatcccagctactccagaggctgagcaggagaattgcttaaacccgggaggcagaggctgcagtgagccaagatcgcatccctgcatcttagcctgggcgacagaggaagactctgtctctgggtttaggggcgggggaggaatccaagtctgtgaggaatctcttggagaacatgcagacataagctaaaatagagaaggctatatcatgccatattagaaatattagaagagcaataattttcatgaattattcttaaacaacgaacataagagaatacgattttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcggtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcgtattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagaccttttttttaaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttacttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaagtcagaaatccattaaacccctaaagaaacaatattaaaataataacataaaattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagaaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggatttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgaacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgc

SEQ ID NO: 1613 - DNA, 128799 bp, Homo sapiens
cagcattatgaatgaaattctttgtttttaatttcacacagtttaaaatacaatatgaaatcaggctacagtatataaaaaactctccagcaaaatgatgtgccagcatcagctactaaaataaacaaacaaaaaactccgccataagaatttttttgcatttttttttaaaaaaacatcgacacttacatcgctacatctctaagctacctcagttctgatttttaaaaagcacctgcttttcctttttttcatcttgcttctaaattttcagcttttaaaaaatataaattatatgaaaatacaagttggaaaatagtcaaacacaatataacatctttttcatccctatacttctcagcttaaaaaaaaagtattcttaaaaaaaaaagttcaataactgaggcagtattcctgataattttattttaatatatatattttatatatgtatatgtatacatatatttatggttccttgaaacttctttggaatgtaggtaagagttcaacaaatttatatagaccccaacagagtaagcggcatgcacagcatgactagaagagagatggtgtatttctcaccatgaaggttaggcaggttaatgctgtaaaacccagagtgttcatctccaaagtgaggaaaagcacatctgatctttgaatgctacctccaatccccacagccacaaaaatcagggctctatgtaggggaagtccctctccagaatggagaagggaacaaaagtgactctgaaccctaaagccaaaaccaacaaaggttaaggcatctctgggaaaataagggtttcacccagctagaccagatttgcccatccttcctctgaagttaacgtgtgtttttaaaaagcataaacgcaacatttccagtgtataaaccacccaccactcttcctgggatggtctctggcctttggacaaaggagaaaaaacatctggccagatcgacaaagctgtcttaactaatacactatctacaaatcttgaaaatggtggacttagagagaaagggaattttagcaaacaagcgggcggaggagcactaggaggcactttcttatatcttatctgctataggaactgcaggagttatactcacagaaggagagtttccggcataaatttaataggaacggtggatgatttgagaaagtgattttatgcctggttgcaaacagcaagcaataattgatacccggccctggttctactcttacccattattgaaatgtggaaagacttacctagaaatctaaggtattatttcagctgcagttttgcatgtctgcaaacacacacacacacacacacacacacacacacacacacacacacaacattcacacacatgcacacattcacacacacaccttttgccagtgcccaacaaaaatcacataatctaagagaaaacaatgtagtccaaacagttccacccaacactccctgagcagctcctaaaatattttgagagcttcattaaggcacctgcatccaaaagatcaaaataatacagctgggataattctgcctttgctttccatatggatgctccaattcatcagtatggggacactcatgaatcacagagctatgttcctgataattctgggtctgcaagaggatctgggagtaaataacaatcaattttcttaaagatatgctagaaagtagttagtacttccaatttctcatccaaatcccaaaaagggccagccctgagaagcttacctgaaatatttctttccttctctcatggaagtccataaaagccacccctcctccttatcctttcaactgggcaactatagagtgagggagattctaattgtattaggcacttttcctcactagttagatgttgacttttcctctaaaactccattttcagattccccctcacaaccagcagaaagatgactaccttgcttgactatgtttgtatttaaaccttgggggaactaaaaatctattcaaatctcatggacaaccttattttcctcactgaacctccttccttagtttcctttgccttcaagtcattcctctcttctggaattaaccttcacttaccctgtgccaagacatcagacccaagcaagaggccctggcatcacctgtgccattcattttgcatacacagtctcacctgacatcctaccggactaatttaaattcttcaaaggaaagccttgcacttctcttccaaagacagccaagtcacattttattgaaatgctctcttaatttccatcacttctaaaactcagcaagtctaaactcttcaacttaggtcgtgtctcaagttactttttcactcaccaatcagaaagccgtacacttctctctactgaataacagagttggcggtgagggggtgcaaaaaatggaggactcttggaaaataagacataaaagaaaaattacagagtgttagtttggaacgacatgcattcaggacttatttcttaggacctgaggggtaatgcccatgcatacagcttttattccaagtcatctatgctacagatataggactaagaaagaaccaagtcaatcttcctccttcgatctcccttccaggacttcaacagtgctcctacgtttactgtcgtccaaaaccagggatgcaaaatacattcagttcaaagacttaatgcttcttagctcaacattaagtccaaaccccgagaatccactgataacaagtaagtaaagggatgtgctaattttttttaattgtagatgacattcacacacataattcccctgtacccaaatcagcattaattgtccttcttatataagtcccatgaatttgggatccctgatctcagtgagagcgttttgcttttccaatggggtctatataaacagttttctttcattgtgacagaatcctcagccggcaaataaaaacaaacttacatgatattgcaatactgagaccaccttagagcttaagacgatttttaagaaaaaaaatactggcacaaaatttaataaaataaattttaacacaacaacggttttggcccctccccactgaagtccatctttgcttcaaaactagagtgataggtaaatagttctcagattttcagtgcatccccccccaaaacatgtttcatcccacccacctcttttttgccctcccagacctaaaaacagaagcaaattaattgccttacatcagtttcatgagttctgatgtgacaatgtcacttgctaatgggtccacaactcaagacactttttcatggatgatttttaaaaatgattggacacattagtctctttctctgttaagccagagccttcaagcttctgagaaggcccttctccctctcctgaaaatttgctcaagaatttctggtcccacccaccccacaagtcctggctttcctttcccaactgcgcacaattgattacagctgcaactgacttagctcccacccctgaaggtaaaaaatgagttctggaaaataaaaaatagaataacaattcaaaattcagagtccaaccaacacggctgtccttggaaggtctcagcagggtttccccagccccttcagtgccatcactcgtcggcatctggcttgacgtccagcatggcgtgcagctcctcaggggtgtaccccagcaggctctgcaggtcacacacaaagcggtacacgtagcgtttccccgctgtcttgtggatgatgtttttgtcgtaatagtagcgtaggccacggctcagtttctcataattcatcttaggtttgtttttcctctttccccatctcctggccacctgaaatttaaaaagaaaaataaaggaggagtaggcaaaaatctacaagacaggccaaatatatatgtttctatgcctatgctatacccattcatggtgacccatgatgctcaagtaagatgatttgagattcatgtagatatagaaaatatttttcgggcctatctcctgaattccatttttcatgggttgggcaaggatgggagtcacaatgattctttaagttgatgaaaacacagtgaccctgaactaggattaaatatgtgactttaaaaaacaaacaaaaagccacactatacattctcctctttccgcatattattagtaaaatctccttgctttgcaagcatgaaatctaacagggaagtgtgaagcggaggagctgagctgcaatcatacctgcctttcatcaacaggaagtgttttttttccataccagggcacaaatattttctcatgtctgccagaacaaagatgttgtctctcctgttcattgttttttatcctcagaattgggcatggcacggaaccactactccataaacatgtgtgtaatgaaataagaaactaatgagccaatctcccaaggcctcttgaactgtctggcccctttcacactcacagagccaccgggctaggaagaggctaagtcacaggaggcagctctatgggtgataactgacctactgccaggcacgttaatgccttctatcagctaatcctgtaagacaaatggggtaacatagatcttttctctattttccaaataatgaacctggagctcagacaggctacctagcttgctccgggtggcaagtggcagagctgggaatcccaatcctggaacacgtcattcaggcccacgccaccccttccaggagttttctctcatccttcctcaacacagtactcgcaagcccctccttccttacctcatctgggtcagaaagtttgaattcccagccatctcctgtccagctgataaaagactgacaggatttatcagtgagtaattccagaagaaactgccatagctggattggtccactgcctagaaacacaagccattgtgaatcattacaccagatattcagcactctacgcagctaatccccacacacggcactcccacatccctcttctctcagcccatccagccaggagaaaatgaaggcaacagacagtgcacatgtcggaggaagtgttatgagctcgaacagatagaaaagacaaaggcctccctataaaacaaaagcatggaagaaaatgtgtcaagtgctttattttgattaacttaaggatcggttcatttttattgctaaacaaattctagaaagagaacactgtgcctatcctctgggatattctaaggcagcataatcttttacacctgcaaaaactaagtcattatttttgccttcagaagtaagaaacatattaacgaaggaatgaatgtctttgccagttccaaacacaagttatggctcataagcactgctctgtagtagggagcctgtggcccctgatttgtgagtaagaaggatcactatcctccggccctcttacaaggaaatagatgttaaatatctgttcagtcataatatttctctccactgccaccaccctgcccttccagtccacttacaggaaagcacccaaaggaaaaaaaaaaaaaagcatcattactatttgaggaattaacgtgccacccagaaaatcctcaggggtcagatgaggactgtcagaaattctgcataggttcagtatattctaaattagacacacacacacacacacacacacacacacacacacacacacttctctgtcttagccatcaacactctgacagtcaatttattctatgctaaaaggtttatatcacaccgatttcctttgaggatacttttctcatctgaaatgacaatgccaccagtgattcttaatttataggtgtcggtggagagacaaataggggttcaaaagtccatgcttcttgttacactgccccttataacataaacaaactgggcagagcgggactgggaaagacccagtccatgtctctggatacagcccaggaagcaccagctcctacaggaaagctttgctcactaaggctctaatttttcaccggagttgcaaatttgtctgatccaaagtaaactgagatttaacaggaaacaaactttaagttccctctcaatctaaaaaagaaattgccttcataatccataagggtaatgtcttgttgtatctcatatttctacaagacattttcacatgcatcgttgtgcttgctcctaaaatccacacccaaccctctgctgtaaggagaggcacaagtggtcttacggcttcctttctaatggtgcagaaaaagtgctcagcaaagtactgtgactttgctctgagccacggttagcgaaatggtggttctgggtctagtacccaggcctttagactcaaaggaccagggcaacctccaatgaagtaaagaaacagctactgacacgagctatcatcccacagccaaaggaagtcctcctccagtaacaacttcctaatggtggtttccaaggctcctctcagcacttgccacgctaaatatgaaaacatgaaatagctctacctcctctttctgagaatggaccattagctctttaaaactatcttgcaagaaataccttacatgtattccacaataaaatggctcagtgaatgcctataaaataaagtaacattcgaacaacagcccagagggccgcactggtaaagccgtagcttcctctgtttctactttcattcaataaaaaccgtttcgtattcaactcagggacatttgcaggtttcttgggagttgcctaaagtcatgagctacttgttttctgcctgggctcacaaaactaaccgtgacattctcagaggaatccactgagaagccatcctaacaggcacaaagaagtaaaacagcaaatcgctctcaagaaatgcagctgccagagccctggtcacagaataggtttcttggagaaactcacgataactatagagactgaagagagacatgaagaaaaccattctatcccaaagctatgtaaaagaagcctcggaggagagggggttgccttagaccctgacagagaaaaactaatgagtgctatgcttgacggtgcacctactacgccgcagacactgtgagtgacgctctacactcgtttccttcattcctcccaataattctgtggggtggatgcaactgttgtgctatttgtttctaccacttcacagcagagaaaactgacacactgcaaggccatttagatcagcagtggagtagccgggactggaacccatgcagcccatccccaggttcttcatctcaatgctacgttgcccctggacaggaccaggccaaaggcctggcatctaaactgcctgactgagtgcaatgttccaagggataaggggacctgacttgaaaaactctctcccctacttctcacagcagttgcaggacacgggatagccagtggttctcccagtcatccgaccaccagtggccgtgccaggccccgccatggcatccacctccacaggagatatttccagcatcctcttgtggtagccattatgttacattacttcattgtttctccttcccaatgttcacctttgaacctctctcccactatctgaaaatctctttggggcacggggtctcatgacaccaagccgaggaaagggatgggaagatcgagatccttcccccggatgagtctttggcagggagctgtcagcacatctgctggtgctggagaacagggcccaggagcacactgcagtctcctgcccttgggacttggcagccacaatgcagagaagggaccttcaattcccgtggtttgcaccagctcccagaggacgaaccctctgacggaatggttagttttccttttctaccagtgcattttccaaactgaaatgtcaagcagtcataggctgtagatgccctgccctgccctttctctgtgatgtcagcatacgggacccggtgagtctgggacagggtgagtactcgtcagaggacttttgtcctcattgtgacttttcctttgttcaaaaggaatgaaagaaaaaaaaattaaattcaggccctagaagcccaagtcctaggtgcagagctctctaactcttttttttttctgtttacacccaaggaaagagggaggatagataggaaaagcagatacctaaagaaataatgggaatatgaatgggaagaaatctctcccgttggcttcataataggacagtcaacataacagagatgtcagttcctggctccctcccccgattcctgtagagaaaccccacaggcgcactccagcctaactggtgcacacagggctcacccttcagaaagcccacatttttgtaccaagtgagaggagttcatgatggccgctgaagcgtcccctctagcacctttttgctgactcctaaactgcctttttgttgtggggagcaagagaactaggaaagacatggaaatgttcttccagccagaaacactgggccagggtgggcgcagttcctggctgggcccgtggatggtctaatacaggagcctgtctccacagcaatgcatcaccctcacttcaggtctgggaggggacttcagggccacttggaaacccaaagcttagaggcagctctggggttggaaggcacactggctacacagatccaccagcgacacccacatccaggcccatcagaagttctcacacccaagattggtgcagacaatgaatgagtccagcactcccagttacgactcttctagagggtgtttctgtgtgcttagcggaggtctgcccaaatccacagggctccaggaccccatcccttgcccttgctccaacatatcctaaacttgtaaagcctcttcctccattccccctgcaactcccccttatccctgtgcccagcctcttccacctacccaaatggactgtggtctcagtgacctttgtcccctagagcagaaaacggtactaataatagcgccagtcatgggaaggggagctcacatgttcaatgtgactcataatggtgtccctgtctgggatctccaaggcagtcaacagcacccttcacgatgctgcccgggagtgtcacacatcaggaatccagtggcatcactgggaaagtatgcttctcaagtcgaagctctgagccacaacaacagaggggtccctgttagaaggaggtctctttccagagccatgcgggcgggagagcaccacacacacactccacacacccatctcccatggcacggagcctccacaccccctgctgtctgctccctctccaccctccctctcaggcggctgcaggggaatttccttctactgctttgttcttctcagcctctggagaagaggacagttcttactacacactgacaggtctgatttgaagaacgtgctacaagctctgaagaagaaataccaggtaggaacttggagagctcccaagcctacaaagcaaatcacaccaaggatgttcaccccctaaggggacccccaaggctcctcaaatctaaggcaacaatctcactttttaaaaaaagtaaagcttcaagtaaattactgctcatttgggtcatatttccttgtctgggagctgcaaggcccactatctgtctcaatgaggagctggttattaaaaatcccctgctattctggtcccttgccctgaggctgagaactgagcagcataaatacatatatagcaatgggctaggacaaggtgttagtaacatgctcttgatggaaatcccttccatttcccgatttgtcagtatcattcttctcattttccagatctgggagttgcctgcctgtgacaaggacatcctcacagcaagtgaacagggtcaggttgaacttcactttttccttctactccttcctcatttccatttcaaccacaagttctcactcttgtcacctgtgctctgctgagaggagaacacaggagttttcttccaaacagaaggaggtcaacgctgggcaggcaccttcccaggcagtctcctcatatttccatagtacatggcttacaccaagaccaccccattggtttggtctctgtccatttctcccatcactagaatatatgctgtaaggacaaggactttgttttttcactgcttcaacccaaagcctagcacagtgcctcaccaacaaacaccaacaaacaaaaaattctttgctgttgaatgactgtgtcatttgacatgttctccctgagaacacagactatatcttactgagccatatatcctcaatgccaggtatgatagcttgtcttcagcaggtactcattaaatattttctaaattacattactgaaacaaacctcctctgaagaaaggcatatggattagaaagtccgctcaaatggcttctctctattaaacaatatttggggccaaacaatatgggtgaccctcaggctgcatttcatcaacgtgttcccaaaaatgaaaatgactacctgtcctttgggagttaatttgctactttaagaagctaatccctttagctctattctaaaagtcaaatcaaatacctcggtgtgggcaggacaccacatttattttaacctatgaaactctcatggttggtcacccttgcaatagggctgactctgccctgatagcacacatctggcaggtggccctaaaacagaggaacaggcctgctggcccctcccttccagccaggtgtctctacccacagccaaacgatgatggcaaaaacagaacattcgaatccagaaatgacccatctgttcacaagtgtatcaatctgcctttcatgctaccacaggaggacgcacctctgagggtggggtgggtgactccccagtccaagcatcacccctttctgtcaaccctcttctaaatcaccattcacaaaggcccctaaatctcctgatttccattaagtttaaggacaaaacagaaaacatcctgacagtttcttggcctctggaccaagctcaacctgaagctgcacaaagtcttgttgcctgaggatgaataactcaagaaactgtattgctggactgactggcaatcaagaccctgagaaaattattttaagaagattaagggccaggagtgcttgatattttggctgagttctatgtctctcatttcttctgagttgtatattttctttgccccaccctgacccaatcttatctcatctctaacacactccatgtataacattctataactggccaatacggccgtggtttaaagactcactctgtgtcagtatattctataaacgtgttcctgtatcagtggctaataactcaagggcagtgattgggaatataacttccaataattcaactcaaacaacaaagaacattctgacaggtgtttggaaagcatacttgctgaacacgatgatgaacaaacaacaactttataaacttgtatttgttgctgagatagccagtatctaaccatgaaaaagagtgagaaaacagctctcaaatcagttaaaaccagtctttgactgccgagttcatgtctcttgcatgttagatcaaaaacgaaaggaggaggagtgtcaaaaaatttaaaaataaaagccattttacatgtcaggcagtggagtactgagtgatgacggcatcctataaaattaaaatatatgatgcctgtgggaaagccccgggtagggagttgagggtacgaggctttgatatcagttcttacctgaatcaccatatgcaatcttatgcaactcatttaatctctctgggctttactttttcctttcctaaaatggaaatagtaatctctgcttctctttagtttataaaaatgtaaattaagtccttattacaaaaatctgcatatatacatatatatagacagagagagagaaagacacttaaagaggtgaacaatttaggagcaactgaatatacaataatggaattacaaagaagaatgaaacaacagaaaatatatttttaaaaacaattttcagtaaaaaacaagaaaaaagatgcatttaaaaaaaattgtaaaagcactagaaaaaatctaattagacttccaaggattaaattggccttcgtatggcaactttgaaaaagtagaaagttggaggttaaggaaaaaaaagttacagtatacgaatgtaaaaatttttaatattttcaatgagaataagcatttaggacttttttaagttagggaagactctgaaatccttgttcccatgttaaaagtgcacacgcaccaaaagagacagcagatgcaaactgctttgcaagtgaaagtatcacaggcatatatggtttagggaaatcttggccacagatggacttagatcctcttttcccgatgcacctttttccttagttattcatgtccctcaccaagtattcttcacctaagtattgtatagagctcacctagagcaagttcaacaccgttccccacaaatgccaatagtttgggcccaaagagacgggtcccaccagcattaactggggttcaagcagaacctcttgtccagccatcagggcccaagacaggcttgacagcaagaccaggtggctggcaactggccagtggagtcctcccacctggaacagggttaagtgaggcttatttggccagtctgacttgggtctgagaacaagacagttacacatttttagggtatgagggaaagacctttgtttttgctctggctctgcacacctgcaagtgctcaagtacacatgtgtgggggcggcagcaggagaaaggggactgttcctctcttaaaggggcagtctctattcaaatgcaaccacctctttcttctaaacccatcagtaactctgtctaacacattcaagctaacactcagacacaaacttggacagtgagccagtgaagctcaagtcaggaagtgggtttctttatagctctttcctcctgatgtcttctaggtaaccggttcttttaagaagtcaccagagatgggttaggtttggatttgggggaaggggataagaattttgttataaaccaaagaaaaggtttttccagccactataaatgtacaaagaaaaatcttcctaagtgtgtaggtaatgagaagaaagaaagatatgttcactgatcagggttagaaaacaggactttagaagtctgaagattatagtcttttctcagtaggattctcaacttgctctctggaatttattttatcctaggggttaagttttccctgcatgtcaacaatgagagaaatcactagttaggtataatagaatccttggaaggtagttgaactagatcctaagtgatcatttgcacaccgaattttgtaagcatttatccagcatataatctctgaacactcctcaaacgtagccagagtgtgttgaatagcaaaacacaatattaacaactgcatggaggtagcggaacaagtactttttgtttcaccataacgtgataagctgaaagtgtcctacctacgcctttaaagaaaaaaagaacagagaacctagccttgagaggcctccataagaaactccaccgcctcagctctgaatgtcaaacacctccacagacctgtgccctgtgagcatctccaacaaagcaagtcccatccttgtttcagagtttaaactttcacattcaatcactctaggagaactttcactctcattatctctcagggagaggtgagtcatacaaaagacaataaagtttggggagttacagtcaacaacatgcattgaactcagaagcccatcacggactactgagagtgtcgggacacatggtcttgagtcctgccacatggaaaagctgtgctggtctcaacaagccatgtttacagctcaggtccctgcagctgtcacactacctgttctactcagttctcctgcttcagggaacataattgactggctctaccatgtccacaccagcacccctcatcctggggactgctccagccagggactgagcacagtgagggcatgcaggtccacccctgtgagacacagagctcctccagcagacgaccttgacccaaagatcccctgggcccagccaaagttttcttagaatggagctgcagttgagggctctttctacccaaatctcctccttccagacctgcagcatggtctgaaggttccgctgccttctcttcgctgcctttttttccttcatagatgctccttccgtaaacatcttgcacatctaatcatgtcttggcacctgctttccggcacactcaaactaacacagtattttgaatattttctgacatgtgaaaaccctgaaagtcatcttatttgttgtttgctgtgtaacattgggctagacctcctcctctaaaaagaaaaaaaaaagtctcgattccctcatttatacaatgggcataacagaaacttcctcatgtgatatttggtgaaggatttaaaaagtcagtgtatatgaaggagtctaagcacacagtaggaacttaatacatctgggattgagctaaataattgaaaagacctaattattattaaatgcctgctacgccccatgacactgccagcaattactgcaattctataagtaaaatgcgttgttccctggcctcaaggaacttagaattatactggaaaaataaaaggtttggagaatactatggaatgtaggtgacagctagcacttagagcctagcttcctgtatacccagcactgctccaagtgctctccataaactaattcattagttctcacaacaagcctatggtatagaaactattattactgccatttgcagatgagaaaacagatacagagatgttagcttgccaaaggttacacagctgctcactggcagggcctgactccatgctctcaattctacagggatggcccctgaatgttgcccttggtaaaactgcatgggatgaccactctttcttgtgtttaacttggacttctctacctgcaggcatccccaagtgactgatggggtgctgatgagtgctccaacctgcaggcatcacatgcaagtcaccttagggagacaggaagggcagcgcttctcttgaatgagcctctacaaagagcagcagctgctcactctctgcagcaggggaggccgtccagagaaaagaaagaagtgccaagggggcaaaggcagggtcatctgggacacctggcagggcctttcccaacagaggtgatggggagtttccgaggcctgttgtttaaaggcaataaagactggtgtggatgtctcagcagcacgctggctgcattctgctcagtggaaacattttgcttcctccaaaggtggagcttcaaactggagacagagtggaattccagaacagtcaccacccaattccattatttgtagtgagactttattaaagaaacagtgaccccaaaaatctaagactcagagactcttcctctaaaacaggcagtgggctatacccagaatagaggggtcaacccgtgagtctcctggtatccaaaatccaggcaccctcaagacctcagagagttgtaaacagcaccagggtgcaggatgtattgtacagtatgaatagatcccttctgtccaaagactgcttgcaaggtattaccgcagctgaatcaagacactaagatgcttcagccagttgtggtctttgaaagccatgacagaaataggcaatcaccactttccacgttttttaaaagacatttagaaaaaaaaaagttcatagtgaggacgaatctttttaccatgtgatctttttctactggtagcagatgattaagaaaaattcatacaaaactaattagataggaggcagaaacagtggaattactcacaggcaatagaaaagagctttgcctcccaaccagttcaaatcttcccgggaattttcctcctcagtgctccaaagtattttcccgtcaatcacataactgagcagcatgtgagtctattactccactgagatccccaggtccacgccaggcacccctttaggatccactgctaaacccagcaccgtgaatggaatccctgccagcatctcagctgctggctgacaggaaggctctatttaagctgagggggctgccagcttcctgcaactagttaatcacaacagcctctgagcaagaaagggaagacactctgtttctgcccttctcattcccaagctcttttcctcttatccaatcaggtactgcccaaggatggtctacattgagactgtgatggcttcagcaagcctggaagccagccccagctttgcctggcctgcagacctcagtgaaatgccctaacttctctgggcctgactttagccaattcacactgtcttacacaacagcatttacatggagagactttagattccagagcttcgctcctgttatctccccaaattaaaaggctctacgctgttcctaatcacatgcccacagcacaaattcacactgcactagtaacctgcttttactctttccttatcactaacttaggctcataccaaaagtttcctcagttgttgtttgtacctgaatacattgagattattttgcaatcgagccttccttcagaaaactgtgatttcagctaatgctgccaaatctcaggtttcattctgaactgaagggctttgaagcacttccttttgcagtaaagttgtttattttcaaaaacatgttttagcagtagttttgggttactgatccctaaaactcaactacgagccagaactctaaggttctggacttggccctgggactttcttattgtgtgactttagactggctctagagtcatctatgaaatgacaagaagaggatttatttcagggcagaatcaacttgagaggacctagaggagaatgcacagggctttttttttttttttttttgagacggagtctcgctctgtcacccaggctggagtgtgcgatctcggctcactgcaagctccgcctcctgggttcacagcattctcctgcctcagcctaccaagtggctgggactacaggcgcccaccaccacgcccagctagttttttgtatttttagtagagacggggtttcactgtgttagccaggatggtctcgatctcctgacctcatgatctgcctgcctctgcctcccaaagtgctgggattacaggcgtgagccaccgcacccggcccggggcttcttttcctgcaagactagtacctttgtgtgtgtgtgtgtgtgtgtgatgtctcacacacacaaaaaaatttggaagttgaattccagatagtcccaaatttagccttaaggaaactgaaggactgcctacttataaatctgcataacaccataaaacataatttcattacagttagtgaatggctttgggtttagcctttttcaggctcctagaaaacaagaaaatcacttcattcataaatgcaaatcaaagagtgagaacacacctagacattgataagggcattaccaccagacctgctcaacaacagctgcagaagtgataggactccttatctgtggctatgtctgacaatctggaatgaagttcaataaaggtgatttataggtcaataattctggacggaagccaaggccagctctcttccctcccacatacccctaacccacatgcatatagtgttcattagtgacaagagggagataaggtcctaatcagtctaggcaggcaactgcaataaccaaggagtactctcattatctaatatgaagaaaagattttctattcaggtgagacatttggtgcttaagattcaattcagaagctacctctgtgcagaatgcaattacatacatggccttgaataagtcatttttttgtgcctcagtttcatcatctatgaaatgggactagaggggttgagaggaagagagactactatgtgacaacccattatattattctatacctactgaaatggagaagcaagaggaagaagagatgcctatgtttttcaaggacttggaaagcgttttgcttaggtctataaaatgtatatagaaagcattgggctacttctctaggactgtgttgtaattagaaggggttcataatgtatcttcgaacaaaagaaaatggagctttctgatggtatcagtttgataaccgtaaacagttcacagtaaggtaagaaggtacattttggcggaagccaacattgcatttgatgtattcttaactcagctaacaggcaggctttcaagccacgttatctgcccccgcatcttgacctcatttaacaagttgctatgggagcccagtgaaggttgatgcaattttcttatctttggaggaagaatgtaactgtgcaggagaatgtgaaaattcagtttctaactggcttccgcacttacagtgcagtaagaaagacatcctatcaagaagtaaaatgtattcctttggacgtgatagggacaaagacccagactcctggtgaaatggcagggagatggattctcttcccagcttggagaatctaagcatgcaccctttagttcaggccaagtaatagtgacatagagctatgtgtacccctactgtgtggccaaacatactctggagcaatcaaattttaagggaacagacagaaaagttgagcagaacctgagaaggtgagtgtgacttttacaagcaataaaatgtattgccaacaagtctatacaatgatttctgctttccaaagtacttttgcaaatttcagctcatcttaacatgtctgcataaagctagacagccatttataggcactctagtgactgcctcaggtggtgggtgaggctgtatgggcacatttcatccgcttccctattccctaggacgcatcttaaatgaggttggcgggggcaccatgagggtgtgagatcaccctcagagggtgagtctgcagtacaggcaggaggtgttcaccaggtatcaattacagggaaaaaataaatactaaaatgtgggctgctcctcacatacctaacaaatcccaactttcattcagaccacaacaataggagaatccagttcaagtctaaggatatttaaaatatcttgaatccaaggagacagtgagcccacatactcgcttttctgcactcaatatgcgctcaaacatttgctgaaataattgaattgttataattgagggtttttttctctatgtctagcacaatgtctagcattcatttatttaattagttgatttaattcaattacactttcacagatttcctgccaccaagataagaatgaacacttctacttcactaaaagtagaaaagggtacaaggtaaatttgcctaaaaccacacagtgtgttagagttgggaggaaacacagaggacttctgttttctggactattattctcgccatcacatgagatagtatgaaaagtgaaattgcaattgtcaaggagaaagaattaaatggtaagaggcttcaaaaatgttttttcattaaaatgattacttcagactttgagacttttaagagataatcaccaccccttctcttctactcactaaatgttttactcccttatcccatttctgaagaaagagagagagaaaagaaggaaaggagggaggaagggaggaaggagggagggagagagggagggaaggagggaaggaaagaaggaaggaaggaaggaggaaggaaggaggaaggaaggaggaaggaagggagggagggaggaagggagggagggaggaagggagggaggggaaggaaagaaggaaaggaggtagggagggagagagggagggaggaaggaaggaaggaaggaaggaaggaagggcagaagagagggtgggcaggcaactatcaatctatccaaacataactcagacctagagcatagttttctctgcaccacaaaaacagaagcaagcactgccaattagagataatgtctacctcccaaggccacaaagtcattttagagctacctctgcctttcctttctcttcccaattaagcagcacatctcccttcctttatcactatattcaactgcagtctagttctttaacccctaacaggtataactgcatgagctggcactcttgtacttcctgagagtgacttaatacacttttcctcatcccagacgtttttaatggaaatggatatacttcctaataatctcctttcaaagatgggaaaggactcccttgaaaagtactaagttcctacatgctagccatgttcaagcaaagaccaccagggtattgtagaaagaataaagtaaggacctttaagttccattcctggccttgaccttgttgctactccaacatgtagacataattcctgagcactactcatgcaatgaactgcactaggagctacatggaatgcaatataagagagatactcctgatctttgaaggaggagtaagttttcaagcatttgagttgttctcaaaggtcactggttttcttcataaaagacctaaggcttccctgaatgcaaaaataaggattcagcatactctaaggatcagagagacacctcaatagaaacacagatcttgctgtttgtcatcatccacacaaagggtccctacatgaaaacatatccagggtggagagaattataagagaataaaggcctagaccacatctgagtaatcaaagctactttaaaataagctctactcacaacacactttctaatttttagaaaacactacaatcttacagagagatctgatgattaacacattaatgctccttggctatttctcagatatactctccacatgtttttctggttaagtagcatgatatgctacaacccatttgaagaaagcattgttttgctctactaccagagtctcaatcaaagttcaagctctcaacctacatcttcctttctctatggcctttcttcacccatcactatcataactatagctttcgctcctggaagaaaactgataataaagccgagtaagagaaggggcattctctataggccaggatggatctggacagggcgtagtgccactgaggatactgttcccacatttgaacagctggcctaaggagaaccgtgctgcagaagagtccagtgcggaggccattcagttgtgcctttgagagatgctgctgctgattttgtatttagaaagacctcccaagagcagaccaggaaaaatcccctgatgccaggccactagatagagtttccaggaacaccagatcattatagttcccttcccccagacatggaaaaacacccaaaatgtaagtttcctaccattcttggaaatgatccctttgaagagaatgatactatttgcttccaaaaatcaatggctattcacaagcagagtggctggagagagactaaagaattcttagagagacttctcccccgtgccctgcaaaagggagtctctcgtcgtctctggtcagaggtgcagagtgccttccaggaccccacccacagaaacgtgcagatggagttggcctaagcagcgggagggcgcctacctgtgtagccagctagggcagcagcaggaatgacaggcttgtccttattgaggtcagcacggtcccgcacatagtccttgaaggtgcccttgggcttgtggttgggcagggcagccggatagtcctctgagtcgaagctgtcataggagggaacacgctgcaggctgttgaaagatgactggctgctccaggactgggtgaggcgatcacaactatcgtagctctctatgctttcaaaagagtcctggcccccgagtttacctggaggtaaaggaggaggtaggaagaggacagggggaggagggagtgggaaaaaaaaaaaactgtaaaaaccctcttatggaggacagattgctaatcagatctgcaggaaggacggaagaagggagaggcgagtgggaacagaagcttcaggggtcatgggtttactctgaggaaaggggctgcactaggccaccatccgagggtccacggccactctgctgcctggtttgagaactccaagtacagagattcagagtcaaacgttgctcacatctgtcggagtagcgtttgggtcctcaagagttctaaagccagaaatctagaagctgaggatcacacatgttatgatatgatttctggctgatgtcgtaggcccaatgaataaatgaagaaatcagagcaatgtcaggctgaattccccactccagctcaagccaatgagatgacttcaaaaggcccagtttggaaaacattttggtcataagaaaaaagaatcccattagactaagagcagattagcctgttttgaccttggaactaagtgctattttttagcatttttcccaaatactattttaatatgaaatacatgtactgaccctatgccttttcaaatagagtaagatggtgtaagatgcttttcccaagagattttttaaaatcacacacactatcactcttctaaacagaaaaccatattctttatcctctccaagtaaaattatgtacttgaaatttaaacttcattggaaaagtgtaggcaatatttaaaaggtttattaaagagttaaggtccacagcagtgtcagaaatcctttactgtgtgagttgcttaaggcattcttaactgaccacaagatcatgcaagttcattaatttcccaaaccaggttataaacagctgctatgattgcacaatagctcctggagaaatttccattggcaaaaatgccactaaaaaggaggctagcaaaaaaaaaaaaaaaatagttttggaggaaaacaaatgaatctaagagcgaaaaaggctcgcaggaatggtttttatatgcaactttcagatacttttcaagtaacctaagttaaatcataggagactagatggtcacctcaattcagcacaggccaaaaggcaaagggatgtgacaaatgtttacggagaaatatccgtaagtcaactcttaattgttcaggggtggttgatctataaatttcaaatcccagaataaggctgacttatacaacttcatattagtgtgcctccagtgtatttttccctccatgacagcggagattggttaaaacaataaacatcaaacatgaacagatgcccaaacctaaattaaatatataggaaaatatgttgctcccaacattgtttaaagatccggataaaatgtattcggttgagtgtgtactttttgtaaaatccactgctgtgggttttctctacatcctgaccccctctggaactgctttaaacagaaaggtggtgtcatccgtttcatctcattccttcctccactcatccattcagaggagggtaatctctggaaagcaaactgaagagcttcatggagttatcagccctgcccacccagtccactagcaaaagggcacctcttcattcttactaaaaatgaatatatatttctttataattcttaaaaattctttcccatttacccaccagaaaagtcatctttttcacctttttagagatcatttaattttctttcaagaaattcacactaaatgatttaagaaaacagcctacaaccagaatgtcaaagccttgttttagcagaacaggaaattctgtggcgtctcataaaaaggtatttgttcataccagctactgatcttcatggtcacttattttctctttgagacaaacataccaaaagcctaagaaggagaatttatattttcatcaacaccgcaccaagtcgatagtatttatgctaaagtctctctgaaatgattccatttctatcagccaattttatacttggagaaaaaggacatcagaattttcacaagcaagatagtagagtttccaaggagtcccactaagcaaggggactaaaccaagccagaaccagtctctggcaaccccccaaacatgaggcaaatgcaaccctgttgagagttgtggtttacagcggtaggcagctttcattttagctcgatttcacaaccctggtgctgggaaccttcatttacgggtattttctccaaaaatgggtagaatccaactggattagatactcagttatgctgctgcgctcatgtagggaaacctgtgttctctaaactgtccactagccagcctttctgagaagggcctcggcgagctccttccaaagctatctgagtccaccaaacagacctcagagcactcaaaacagaagatgcggcagcacccagccacccactgagtagactcgtacaaagacagtccttagggcccaaataagtggggcatagaagcactctgtacgctgtaatgcagcccgtgaatactgtactatggttagtataaataacaatcagctaacagtaatgctttcggtctagaccaatcacagcatctcagaatcaattggccctttgcataggccctgtttgcagcacttctaacatgcagaaaacagccctgcacaaaatggtcttcccctcaagtttctgtggcctgaacttggagggagggaagaagagtggagccagaaagaaatacctcatgtctccttgtaagggtcacttttggtccacagtcattagtttggggttggaggggtggtagggaccaaaaccaagaatgaagaaaaggagagggaaagagacaattacacaaatgcaaagccagatgcaatttcaaaacaatgtgacaggagatcgacccaaagttacaacatggctgagcccaaacccacaggcttggcctcactgtgtagatgtacagaaagtcccacaaggaagaaagtcgttttaatgctttgactcgcctgataaaaaagaaacacatgtacacacacttgtgtgtatgtatttaaatagacatgcacccaaaaataaaaaagagccagaaaggggaaggccgactggtcccacccatccccttcggtctgaaacactaacaccctggggccttaagaaggaagattaggggttctgattttgcagggactttccctctgcagggcttgttggtgatccctaggcctgctaggaggaagtgtgagtctgaatactcgaagaagacgacaatgggcatgacccatgattcttcaaagtaaaggtaccattgggctctcctccaagagcctcacaataggcaccgcatatggtcagtcattgagcagaaatcactaataggccagccccagcctgacatctgacccaagccccgcttgatcagctttctcctgttcctcttcccatttataattctttcccatttacccaccagaaaagtcaggtttttcacctttttagaaatcatctagctcttgctaaatagacaaaccctttcttacaatagattgcatttttctcagaaacaaaacaatctggacactttactaggtaggctgtacctctgagtgtttatgtcctgttcctaaaaattgggtgcattttaccttttttgctttatgtcacccagctctatttttaaacactttcttccctgacagtgaatattttatcactattataatagtcacgttaacaaaactaccttcttttggaaacccctggccacctccgtccctggtcctctagctaaatacacacttcaccacactgctgatgactggttccaaataaaccgttggttaaccatcttgtatcttcccaaaccgaaaaagtcacaggaggctaaagatcccaggctggccagcagaggtcattccaggtacccagctaggatctacagtcagacccaggagtcctctgggaggagcaccaggacacatgctaagcttaagggttttccagggtggccacttgaaccatttttacttgattatgtcctcctcaaggaaaatagagcatacctttcaaaatgaccaaattcaactagagttattgagtaaaacattttgcccaagtaagatatttaatttcttagattgcctgattttgatttcactgtggaccccatggcctttgtcataataatggacttggctaaaacaccacgatggaaagttcttagtatctggacactctaagatgggaaggctgaaactgaggaatctacaggtctaataaataagaaaaaaaaaatggaacctgaaaaaaactcacaaagtcaggtaattcttgtaaacccaagagcttttagagaagaaatatgacctaccacgactggtcctccccatgcacatgttgtctggggtgacgacttcttgtttgatagcaaagtagtcattctgcaaggtgtctgtctggagagggtctcggagaatgaccgaggggtagtcattctcatacttgagggagaggagctcttccgagctgatgggatggagcgtctgataggactctgtgatgaagctgggctctgagaactccgatggtggaacacactgggcatgctcaataccatagcctggaaacaaagggtttgcaagtaaagagaggagagatttgtacctaaaataagcagttttcaccatctacagggccctatgatgtgggacaagctccttagagaataagggaaaatactttaaatcagaaaagcttgcatttttaaccttgtccactactaaacagctttagcccttgacaaggtaattgatttcctgacttcatatcctcatctctaaaatgggggtgattgcgatttttcccggagcactgtgatgaagatgaaatgaggatagaggtcaaatgcccaccaacattccccacacaataagctcttgacacagagtagttaatatcattgtgtcactggaataaaaattgtaataacgtaaaaagataaaacgaaaaaaataaaacctgtttcatattccctgtaaaagcacagccatcagataagatggtcctatatctcagagcttacattagtgcaacaggcctacattcattgtttccctcaggccatctcttcagtatggttgggtatcttacacgaaaaaggagaagactgtatttcctataatagaatttgaagctgcatagcacactcttaaagaaggattttggaggaaatgctgttatctccactagtaaaaaggaaagaacaaagaccaagatcaaatccctaacccaaccctcttttggccatcgtagtgcacagtatcaaataggaacaaaagtttaggggtctagttgcagtctctctgcatgactttcaggtgaagacatcagagaaggatcctagtgtgtaggaacttggtaggttaatgaaacatatatataggttgaaactttgtgctttgtggaaaataataaaataaagtaacaaagaagagtctacatctaagaagatattatttttgatagaattaccatgaaggagcctgagattcactgagataggggtcttttcctagtttgctattatcatgagagaagaggggtagaaatgaacttactaatgaagtaatccgaggtatagcgggattctggataggctgggttgactccattaacttgatatggtttcacatcctctgtaatgaacagatagggaaggaacaaagaggtcaatattcaagtcatgcttggcctaaaaggatcttggatgcaaagaccacaatgatctcaaccccttttctaagaaatctgcatactcattaactgggttggtatctgagtctgtcctgactgtggccttgtctaaagatgagatcaaaaaaatatgactaaggttattatttcagtagctgcaaaatgggatttagtatcttggaaagagaatccatgagtaatctctaagggctcagaaggcattcagcattcattctcaatgcattcgtgctgcgtgtatgtcgaccacactatagccaaaggcttgagtacatcccaggttagcaggatcaatccccaacccccaaactaatcaatttcaaaatttctcaaaaatatattgcagtctttaggccatagattttacgttctccatttcctctaacagatgtctggtttttgttttgtatttttcccattgccctcaggtttcaagttcaggcccagacaagaagcaggacactggtaaggtgactccatttggtgaaatgcgactgcgcttgtgtcaagggagagaagagcaacccagtcaagctcctgcccagatgccaactcccctaggaaaaggagaggaagggagacgaagtgcacctgcggacagaaagctctgaacgaccctgcagtaagcctgggatcctctaattaccctggaacaaatgccatggctccgattcttgtatggagtagtctgattatatttcaccataagaatctgacatagagtatgggtttgggtttttcctcaggtatttgatagcttgttaggagcaaagtctgatgggaaaacaagtttatgcctgcacagaaaaacagttcccagttgagataaaatgattaaactttgctttagcagtttatcagattgaaacatccccgtacctttcaccttccaccccaccccaaacagctatgttcttttgctgctgtgttgctttaattacagaacaaaagctgtagcctcagcacaaacatcatgctcatctcttcaagtaactgaacctgaagagggagaattctttctgcctctctcaacagaatattgggtgggaagatatgacttttgctctcaaacatactgacttatatcctaattctcttaaattttcttacattattcctttaccctaagtgaggccaaaccagtcttagcggccagaaggcccctgtgaatccacattattatacaaaaagcacaggatgggatgttaaattttaagttaaataaaaatatattgagggcaggcgcggtggctcacgcctgtaatcccagtgttttgggaggccaaggtgggcagatcacgaggtcaagggatcaagaccatcctggccaacacggtgaagccctgactctactaaaaatacaaaaattagctaggcatggtggcatgcgcctgtagtcccagctactcaggagggtgaggcaggagaatcgcttgaacctaggaggcgaaggttgcagtgagccgacatcgcgcgactgcactccagcctgggtgacagagcaagactctgtctcaaaaaataaataaaataaaataaaataaaaatatactgaaagttgaaataaaatgaagaaaaggagatgagtgatactgaagaaatcgcctaccctgagcttcattttacagacaaggacaataataggacttgtccttactatctcacagttattttgataatccaaagagaaaatgtatttgaaagcactttggaaacagggagacatgatagagatattaattgtaactacaatcagagatgggcttagatagcccaaaacacctagcagctccattttgataaatggaggaaaacagcctcttagtagaatatactgggttacacagtctgattgaatctgctattgtgtttagaagtcaacagtcaaatcagatctgttaggagcctgccgtatcgtttccctctataaacaggtcgctcatgtcaacacctatgagtgggtgtctgtgcatggagaacatgccggtgctttgcaactgcctgccatcctcggtaaaagcagccacagaaagactcacctagttctttcctgtattcctttatgtcttatttttcaacagaaagtgaaaagaaggaataaagataacatttttgagcacagagaaatctagtttgggtctctcttgagcactgcagaatggaatatattcttaaccaaaggaaggtataatgcggggtaaaagtgctaatcctgagttttgctcccctcccccagcgtctgtgccaagggttagagctgatgaccacagggaaaggatgggcctgggttagagagggcaatgggcttctaggcttacagtcagctgaagggcactgctgactgctggtaactgcaatttattttaagaaaaaattcaaaaaaataagcacaaaaacacccaagtttgccgcctgctgctgtttctatactcagccaggactgtggtacatgagtcacttggtccaaaaaggttggaagaggctgttaggggaggccatgtcattataaggttgcaacatagcgtcctgatataaccccagttcctgctccagatgtaaaaggtatgatgcactactgcaattccaattcagttagtgggcagagaaatctgtcttattaatacggtctcagacgctaagctttcccgggatgtgatgaggtattatggggcatgcatcaaggcagtgtgtattaagattgcagaaaacaaaaacaaaaacaaaaacaaaaactattcttgggttggctgtgggcactgcttgttcaaccagggcatgggtttgagataaggacctggattagaatgttgcaatccaagaagcttcagtggtacaatcttgctgaagattaatatctgaacccccaatatgtagaagaaaaagaaattacactcatctaagagtacctgctgtatgctgagcagtgtactaggcacattcccacatacgtcctacagtaggacacccacagataaaggcattgacgtcccaccattgggtgagccccctacctactctcacagcaaccccacataacctccacctctctctgtttccacatatttacctttctgcaggatctctagatgttcccataagatgtccccaacaaagtctggggccagctcgagaaagcagtctttacccagggcgcagagggctgctccattcatacagaacttctggaagtctacacctttcaggctgaattcattcacagcccacatcacccagtcccgaacatgggtttctgtccactgccgggggtctgaggaaagagatcagatgaagatccagcaggtcgggcttttaactcctatccaagcctcagagaggacactgaaggagctgaatttagctgagaatgctatctttattcatcgaatgaggaagcatcagcctagcctgcacatcattgagtgccttccataaccctcccctccatattcaacatctccgccttctctatttcaccagctaggaggtcactactgccagccaaaaagtaccacatgagtattctctgtccttgcaggcaaagatttccatgaatctcctctctcactgccttattcccattggacttttttaaagccctgaacagaacaaatggcttctttaatagcaataataacaagagattgctcatgcctctccctgctcttaactataatatacttgagactattattctcgattattttttatcttagccaattatagtggtaacaattgtagcaattagtagtagtcattcattcaaatggcacttggtaataacattattaggtgcctgtattataccagatactctgcaaagtctgtacttatcataagctatagcttgagtagcactgtagtattgataacatgcaatcttcatacatgacctgaggtttaacctggctacacccaccaatgacacttagaagttcagatgacagcaggtgtaatgcccaacatcagagctgttccaagagatccagaagtgattctagtgtgcaggcaagtttgaggaccactgtcttcataccaagatggcaagaacaagcccaggagacggggcagcctcagtatgtgtgtcatgattgtcctaacagatggcagccatggcccatagctgctgactccaatgtggttagtgtaacgtctgcctcacacactccaggtgagaaaatgtgtcttcccaaagggtctgaccccaaccactctttttccaactacaaaaccataccttttgggatccccagtcgttgctgttctttagtgaaaccactgaaagtagcttttaatgcttgagacatcatttctttgctgcttggagttaatagtgggacatctgcacattccatatctgcatgaaaaaattgcatatgaataacaaaaattacataggtaatgaaccaatcataaaacattacaaatgggctgtaagaaggcaagctgagaaacaactgtgctagcatcctcaccagagcaccagagcaggcaattttttttttttttttttttttgagacggagtcttgctctgtcacccaggctggagtgcagtggcgtgatctcagctcactacaacctctgcctcctgggttcaagcgattctcctgcctcagcctcctgagtagctaggattataggcatgtgccaccatgcccagctagttttttttatttttaggagagacagggtttcaccatgttggccaggctggtctcgagctcctgacctcaagtgatccacctgcctcggcctcccaaagtgctgggatcataggcatgagccactgtgccagcatgagcaggcaacatttaaggggctttccacattgtgctaggtctaaaatgtcctgcatccctgacaaacaaatatgtttactcttcctgaacacctctactagtttatacacagtccctgcttatctttcacatttaccgagaatattaatgttactacatactttcagttacctatgaaaatgaaataacaatattcattcattcaacaaatgattatctagcacttgctttgtgcaaggaattaaagaaacaacagtgagcaacacagaaatagtctccacaggagctagctatctgattcttgcagtagattcagccactaaaaatctatctacacagttaaatgttcaaatgcaatgtcaataagggcttcaaaggagaagtacatgatgcaacgttaatgtgcaacaggaattcctggaagtctgaaggaaacaggaaaggcctcccttagaagatgagagatgtttgacctgaattgtgaaggatgcatgagaatttaggaagaaaagaatactccagatcagtggttctcaaagtgtagtcctcagagcagggacatcagcatcaactacaaaaagatcattttgttttaagatcaccttatccgttctgtaaagagtgatttaggggtgagtatgaatggatgagcaagacattttagaaagttattgcatcagtcctggtgagagaggatggtggctttgactacaaaagtggcaaggcagataacataagtgaacatgacttcaagtcaacttgaagtgcatacaggacgaaaaatctataaagcttggttagtgtcagtagtgaagaagagtgaggcattacagcctgcagatttgcaaatgtatcatcatttgccacacccacatgcaccttaatctctgctatgtccatccagatcctcctgtatttgcagaccatgttcacgatgttggtacataaatacagctgaacgtaaacatcttctgaattaacctcaggcacagtttcccacaaaaagtgaataagcaaagaaatgagctgagaatccctactagctttcctgttaccttttgacagtgatacactttaccaaagtgatttctagaaacctgaatcttcagtgtatcccatgaaactgacttataaaatgactaagttccaggcaaggctactacagaaattcttcaactggccatttctaaactttgcttcgttaaaaaatattccccggacacaaacaatgtgttatgggctgaatgaaattaagcataggataaacctctgaagaaaggagcaaatatattgcctctgaatgtcgaactaagtggagattacactgcataaaagaaggacaggtggcactttctctcttgtttgcttttagtgatgctgtcaggaaactgctagagtccaggctgtgccctggaagaacagaagggctccctagctgctcttccaggccttgccaatgacgaggaatctgaagttccagggagtggtaagtttgggttgccctgggacatgcccaaaaaaatctagtggaaaaaatcaacatgtctccaggaaggttaacaaaatgatggaaaatcccagattgttagggggaagtaattgggggaggggatagaatgttgattacataacatccagcccttcaaacaatggagtaatcatcaaatgagtcactaagaaacacatggctgctccccatccatccccactctacacctccaagaacagctaagcggcaggtccagaaatgtcttcccttagagtagaaatcagttttactttagagaaaagggctctctagttaaccagagagtattgcttctgagagaagaaacaactgtagcagccccagctcccagcacatggctaaacacacaagtcaatcaacaaatgttgagtgaattaaatttttccaaatttgaagcaactttcctcccttcacccccatccaacacaaattcattaacttgaactgtgtgggttttgttgtgtgtgtttgttccctccattagatttatgacttgatgaaaaggaccttactgatggcggaaattggccaggacaacacatgtggaaaacacaggccaggccaaatggacaagcagtggttctgctgtagcgggaactgaagaatgagactgactaggaggcccccagaatcttctcaacatgaaagctgggacagtgggatgccagtgtgaggtgacagccaaggacgacagcagaaagcctgaaaaagaagttccttgagtctgcctcccataactacacaagccctggcagtgtggtctggacaggactgctgagctgacaattctccacgtaggtttctgcttcctgtcagggggcaggcacttctgggttctcacttgttctctcccaggaaagcagctagaattacttttgcctttccacctcaatgccatctccacaagcccagtccacgtgctgttggggccccatcagaggtgcctggctctgcccctctggctgtgagactcaagtgctagatctctttaaaaaaagggttcacatcccagctgggggaaaccatccctgtccacttaggacacttgcatttggacttgatcagctccagagaaggcacagcattgtctttggagccaaaggattcagatgtaaaagtcagaactttatcctataaagtgtggaattgtagtttaaaaagaaaaaaaaagtcaaactcccttctataactaagtgaacagttggcaaagattgtctttttcggttgtgtgagcattgctcttaagtgatgactaatcatgctcaaaaatgtatattaaatagaaaataaactcaccatataaaatactaattcaaaaattctcttcatgttgtttgcagattgtagcagttctgttcaatatactcatcaaaaacaatgacaaaatcattacacgggtgaaaaatctgacatgacttagcctaagcagatatcgctttactcttaaaatactttacttcatcacctattataatatttttacattaggtacaaaatatttctaattttagaatcagtgtctgaaagttaatcactacctccatagacattaactaattatattttatggaaaaatactgaaatctcctttgtgctaataattacaatatcttaaattcaaataacgtatttgtttcaaaatgctgagaatccggcctggagaaacactacgccaacacagtggagattctaaacacaacgcactggaaaatgaggacataaatatattgcaattatattagatttcctgcccactgattattccttgggaccccaaatttcagttaatatttataggaattcccctagacctctgaaaggacagttgtgcagaagctggtgattaaataaccattgcaggagattgcacagtatttagacagaagtgagcaggtagctttctctgaatctacagaagaataagctagtggcattttgaatgcagggaaacatctgctcatttttcattgtggcctaaccctgaaccacctcatagatgtttcaagtgaaatgtaaaacaagggtttccattcacttacatgtaactcaaagttaagggctgttcagtttccaagaaccttccagggtgtttcatgtgtcttttcataccactcttttcagttctttgaaaccgaatggctcttaccaacaatggtacacagaatctaaacactaggtggcttttgtttggcaagaagttcaagacatctggccttactgacctcacgagtttatgctctcactattctcaatcaatgatcatgtgaagactggagcgtctgggatcctagggttaggagatgagggatacagccaaggacaagaaatccaaggtgcatgtcccagttttgcatgaccattgaactgggcccaaccccatcagattatgataccagtcatgtgtgttgggtatggtcacactcaatagcagcatgaaagaaatactaagagtgagtaatatgccttatacctgagaaatgctttacagtttgccaagactcttcacatacactattccaaaatatcctctaaacataaaactggaggggcctggaaaggtatcacaaggtccccatttcacagatgaggaaatcaaggccctgggagatcaagagcttgacctaaagtcacaaggccaagagggaccagctggggctagaagccagtcttctaactcttaaagttcagggtctttctctctattccactgcaaacagaaatggatcagatatccaggaaaactaacatttttcagagctgagaaaaaaaaaatgggacttttcctttcttattttgaaagattttaggagtgattaaaaacttaaaactattccaagaaacccagggtttcatacagctagccccgtaagaacataattaagagccatttacagaatcaactataatcttttcttttcctggcactcaggcaactgaggcttccttccatatgaagcaaatgagttaagtgaaaacctggcttccttctctgtccaaccctgactcaacctaatgggtaactttgcatataacagaagtttaatttgttacataaaggcttactgaaatatattttttaaagtaaaagtaaaccaagaataaaccttctggtccacatggagaggataaaagaacagttctccaaactgaaagataggattctaaagacaaagaaaaaagagagagaggggcgtgcattgttgataacttgttgatcaaaatccataggttctgatttcacatacgccattagtgtagacacactggataagtcacttactcaattcactttgaaaagaggtctgttcataggtggtgtctatatccctcatagagttttacattttttatttggcaattttcaaacatacataaaagtagagagaaactctactcaaaatttatcaatactacccgtttttatttcatcttccacacacatgcacacccatacacacacgcagaagaattatacacctaatcccagaaaacaagtcatttcacccacaaatatttcattgtcacaaggatattttttagataaagggagatcatagagttaaagttcaataagaggcaaataaactcaaggaaaaagaaaaaaagccttcaagttactttctctcatgcttaaatctaggtctatatttcatgcattggcccacttgaaccacagaacttctttcaaagcaacactgtcatgatctggaaagtgccaatgttggatcacagagatgatttcaaatcaagatggtaagccagttccagggacttccatttcctacaagcagaaggctgcagtgatatttcctcttaatggtcaacatcctcatgaacttacaactgtaactaaagtgtacaaaacaaataaaaaggctcggagttctggccagcacagaagggcagtgtgaaaggtaatatcattgccaaactgccgacaacaagtcccagtttaggagataaggtgcctttaccccttcagaccaacacaaatagagaaatggctgcagccacactgacggctctgcttctgaagttgatgacccctggagggtggtcactggtctacaagaggattctcctgataaaaaagctaatgatctcagaagaatgtgcaaaggaatctcaaagaaagacagtctctattgccctctctcattcatataaaggcagggttgaagtagagtagaagggagtggtaagtgattcctgtgataggcactagaaaccgggcaggcaggacttccagcttagggaggtactataatccacaaagcttctggctaaggttaatgcaaagaagggagggaagtgtccctcctcagcccctcggctgtattttcataaacccaatgatgtgacaacacaatgggggacacgcaggactcttggctccagcaagagtgaagcaataaatgactcagtgcccatgctgaggccacccatcccaaccaaaccgtctattattgtcccaaacaacaggacactatgagacctggaagagactcatatgagttaggaaacatacaactgggtttctgaacttcttttaatacctaaccctttcgaagtcaccagccagtaaaaaccactgcaaagaagggagaagaagctgcagagaaaatccccaattcaccctccagtgacctgactgaccaaaaatgcaagccagtctcaagttacagtatctcggtttgctgccaatgcacacagtcactagggaaagcacgctctttgggtacaatgtgccaactcagaggagatgcctctccccagagggaagctgccctaagacaaaagagatggtctcctgcaaggcagctccaaattgcatggagaagctggtttcaggtcctgcagccaggcctgagaaagaagcctgtagagagggctcagcacactgaacatctgtaggaagtgacctcagacttctccctcttcccttcatccacctcctgccccatcccccaaaaggagttttaacacattattaccactgaagtcctgaggatttggtgactcaccaggctcacacatggttccaatgagcccttgaccattacatggtagggaagcaggaaaaacaaatgaaagcagttgtaattcggcagcgccggagttcagacctgccagacaaaagggattgcaggcatgttcccaaattcgttcaggcacctgacatgcacaagctatttttaatcactggatttatttctttcctacctcctccaccatcctccacctcagcaaatgtttcgaagtcagagcaaaacccaaatcaattccaggtgttcagggaaacccagagaggctcttccgttccaggatcccagccagaaagcagaactgcccccttggtcctgtagctaaattttctcgctcattccttagactagttcaaatctcccaccctaaacattgggcaaatggcctaaaataggaaatacatgaatgaatgtgtcctgctggaaaggcttttaaatatgtgtttttctctagcagcctggcaagtgaaggtacataaaccaggtctcaaagcccctcagatgaagctcgctttcattctctaggatgctctacccaccatgctgtgaggattaagtggactatgtgtgacaatgccaaagcttaagacatagtaggtgctcaacaaatcattggctacttgattatactgaaaagcatcttataaaatataaagacttaaaaaaaaagattttatttcccaatgcttacagaaacatcaagaaggaatctggcaatttctccaggtacaaataagcgactgagaaaataagaaaaacaaacgcaaaaatcagattctgagatataaatggaaattgacatcccctgaaactggcatttttttctaacagaatagactaatttcttacctattctgcatcctccaatctgctaacgggaaatactttttgcagcaataagcatctaaaatatgtttgccgtgacacttcagaactacatgaatccaatgcacctaagatgccttttggttgcaaaaacgtcctaagagttccactttagaatcaatatggcacaaagcaaaagtataattttatgctaagaactcttttctatgtgtttggaatctgccaaaacccaagctgcgttttaattgtcatttatgggcctctaaattaacgacactcaagcaatttaaaaggaagttttagctattgagattatgattcctgtgtgcaaggaccacctccatagggtacattaaagaatcatttaagcttcttaaatgatcatttcaagccatttacaaagtacttcacatgtttcaaagcatttcctgcatagataattacacctgactcccaccacatgacatactttatagttcctaaatgtcccagaacagtgtgacttctttatctgaaaaacacagagccatggtctctacattactcaggaggaaagaatgagttgggctctttcgtctccatggctttgcagagaaccacattgcatcctattggttcttcccacatcttacacttctgaatgaggaaaactcctgccctgccttcactaaaattctcatgacaggatcatacggcttttggtaccaacatgacataggataaccccatccaggaagacaatggagaatatctgacaactacatcttgctataatcccagcttccactaattctggtttacataatagcctttgaggcctcatcctctgagatcttgcagatgctgatgaattgggctaaccaatttattttaatttcacttaactcccacctataattatcattcctgctatttgactagaactgtatcttttagaaagcattttcttgaatattctcatatgatttttcaaaacaagcacttgtagttattatctttatcatgtaggtgaggaaactgaggctcacaaatgtttcttaagtgacttaactaagattatcaaaccagtaaagtgatataacaaggattcaatcccacatcttcagacacgcaagccacgtgttttctccctgcacctattcacagaattaaaagcaaatgaggcaaaaatgatggggcatgataacatttcttttttcattttctccaacattttcattctagaaaaagctctttctgtagcagggaagaacctcaatccccgagactctctaccgacagcaggctccattgcacgtcctacccagaactggcctggtcaaacctcggctcggggcccacttggcacttggtcggggggtaaaacaggcatcgggagagtggtgctgagaatcaccaagaaggccaggctgggcaaggtgtacgatgaggagttttctccatgggcaaatgaaaaatctgggcaaacaaatggagtagagcccgtttatttaggctggaagaggtaaagtttttctgcacttttgaactgttttctcaaggcctgcctctccctcccacgcaggaaacaaacacagagacaggcctcttccagtgagggcttcagttgttcaaagttagcccgggaagggcagaaggaagaaaggcttagagaaaggaaggaggaacgggggctaggaaggtggtgcagtggccatgggggtagccgccaagggagaaggctggagctgggatcagacagaggaggagagctggccaagaagggaggagagagggaagaaagcaggaagcagagaaagggaatattggaaaattgtaaaccagaacaaagaaacagaatgcagagtggcaatggcctgggaagaggcaacaaccgactcccaattaatgatgttcagaaagcaacattttttcatcaattttgaaaggaaattctctctcaactttcttatttatttatacattatataaatacatttttaaaccaaaaaaggaccgtttttccaatgggaaaaagtcttgtttgagatgaaagccagtcttcaaaaacttcttagaggaagctgaaaccccacatgtctcggtgctacagaaagaaaaacaaagtggacattcttcctgcgttctaaggcttttttatgcagatgtgtttttcttttaataaataaatctggactgagaaggaaaaagcatactcatacacattcacacagtgcaactgtctgttttcaacccagggaaaccacaatgaaaaataagaatacgcaagtccattttcccagtacatcagacaaggattctcaatattggcagccacaggcactgaagcaacacagtatgcgtgcacaccctgctccagcttccagatccacagaggagtacttgatgatgagtggtcatgaggggcagggcaggacctgaagaacgaccaccatacttccccagaagtcttctcacttaagacatttggttgccccatcctttttgagctacacaatttcacttataagccaaaatgattatttaaaaatgattagacacaacgagtttaaatctgccttcttatgaattctatcaataggcccttgctttgcttgttgagagatcagcagcacaaagcaaatttgtccttatctggcagcttttcccctgctttcttcctcctatcatcacttccgtccaggtttccaaactccgtggttccttcaaccattcatgttggcatggtttttggccactcccctcgctccacctagaagcattcctctaagcctatgttcctgaagagcatcacaagcattcataggtgaacatcgtgcttctcagaagttaaatgggaacaatgagatgatcatcttactccataagctttgactggtgcagactaagacaacactgatctaacagcctaactacaaaagccactcaaaggacattgccaggacctctccatagaaagtgatactgaaccagttctgtacctattgactgaattttattaacttcacaacagggcttcacatttatccatattaacttcactttgtttcgatccatgtttctaagaacttttttataccttgaatctgtgctcatcctattagccatcattctcagctttgcaccatctgcaatgcactaagtgtgctttctgtgtctttctctattctaagcccctaataaaaatgttgaaaaggcaaccagcaagtactgatccccataacataacatcagagaccatgcattactctgacactgacacattaatcaagacccgttgggtatagttgctcaaccagttacaaatcctcctgactttactatcattagatccacatatctttgtcttgaccacaaatatatcatggaaagactcagacaaaagcattactggaatcaaaatatgaggttacaatattcagttggtctcccacttgtggagccagttctcccctcgagtttctaagcatctggcaagtgaaaggtggctgatagtacaaatggttgagctggaattcagacccctgtacagtgaaataaagaaagacagagaaagggggtggggtggagagagagagagagagagaaagagagctgcagccacagcattgctttgcttctagaaacaatgggcagttagagaacaatggctacagacaaagtcttggtctatttatatctgccactgttagtcccagacaggaggaactggaagtctgccctgtatgcacagctccaactggacccaagttgggaggaagatgaggtcaccaagaaggctgcctgcttagaaatgggcttcttttttcttcgtatagttgcttcttagcctagaggttctcttaagcttgcttgccttctgctaaaatacagccactgctgagaagggagagatgagaaaagtaactgctgctctgcccagcccaaagcaattaaggcctctctgtacagaggttgcaggaaggtgggaacgccaaggaaaaaataaccaatcgatggaggtcaactctatggtttctgaaacaacagtcttattaggtctgttaattatacatgtttaggagcactataaaggagcttttccctgggaaagttccctcctcatttctttggagacaaataaagaggccaagagctgaaattcacagatatgtatgcattacatctcagggacaatctcttcttccctttatttcagcccctttttgatggtatctctattttctggaatttcatcttttgctctaacatggctttggagagatactcaattttaatccttcccaaactgtgttacttgtatccttaatcctcctacagccttactaaaaagagccaccagtagattagcctgtgacagacaccaaactgaacatgaggagagcctgggctggggaggaaggaacagggagggaggcacaggccgtgagcccctgcaggcatctcctcctgcatgccttcattgtgagtttccaccgacagcccttagcattaatgcgcaaccaacagtaagcaactgcaccctctggatccagtccaaccttatagccttaagaatcccacgtgcaaagctggaatctcccagaggcaagaaattcagggctcaacaaagagatcccctgagcagtaacttcagatttccactcatgcctcaagttcctgtcactaacttcccaccttgttcctggaaaaccaacatgtaaggagatatacaaatctaaataagattttttttctctttttcctttaaatagcttaaaatattttacagacaacatcccagataatgtcaacccattgggagggaactagtagcaaacagttaaatgttttataacttaaaattttaagcacagagcaggcacatgctggatactgctagggccaacgaaccctaggagccaagaaatggttaaaagggatgcatcacgttccttccccagccccacatgctcttcatcaacttcataagtgtgtcaagatgctcagggtccagaccatctggagggtgcgctcataaacttgaactaccaggacaacagataatgtgcacaagcccataacaagcaaacatactagtacatctttcatgctatgcaaatggtggagactgaaattcagatgaaacattggaccacctaaaatagaccaaactgtgaagatctaagtgagtgatctataggtcacctgacctggtacggtacttcattcaaacactgcttccttgactcctcccctatcccctgctcccaacagactaattattcccttctctaagggccctgctgaatcatcccagtgtaattcacaagagccacatgggaaccacatggtaggagtcaggagaaggcagagagacacacattcttaccctaaagcaaggctgacatcagagaagatgcagaaatccccaccctgagcatgttggtaagcacatgagatggccgtccctctgcctatcacaggctccaaaaaataccagcacgccagctaaacacaccaaaaaccgatggtgccgccccaacatggcacatctaatggaattcaggccccacacagtgcagtaaatctaaatatatgtccctaatgaggagtcagaaatcctgagacttcggggatttaggcaataattgtggggacccagctcaagtttcctgcactaaaaaggaggggcctagagagataagctttgaagggagcatgcttatgctccctaaaccattacgctcactgctaaacctatcatacgagcctactccaaggtttgtgtagacctacctaatctataattttggcctctatatctctttggctttggccttttttatggcctggagcaataactatcagcccgagtcctctcctggtgtgttcacacatttccctgcctctgtccctctatcccgccctcactatagctataggatgcataaagccttatccaggaccaaaaagcagaaaagaggaatttacagaatttgctataaaactttaacaactccttggagggatgttctctttccttgcaaccagacatagttataaaatggatgaaaagtggagagaaggaggagccaagctctgccactggtcaggggtcttacactattcctggaatacagaattagaagacgctttcgatgtcatctagttcaaaccttttcttttactggtgggtaaaatgaagctcaaggtgacatcaacttgccttaagtcactggttactaattctagaactctggctccctctcaggatttttttttcctctacatcattgctgtttacttacaacagtggactgggagggagaggctttctcctatatcttcactactatcaagtcctggttcatcattctggataaacactactcctccccaagttattaagaatcacagaggaatgagccatccaaagatctaataaatatgatgggattttacagattcatgatgctatccactcctatttcaggttataagtctggaataccaatggtcagactctaaggtggaaaagcttcctcctagcaaagatccttgttgcataccagggatattaagcaactttcaacagtcaactccgatagcatgataccatggtgtctgatggctctgaaatttgagggtgctattcctgtcaatccagaaagagtgaagactgcagttaacttcagtgatctatgaacctttatctaaaaagcactgaaaggcagagtgcctcatatcatttaaaggttttacaccactacccttctagtcctgctggtattccaaatagggtcactgagccatggtgatagggttgagggaatacaacaaaccccactgacaaagccagaacttaatatcaggggcactggccagtaagttgaatctgatctatctaattaatgaagctatctgttgacccccagaaaggccatggcctgaagtaacacaagcagctctagttgtgaaggcaaatgcagtcggaatgcagagacctaagggttccaggaaagatccacctcattgtgatctcttctagaccccacagatttttttcttctccttcccaatgggcttctctttaatggccccaaacacccaatcttcagcattctattgttcctgctgctgccccagagtctcgcccacacggacccagggcagacagcctcagacgcctctcccagtagcaagcccaagagggtggtaagtcgccaggcagacccaatctccagatcaatgggcgagaccaaccaatgggtggcgagcagacaaaaagtgatcaatgcaaaaggcggagggagcttaagccactctccatctgcctgggtaggtgagaaagggagagactgggatgtgcagccctcatccgctgctaataaatggctctgcctcatcaggaagccattaggaaattgcagccaccacagccccaagctccccggactgaactgtctgcatgcagctggtgaaagcgctcattatctctgtccagacgacactagctcactacacagtggagcctaaccaatgagccctcagaataaaccctgggcttgagtggtgaggaaggagggactgaaaaagtcccttgagattggggagatgcagcgctcccccaggtgtgtgctccaagctccagatcaggaatacgagcccttctcctcacatcccagctggacagcattctttttttcagaaagagctactgactgctcatgagcatggggcttcttttgggagtgatgaaaacattctggaattagacgttgatgatgatggcacaactctgtgaatgtactggaatgcactgacatgtacactttaagatggtaaattttatgttatatcaattatatctcaatttaaaaaaaagtaaatgttagagagagaaagagctactggcccactgctatgagcccaacaatgaataccttggtgatagatccctcaggcagagtttccctctagtgggagaagcaaacaccgcctaagtacagaagcaatagctatatgctcacaacagacgatgagtgctgggatcacggctgaagcggaaggttttgcaatgcagagtgagtgaactagcggggtccagaagcactaggggagggggtaggaaggagtgcacgtaagatgtcctgggtgtagggcgtgagggacagaaggcgggcaaggtgtccaggatggcgcccctggcagttggtggcattactgaaagggaagacgagaggatgagatctcccacagccacctccgccacctggaaatccttgtgagatggaagccccgcgatgctcactgggagaccgaccgtgggagaggctgggcacgggccatttccagaggcagacacctggtaactgcaatttctgggaccacttatgtgaggactaaagaggaagggccacaggttctaggagacgaacaaaatccctcaagttccctaccctaaagatgctcccagaaaaggctgccgagtgctcttttaaagtgatatgtgcatctttatacttacatacaaaagattctcaaggggaagaagtctccatcagacagggctctttcgccctccagtccctggtgggggagacagaggaaaagctgatagggcggtggggtgtgggggcggtgaaggctcactgcacaggaactgaggaaggtgcagtcacaacactgtgatgccagggatctttttgggaaattcttttccaaaagggatcatgaattttggcccctggaatgccccagagcacctctgattggttccctggccctgactcagatcgagccgggctccaccctccatgagtaaataaaggcagggacggagggagggagagggaaggagagggagcggagtgggcagacaggaaccagaaggccagcgctggttcagggaacacaccagatgagatttcagcgacgggtggtgtggcagaattcaagacataattctctgagccttacacaccactccagttgggattcagccctgccttggcagccggctcagtgctgctttataatatactgaattagtcactggattagcaagcacatttacacacagtggcgcacagctgtttaaagacgcaggatccccttttctaggtgccagattctggctataaatcaaccattgcaatcagcaaccagcaaaccccagaggtgcatggttcctgcagacatcttccttaggggaagcctgctagaactgcgatggccattttctggggacaggagggacatctgtggcaaagaaggaaaggtcggtgggctttttctgtcttgaatcttattatcttcagggggctgccaggtcttcactgacctggaccttcccggcagcagcctagctcaggaaatgacgcctgggagaacaggagttctaatcctgcctggctgtattatcaagtacagagtttttctcctaaaccttgaatggctgggtcacctcccagaaaagaaaagactccagggcaaagaggacagtacttcagcaattaaaataattttaaatcctgataacatcaattccaaaaaactgccttgttgaagtggcaagggcaatgtctaaaaataatgctttagagttggaatcataactcaagccctaactcacgttcggtaagaatgcgtgagaggcatttgaaaataattgaactggccacagggacggctctggcccacttggttatggaggtgtcaagtggaaaattttctgtaaccaggttaatagtaaccacagttttaacaaccgctgaagtaataacagcgacagcagcaatgaacttttgtacagaatttagtgacctacaagataatggtttattgagctcctgtggcaatgaaaaagtataaaagttttcacaggaattatctctaatcctaacagccctgaaagctctttattattacctcctttgtaaggatcagaaaagaaaggtttacagaagttaaataatttgtctaaggaaaaattagtaaagatcaagcctgaattcaaacccagggctgtcttacctcaaaactctgctctttcaagacatggtgctgcctccagtgaggaatatcattataaccaacataatgaaagggacgctgtgtgattcagggactcaattacttactatcaagcaccctaaatgtaaatccctctcctttgtcttagagggcttaggtacccaaagagaaatagggtttatctaaactctgtatcgtaagatcatggtaaaaagcctgtggcataaataaatccacctgacaaatataagaaccaagaaccaattactaaataaggcgaatttcatttaggctcctctagaacaggaatttagagaagattcgtaaagagatttgtgactagctcgtgtaggcagagcctagtgtgtattctgcaccagcttttggaaattcaagtattacttccttagaacttgtttgcccataaaaacactgaaaatattttcttacgaaccaaggcagtcgggggcaactgaagacttgcatcatctttgctcatcactctctgcctgcaccatgccactaggcagatattttgatcaaagccaggagaaaccagcggcaagtcacccagggcccaatctcattaaaaaaactaaatcgctgttcggttcacccagcaccccagatcctttggagactttgcagtcagcctgaaatttcaaagttctttcatcagatcatccattacagaagaggatgggtggaaggcatggaaaagccacaaagctccctgcaagagagaccttcagaaatccagaaatagattctttatttttaaaaatctccaattgaatcagaggttaacattatgtccaccgtggagatgctgattcattctgtgtgtgtgtttacttttctacaaatgtccctcttgcatcaagtagcttcaagccctaggcttgtgcctctgaacatcccctccctggagaactctcaagctggggtggagctctcacttcattcctcaattgtctaatctggagagtgggggccaaagcaccaattctgtacacaagtttagtaaatttggctagccacctttcatgtgtctactttggatttgaaaatgcaccatggaaatcaggtgaaaattttttttttttttttttttttttttactttcccactactaacacatcccaatggtagatatgtataagtgaaatgagtgcgttcttcctgcccctataatgacaagcctgacagagaacacatcacacagaagaatgtgccaagaatcaagacctcttagaagaatgttagaaagttttctctccaaatggattctgtctaagtaggaaggccttggcaactagaaaggtctaagatcaaatttatgacttgaaaactctatggctttgggcaaattatctgaacttaattctggactcaatttcttatctacaaaatgggaattaaggcatcaacctcaaagggttgtttaaagaatgtgattatgtatttctgtaaagcacattgcaaagtatctgacacatagtaggtactctctgtaaatattagcttcacttctctcactcctccaactgaactgcagttatgtaaagaaaagcaagcatccagcagttttgaagaatgtttggtttccattaggaggcaagggaggtgtaagattgaactcttgatcttatatgaaataaggatgcatttcctgtacacatacacatgactcacccttggggagctcatatgtatttagcatccccactccgtatcatatctcccactaatttaataacactccttgaatcaccaaagactccagagtactttctaaatgtgaactcattaactttcccactctctctcaaagaaaggcagctcactcactaggagcatccttcttggagaagaatacaaagataatgcagacatgtgtccatatctggtggcttaaggtaaagccagacttgggtatcctgattctcacatcaggcaacagaaggtaataagatgaccacctatgccaccctgcccagttaacagcagagaaaatattcaaaccgggcaaagctaagaccaaggaccccttaggcctgacccaaaactattggtacatggagggcaccaagccatagtgctgaaccccaattggaggaggagacacacttcgtgacctcactaggatttgctttacaagataagattttcctggcaagcattgaagttagtgcccagattcaaaacagcaaacttaaaactattatcttcatgcttgctataatcaggtgtaccgcccaacttcccatccctacctccccttccctagtaatccagaggtactcaaggtcactactggctacttaaggtttacatccactcccaaggaaacaccagcaaccaaaagaatacttcccagatggaaaacccgtcatttgaccttggaatgctctgcctcccataatgaccaaaataaggtccggccagaggggcttacgttttttggtaaggaacaacacattgttttagagagataatctgacataactctgctaagctctgagtgtctatgcatggtaccacagcaaacaccctatgtcccaaatggaaactagcagggtgaaaaaattgttcatctaagatgacattaatctctgtatgcctccttggtacagttcttttccacaacatgcagcttaagattcaacaattttttcattgtgttttgtgtttcctgaagcattcctccagctacctgaagctctcactgattaaaatagacctcctttactaaaaggggtaaactgaggcacagaagaacaaagcaatgtgccttatagttcagaataggtaaacaaaaattggacatctattattttcaaatctctttagattaaaagaaaaaaaaatgtatttctcaaagtccaaagtcaaccttctccaaagggaaactgcatgtctgtctagtaacctataggatcattcacacttttttttccttgagaaggaactaacttgccagcctaccaacaattttgccagtgccttggcatcaggcatatctgcacaacctttccagagcctatatcatagtgatctgttcaagctgctcaaagctcagtaatcatactaatctgtgcatagtgaccagtgctacctgctcaaagctcagtaatcagccagctatgtgggacttgttatagatgcataaaatatgtgggtgaaatctacctccaccaaaagagaaaagaatgccttgttgacactttgatctcaagctaacgtttattaataacatcattattatatttaagtgaatgtactagatactcatcgaatcaaagaaatgtttaaaatccatgtggctgaactcaaatgtcaggggatttggagaaactgactggagcttcatgttctaactctccgcttatttgccctggaaccttgggagggtaacttggcatcggtgcactgcactttccttatttgtaaaatattggtaactctaaggattaccatgagctcaaatgtggtgaagtcacatggcaaactgtaaaatgctaccagatatagccaagtattaagatgaactagcaaacaatatgcacaaacggaccttagtatttcccccaaattccacaaacacccaaatatttctgagaattctgaaaacaacagacatggaattttcaagttagctacagctgggtttgaatctgaactcctccactcagcagctttgcaaccttgggcaagtcgtttaatctcagtttcttcatctatgaaatggcaataataatgcttcactattggggcgaaataatgaggatactggcacaaagtttgcgcccaataactatcagaaaataaacagaacatgaggaaaaaagaaaagatggatggagatgagaagtgcttacacaagcaccagtagataaactctacactgtcatcaatgatcgttttccttgtttttcccccaaaaactggcatgctgaacttaggtccctgctttggaaagagaagggtaactgcgacagacctttctcaaaatgcagaaataacatcaatcagatgagacttcagataacccccatgtgcgggcaccgctcttccaccgccgccacagcccagtacatttgtagcttccggggtggctggggaagccaaggcaggtggtttcttgtccggctccaactctgctaagcagcgtgtgtccagtgaaggatcagccggtggccacctagacaccattctgtgggcacccaaagcacgcaggcctggcctttccctctgtgcaaacagcaggccagggccctgacttactgggcctgtcaggaagaggcactgccgtggctaacagcagattgcattctcaaggcaggagggactgtttctgaccagagcagcctatcaagaagaggcagattggatgaaataagctcatcactcagcccacagactcggcctgcggaagcagctggactagctgcttcacctactgaatgcttgacttacatctccctcctccaggtgagaacctgcactggagctgccttccgctgcaactgcagcaacggctcatggaaaagggaagctgaaaggaagaccatgaggaaggtatgactcttggttcagtgctacccaagacaacatgcctccatttccccaatggtgagctaggctggcaacaatttctaacatctctgtttctctgtggaagtagccctttaccaaagcacccaaaattcctcaatgattaagttgttattaacagaatttggggattaggatgcaaatccccatgttgcctacctcttgaatggcagtctacactctctccaagccttggctgttttaaatgttacctaaagtcataagatgtcactgttaggagaaatctgacaggtcgtcattccaatgaatttatttgactgatgaagaaaatgaggtgcataaaaatgcaatgacttgcctaaggtcacacagacagatactgatgcagagctgtggctggagaccaacactcccgactctccagcccacattctcctcacagagtggatgctgtttatttcatacacaatatttattcctactggtaaggaacaaatacggtaaggtcttccttatcatctgtgattcttcattgcattctgtgcatttatttcgtgtcttaatgatgtgagacaactgatgcataaggtatggaattaacttaaatttttggcaaaagatatcaaataggagaaatgtgtaggtactagaagtacaaaagtcggttacatggaaactctttcactgaaaatttcctgtgataaatttcttaaagggtatttcaaaatcagacttgggcaggggcagtggctcatgcccgtaatcccaacattttaggaggccaaggtggaaagattgtttgaagccaagagtttaagaccagcctgggcaacatagcgagacctcatttctacaaaaaagaaaaagaaaatcagactcaacaacacatttttattctgaacatgaatgatactaatgcatcacacaactctaaacgcatcacacaactctaattgcacacaaaaaaagtaattaattgagaacaggtataacacctggcacatagtgggagaccctagatacttcaaaaaacccgtatctacaaacactcaccaggcttagcagattcctgtgcctgaccgaggttattttccatttgtaccttgaaaatatgtacctgattgattttgtcatcttctctgaggtttaacgcttattctgataaactgatacagaggttttaacaacagtatgagtaggaggaaaagtaaccaaaaaaaaaaagttacctatctcataagcttactcaataactctgctctacccttaaatattcctactttcaaaggcaaaattcatcctgaggttcaaaacgctctttgggtcctggcctcctacttccttccttcatccctttctacaagtaagttttttttccttcatgtttatctaagcatctctttcattccaaacttgcagcattcttcccacgctgctctctatatggaaaataatcctttccctgttcttacacctccttcaaatgcttcagaagtgcccctgtttcccatgaagctgacctatgaaactaacttaacactgttgcaagagagagcttcacagacacagaaaataccaacagtcattgatccacacatattttcataaatgtaaacactggtcctcctgcattttttgccatggaagcacctggaacccagggaagacttcatctgagttgtcctgaccacccatctacccatgagggatttaaagtattcagaaatgaccacaggcaaggagtagaaacaacagacccaaaactgcccatggggccacctgagcctggaattcctaaccaggtgtaatgcttggcccagatgaaagcttttccaagaatctatgtaatatcacttaaattcgttcatctttagttttacaatttcctttcattcattctttcatactttcttactcttcctgtcctcattcttattcttgtctttttttaattcaaaaagaattttgcaattgaatccaccattcctttcctccccttctaaagaattgagggcttgttttttatttttgcttttgtttttgcccactttaatggtacaaaaagaaaacacaacattttttttgccccttttcagcccaaagtaaaatttcttatcttcgataaacatttaaacaaaacaaaacaaaaattgcaattgtcttcacttgtgtaatgaagacacgtccctctacttcaaagttcattttatctctctgtcacacacacacacacacacacgcgcgcgtgcacactacatgcagagtttacagtttctccacagaaccttgcaaagcaaaaataaatggcttatcacagctacccaaagctaccaagaggtttcaaatgcttgaagtgaacttgtctgaggttgatttgggtttctcagacactgagaaacaaatttaaaatataatccatgtttgggggaaaaccatactaaacttaaagggcttcaaactcttaatcgtgccttattagcttacttagatggtctaaaccctgaaattggcaattgagagaagatattctagaaagtacgattgaccaaatttagtgtctaactcgggtggccctcatctgtggggagagccccagttaatgtctgtcattctgatgcaattattaatagtgcccctttacactctcaaaggtatcccagtttgggtggtaaattatacgattttctatctctacaccattatgatctgaagtccaacagccttaaaatttctaatattactttgggtctaaaagcactatctgggtcaatattccacaactcttagagacagtactaaatgctacaagaaagaacaattgagaaaagtggaaggggcagtaataagccacatttgaagtgtcaagtgacaggcttgcacccaagcagtagacactggaaagcacctgggaaatatgacagcgttggccaagtgatcaataaaatatttacggcttgaatagcaatattttgagcgtgtctgttaagcatggctctctgccaatgaaaccagacctaccacaatccaccctgcagacctatgtctttctgtatctgcatggagattatacattatacaatcagaaggaaaagggggtgcagataggcgaaggcttcagaaaagcagccaagtagaaatagcctgtttatgcaatttggaaaacatccactgaagttttgaaaaagatatcatcaacccgacagaaaaaataaagcagaaagtagctagagacacatgacaagtaaaaatgatagatttgggaatagccttgacattcctaaccctgagttaagaacagcttaacagctgtgagcgaagggtagacctagaatactgcaaacatagaggcaaatgctatcagaggttccttgtgagcaggaaaatggagccaaggttttcattaaggagcagctaaataaaaacacggagatgatgttgttcatatacaaattcctctctgcggtgacagtgtgggcccaagcatactaactcttcgggaaaatgctccccataatgcagtaataaagaaaccaatgccttaaccttaaacaagtggcaggggagtgtgcctgtgtgtgagccatgggctgggacagctggcaggtctgcaggtagacacctggggctgtcttgtgccaggacaactccagaccatgtgccctgacacatggaatggacttttttaaaaaaaactaaattttaggggaaaaaacgaaatttatatgaggcataggcagcaaatgcaactcaactatctatggcctctctgcaagcaggataattaaattttaactgccttaagaaaatgaactagtttgccaagctatgtctcatcatcctgattatgagagattcaatgcacagcaacatcagtgatgaaggggaagaaatgggcagaatctggaggctcagcgaaggactgaccttggaggtgaacataatcaccttcctacctgtgagagagccaaggccatatggaagacgttgcaaaaacaagaatcctggttctctgcctttcattctgaggtaagcattgctggaactttcaaacatctttctaaagcaacacatctggactgccaggcctggggacaacccacaggatggaccctttccccaagccgtatgaagcactgagctaacaatgaggccacctgattcagctcagggggctcttgcagagatagcagggagccactgtacctcctgaacccccaaagcaccgaccagcattgccttctcacctgcctgtgttctaatttccagagtttttgagaataactcaaaattttaggtataaaatgcctacaacatctcatcagtttctaaatttctagagtgtggccttaggccaagtatgcatctctcagaaactcattttcctcatctgaaaaatggagaaaataatacttccaccacacctcagagtaagtgtgaagcataaaagtgctcttttatctggctgtgcccagcacacaatgcaggctcgatgtgtgcttcagaaatatcccaacaacttttgaatgacaagaacctaccaccttcaatgcaagctcatggaattccaccacagccatggattattcattacacaaaccagagagacatctgtaattacactgtcactgtaaccattgcagagttatctgctgtattctgaaacagggagactctcctgaaaaatcctgacctacactaaccagctctcagtttgcagagatttgatggagcccagagagacctgggctccgggaggttgaccacgagctggtttgtctcctggagggaggcgatgctcctacagggtggtctggcctctttaagagaaaaaaaaagttacacagacaaaaaaacagcaacacaaaccaaccaaaaatgccaggaatgcaagctctgccaaccaaataaataaataaaataggagatgctttataataactggacatgatgcatttctcagccctgcataattgaaaacttgacttttccatcaaccctgcaaatgttccccttgcctctagacttggtagccttcctgctctgaggtaacaatgacaatctccatcacccaaagtaactggcaaccccctccctgtgcctccaacagtgagagctggacttcaagacactctctgaaagttacctctcactatttgctccctggagaacagaatgaagtttcacgggcatgggatctcagctaagcaggtgaaaaggtcctccttaactttactcttctttccctctaaaataatagattatcaggaggtacataacacagccaccttatcttctaacaaacattcaagggcctctgaaaattctacactgatcaggatcattttttgttgacttgctctgtagttaactgctaaatagtatttattatggatcaggcactgttttaagattttgcacatattcatagatttaatcctgatattcatcctatgaagtagaatgattgtactcattttatagatgcagaagctggagcacagagagattaagtcatttgtccaaagtcacacagctgctaagtggccgagctgagattcaaatccagacaggctggctccagagtctctgctctgaaccatagagctctttagtctctaatggagtatggtcggcggggatctgggagcacagtgagcaagtgatctaatagactgggcagctctgcccttctttcttgtctacactgatgaagaaacaaagactgaccaagctgagcaaggacaaagcttcttcctatctctaagtataacgcatgttcccgatggatgtacaccctctgctgagggcgggtggggtgagaggctgatccttttattcttatagaacagcaagtatccaggattagagctcctgctcttatctggacattaagctcacctcaccaagaaggtagagcagagtgttgaaggaaaggaaaaattaagtggcttgggaatgtgttggctttggcacctggccccttcacagcaggctccaccaggagagaaccaggagtgaacccaatggctatatttgtttttaagctatttaagatccttgcaatcacactgttgcaatcaaatagcatatcccaccttactcttacacttgcaaggaaaagtcaattctactgttatttcagagtatatgttaatttagcacttaacgctgtcaaactcctgtgaagtctcaaaatagaataaaagtgcataaaggttcttggtcaggtcctagccaggaaaacaaataatccaggtcttgcggctcctgtttggacaccccactttcttactgcctctctttggcactcatgaatttgggagggggtggggagaaaattctggtttaatcatttaagccagataagatcccacactagctgtctccacacataagaaactaagcaacccaaagaaatcattctgacaaatatttaagtcacagctgtggataaaaagctacgctgtgagaagttaaactttaaacacatgtcctatatggtctgatgggcaaggcaaatccgcacttagccaatgtcttgtccttccactaacaaaagcagacagccctggccagaaacaccgtttctcccatccttgctttgcacctgcaagttaagtctcagctgaggtttctttgctgagcttttggaaggtatcttgcaacattactcaaagcaatatacattgcgaagttagaaacaggaattgattgtacttcagccactggctcactacatatttttatgtcaattatttacctttcctgtgactctattttcctctctgaggtatgggcataatgttcgcatataagcaactaaaggtccagaaaaaaaaaagttgattatagtctatatattttttcaagtttttgtctttattttttccaagataataaataatggtgctagaaatcaaacctctttacaatgaatggcagaagactgcccaatttctttggccagttgaaattttgttgtatcgaagttcacatacaaaagatgaccaatggcttggaaatcttttttgaaaaagaaagccattgcaaatatgcttattataatggacgctgactgtagcgttaggccttattgttcccattttacagaatagaaagctaaagaaagttacttgcccagagcttatttttaatcagtaactgaaatgacggcaccatatacattgtctctaatatttaatattaaattaccaaaaaaattgcctcagctgttcactgtgatctgaaacatgtgttgccagggctctttttcattcccaggatgaaagatcccttgtaggtatgtggactgacatatcgacacgatatttcccagatgaccaaatctgtctcttcccccataaacacccataacaacacatataaacaagctgttcttaaggaaaggacctattagttgagtttatatctttgatgtgaactatcttttcacttctatatatggtttcaatcaactgacaaacagaactcattctagcttcctcgaacccccaaacacaaccatcatagaaacagcatttctgaattgtaggcctaagtgccttaaatgtctccatggttccagctgcgctctcagcattgctcccaccaccatcatccttgcgaggagacaaaatctcagccttctgtgcacagcagccctggagctgaatgtcaggggacccagagggaggggacgtgacctacatgtctttattaatatttctgaaggacctcagaatgacaaaacatcagtatggttgtgctgaaagtttaagcagcgtaagaaagggttaaagtaagcaataaattatggcagaggcaaagaagtgttaaccacagggggcagcaactaaacttattgataatcagatacaacagaggagcctgttcttgaaattaattattttccagggtgcactgccttctccctagatctttctatatactttcacctccaaaatcactcatctctaaggatagctggcagtgccttatcctaaaagaaagcatctttccctctcaaactacatttgtttcagaaattctgtaaggccagactctcttaagttgcttagcaccaatatttgtgtcaaagacaaaaaaaaaaaaaattacttcctatccttctcttcttcaaatgcatataaatgaaagagttggacaacaccatgtaccaaagacacaaagtcacatttgggtgtttgatgctttccttccaacggacctttggtaccagaagaaaaatttatggcagattagaaacatgggtaaagtaagtaacctacatgaatagggtcggacgtttctcaaagttaagaggataatttcaattctcctccgatctccttaccctcaacccagaaaagaggggcaaggcatgtgacagggacgcttggggaggcaagaccttatttgaaaatctgcctgaaggccaacccgttagactgcccggggccctccacccagcctcagttctatgggggacgtggagtcaggcgatgatgtcctctgaggcagcgtccatctccccttaacattaaggaataaggccagagggttctcgctcatttgggaaaataaaaaaagcaggaatggggcgctggaaattctataagcttttccccaccactcacaaaaacacagctgtgaaaataaataccaccccccaaaccaagggtctagggccaccaacagtcctcctcctcctcctcctcctccttctcctcctcgtcctccagatccagctgccaacagcatcccccgctcctgaagaaatgcaccgcccagaagggaacggcgaaagggggaagaagtccaggggacccccggcctctggccgagagcttgggtgggggcctcggccgtcgccactcacccggggaggggaaaagctccagatcgactttttccgtcttgatgatggtgagagtcggcttgagatcgacggccgccttcatggtgccaggagtgggggacgtacgggatggtagcaagtttgcagttactgttgtttttctttttaatgaggattagtaacagggggaaggggacgggggaaatccgactttcttcccaaaaatctcaaattcccgctgcctttctttcccccgcgcccggacggtgcgcgcccggcactccaggggaagttggcactttgcggcgaagtgagcgcgctcgggtcccagcctcgcccgcgccgcgcccgctcctcctgcccggccctcgcccgctccctcctctccgccggcggctgcctcgttcgctctcgatctcccggccgctctccctccctctcgccctcccgcgctctcccctcctctttagggcgtttctcgcggcgccgcgtctcggccgctgggtccgcgcgccctgggccgggcgatgtccgcttgggggagcgaggggcggggcgtcggggcagggcggggagccgggggcggggccgagcaccgcggccaatctccgcccgcggcccaaagcgaaaggaagggctggcgagcgcggggccgggccgcgaccgcggaggagcagtgcgtggagccccgggcctcggagcccaggcaggggcgggaagggccgggagcgggtgtgcaggctgggtgcacaggccgcctccaccgtttcgggaaagtccgtctgattctccacgcattcttgagggcttggtcacccgctctcgccccctcccagtagcagcatagttttccaagtgcgtgtacatcattcattcacaaagactgacacacaggacgtgaggcatgtggatgaaggcgagcgtgcaggcaggcgcaggggattcgtgagcccgtgtcctcaaagggctttaggagtattggactccagccggatcttgagtcagggcgtgtgtttctgaaggaggcttcagtttttcagagcccacccatgtaatgctcctgcgttggcaggggagtccagaacgggaccccaaactagaacccagccatgagcttccgtaagcttccaatttacctccagcagtggttgggttgaaggggaagttatgatttatttctaattattctgttcctctaattatgtcaccattggccaaagctttgtctttcctttcacagactctcctcttttagataaaactaacaaccctcccacgaccgccaccaaaaaagtgatgcagaggctctgtggttttgaatttctggagtacatcattggcagccatgacagaatcacaatgcacagtttctgttccatttgggaacccccaacactagagataaaacaaaatgaacccgaataattcatggtttgccactaatacattggttgtaatagagatagtttgtcctaattaacaaatcaaccagtacatgtatatatctaaatacatagctagaaccaggcactgagctccatctttgattaacagaaagattaaacataaatcttcctgagcaatctcagagaaagctatttttaatgtttcctgatttctaagcacatttgaactcccagcatttgactgtaactgtaacctctgcctctggtaagttttgacacacaggcttaccttcatctaatcccagttttgtgcccttgaagccttagtaatttgcagatttcccacagcaaatcggggaggaagccaggaacagaaaaatctgtggctcctggtctaaactccagattaaatccctccttagtgaccagaggaaaatatttgtatgtgatagtcctaatttttgaaagaacaaagactgttgcaatccagctgtgtttccacaaggtatgagaaaacaatgctggcctccagatgacaagaacagacccttctggtcctgggaaaagcctagagaaacagctgatgaatgaattgtacatttacacgtccaaatgaaccacaaaaaaaaaaaggttcttgaatcaattctgccttactcactatgaattcatcaggagaagaagtgaacaaatctagagttgctttggggaattttgttttgttgatgttgtattgagaaaatgttggcattttttaatccaagtgtgagtacttctctattttcaaatgcagattcctcagagcaactcctttctctcttccccagtttgctcctcaactttcttccccagactagcctaaacactgctgctaacatccacccaaattagatactaaaaaagcccaccatgattaaactgtaaacactttccactctagcaatgaggaaaattattctttctaattcttccatagtgacaactcagatagtcaatcatccgtttcctaatccagtcctgaagcacagaaacaaaatgagtgaatgtccaaatcaaggaatagggttgcgtaaagcagcagtttggagagatagccaggcgccaccacaggctgccaggaaagttacctccagatgatattaattatgaatatttatgccatcagaagttatgcatcgaaccctggatttggatgaagagcactaataaggtcatgttaaaatattttttacatatttaagatataataatctgatcaggtctgccagggtcatgtttcattaatctaatcaatgttgataaatgaaatttttattcattctctttaggacacaagtagatttttctaaatgttcatatggactttaaatgatatttctatgttatcatacgctaaaacattgatgcctagcctagtgcctaagacattacagagctcaataaatatgtgttgaatgatgaactatcaactttttggtcactatgggcttcctaattcaatgattaagtgagtttgatatgctctggcttgtgaagatgaactaaaaagtgtcagaggctgtgcccttttcccttcatagtagagcagaacctctatccccagcactcacgtccactcggttacatgtatgcctcagtgtccccaccagccaaacaacagcagccaagcgttgcctttcatccacttgggcaagatacttcaataccatatctggtttttaaggcactcaggaaaaaaaaaaatcaatcaaataaatacttctgtgcttgtgcttgtactgcagcagtctgttcctcctgcatttgggaaaaaacagaattgtatttttaagcattccttagacttcggctaattatatcctaccaagtgctgaattgccttacactaggaacgtgaagtcaataagggccaagaaaagtccgcaggagttggggaacagaagagtggagctagacaataatattaagaaaatagtcaccttcatacaggaattcctcaagcacatggagtatgtaaaaagcatactttcttttttatttatactcctccctcaactccaccccaacttcaataaaaaagaaatataaatatacacttaatgttgaacaatcatggaagacagactttccctctccagaagtgtcctagcatgttatctactcctgagtcttgaacttcaacaaaacaaagaatctctgagttttgagctaaaatatgctttactgaaggtaggtacaaaaacattcagaccactaacggctgatccagaaccagtttatgactcacagatgttgatttactggtataaatgtaagatttagaaaaaaaaaaaaaaaaaaaaaagccctcaattaacaacaacctgtctgagctgcatttgtggtctcatttttctctgagaaaaggcaacagtctctgtcatacacagaaacaagctttgaaagcttacttctaaggcaagtggtttctatgtgagaagtttagtcattaaaagtcacactagggaagaaaaatgcctggcacttcaatatctacattatcaagcagcaataaaatggaaaattagagataggaaggaaaattaaaataactctcttaattaaacttggatgccaaaaagccttagggtcagttaagggacccaagccaggggactcagatggtactgttgctgactgcaggctggctctgtgacctcaccaaagccacttaacctttttgtgtcacaacctcatctctgtttcagggaataaaatcagccctagctctccctagaatggaacacagactcattggctattgtttagaaggcacaataaacaatgagggtaggaggagctgcagtcaggagggaagaagggagggtggggtggggttgggggagaggggaggacttgggagcctgtttgccctggaaagctcaatataagaaaacaaagaggatagtagtgtgggctttggaataagactcaggttcaaattcttactctaccaactagccagctgaattgccacaggtaagtcatttaaacaatcccgaacctcagttcctccatgtttcaactagggataatagcagcacacaccttttaaggctatttgaatgattaaatgagataatgtatgcaaagaatttagcacagtgtctaggtgagaattagtatttgattattgttattaagatctagtatacggtagaatatgtgggaaatcacattaaatgtctgtctacagccatctctttgcagaatagcttggatgctcaattttcctgaacgatctccagcgagagatagaacaactatcaccacatttcatttaaaaatctcttcaagacccttcctcagttcttaaactggcaacctgcccagcatcagcctcacttgagaaattcgagaactacctgattggagaagagaactagatttatatttgttttgagtcacagaaaagtgacagtttaaattctgaaagaagatcacatttgtagtgcctctttggagacaaaaccttaggtcttggatttgtcacatgttagagctcaatgggagtttatcagtgctctccaagtccagcactcctatttaccagaggtgaaaaatgagtgtgagtgaggaaattattatttccagggccacacaatctaaaaaagtcagtgtcagtactagaaccagatgccctgatagcagttctctccctggcatctccttgcatttactttgcatttcactttggcaggagaagtaccagacacccttgagacacaagacaggatacaatggacatgggagtagatagatgagcagactcaatttctagaaatccaacttctctacactggatgtattgtctttgggcaaatacattgcaggataaccacactatggttccctgtgggagacagcttggcatgggctgtcaggagagaaagggcctgggttggctctattgctgtctgcagtttctttagactataattatgaaccattcaactgcatctgcagccccaacaatgtggggtggattggcctaatccacagaccaagcgacattttaaaatccagcagtttagacacgtattcctcttgcagcaaatcaaacatggctcagacaggaagaggtaaggagctgcccaaggttagagggttctgaggtctcatccacactcagtgttgtgtgcttccctgaagcaggctgagcatgttgcctggaattgctgcaaatgcagaatgcaggctactctgtgagcctttggggatcatgtaattgggattccaatttaaattgtcctgaattggactcttgaggaggtagagggataatggcaatagcacagatggcaagagaaccaacatcctttaataatatgagagaagaggacagccagtctcctagaagctctgcatcccagggctacaggatttcacccactgtccaaggctgcaggtggtttcatcctggtggaaggctaaggccttcctctgatcttactctgcttttctcttgggttacaaagacaacatcaaacttcaaaacagatgttctctgcagttgtggtttgaatcttacattaagacaatttcactgtggaatcttttcccctctccccactactttcatttaaaatgccaaatcaattgccccaaaagactaacatttaccaccccagagatcaagaagcagagataagtggagcacaaaaaggagaaatagccctgaaaggaaaagggacggtggtacaggaggaagtagtggaagggaagtcctctgagaacaatggaagtgtaagtcgaggacagagaaggggaggagatgaggaggtagagtcacagtgattttatgttcttgtcgttctgggacttcagtccccaagatttcaaaatgcagttaagacctagtaaagtatcccatactttaattaattgtcttgcatggccaacagtcatggaactacagaaaacagatcaatgggaggtcctcatgctggaagagatgcaaaggatccaggatagaatggaggtgaaaggatctcaggaggtcacagaagacacaagggaaggtcaagctgacaatctaggcagaatatagagtgtgtttctcagtcttttcctcacatggacatttgcagtacacaaagaatttccctcacagaagctgtcaccccacccctgcaagttgccacttttctgctcagctcaagagcacactcctagtacatatttgaatatgcgtgtcagtctcctacactctttaaaggcagcaactgaggttcagtcattattacactccatggtgtttagctcaaggtagtaagagccccataaattatgttcattatttaattaatgaacagttaacttcctaacatccccgtaacatttttacagaaaaatgaagctcagataccagttttgttttgcctagttcggtctgaagtgagactcaaatttgcccaaagtttaagattaaagatccaaccaactgactcatttctaactaaaaaggtcttcgtaaagttttattctgttcctcccattcctcccatccccttaaaggagaatgttgctaagatcacaatattcattttactttttatctaattttttattctgagacttcatgtaaaaaatgacatttggctcaccacgaagtaaatcagttgtttgattgtcagcctggacgttttatacatcacgctattcatattctcagatggctgctcagaagcagtcttcaggaatttccgaacttcgagttgaatcttttatttcactggcttccacaaaggtaagatgtacaactgctatatacattatttgtaagataagggaaatacatgaaatgaactcaatttcctccatctttatgagaaagaatagactgttacatgctttatggtgagccagggtgcttactacaaatccctttcaccttctcaagtttaatctgtcaggactccagaagcactgtattttgaaatatatcttctggctatacaggtgattctatattgaggaagggtatgggttggaagtagaaatggggggacatggggatgggctgagagtgaagatgggaatgaaaaggacagggaggatcaaatggagctgctacaatctagcaggtggcacagaaatatagaaagcagccctaaccacttttgtcgaagtagagtattgctctctgcactttgttgtttgtatctactaatgggtaatcaagatgttggaacagaaaaggcagctgatcttaaagcctaaaaaccaaggaaatattggatttggtgagggctcatgatttctcctgagttctgagggggaatcatgaacacacattattttacatcacttcttccagaaccagttccgtataagagccccaagaaaacattgatgtgtcacactaagaacagcctgcttagccagtaaatataacattctttgagtatgtcactgcagtcatccacaaacattttactcaagaatctatgcctatcttaccttaggcatccttcaatgagcagcattatagtgtcataatgaattaatatgaatcctagcttcaccaatgctaactctaccaacagaggaagtaaaatgcatagcactttttaagttcccatgctgctttaaacctcttttctggtatgtactctcctgaaaagggtgcacagaatctgagtttcataaatatgcaggaacataaattcattaaaacaactttagggtgtccagtgtaattattcatatttagaatttactgagcatcaagcatgccaatgatgtaaagttgacagatttgaataagaagctcaaaaagggacatgtcaatttctccagcgttacagctcacatttgattctcagctcttaaggaccaaaaagaaatgaagtcttctttaatttgcaagcagccagctgtgctcactccacatcttgcatcagccctgtgaaggagtcagaatgtagtggatggtcctgcccatgactcatgaggtggaacagacccagctcacatctcatctatctggattggctcccatacaataaaaatctttcttccgttgagttggtgaaaagaagagaagcaaaatgggcatgtgtgacgtgtaagagggcgccatttaatcagacaggcctgtgaaacactttcaagagtccagggctggcagtgagaggtaatgacaggtaacgtgcagaatgaagaaagcagaaagcatatagaagttgcttcttaatggaaacgtgtttcatcagaatgatcagaaacatgtgttctccccagattgggaaaccatcttgaaagacttcatcacaaaaaggccttgggtgggaagtaccacaagggacccatccaggaggggtgggaggaggtgcagctgggtgggaagctggcaatggactgtgagaggaaaaaacaaagggcagtcagcgctctcatggcagattcccaagagagaaccctttccaggaatttaaaattctgaataattgttgagaatttctaaaaatcaagaagattataaacttttctttcaggggattccacagcattgagagagaccagatggctggcaacaaaattccagatccaggaaaggtccagcatctacatatccatccacttttagtgagctaatgctttctcctacagagtgtatttgtctaattgaattgaattgaattgaactgaggtgtggaggtaaaaaggctattgcaaataagtgttcctgtttccaaatagtccatacaaaaacctgcagtttcttgccaagcagaaactaccaggctttggtttcctcactatagaataaatttaaactctaaaataaccagggaggcaacatagtagagtgggttaagagcacaagcttggcagtaaatagacgagagtttgaattttagcttggctgctctccagatgtcagtctttgacctcagaaagcctcagtttcttcatctacagaatggagatgcggaaagtgcctagttcacagagttgaactgagatgagatgagatgaatgggtgccaagtgctttgcactgtgcatgatgcagaatgaagactcagtaacccttcactgctattattgattttaaaaatcagaattgtgacttcggatttagtgagcataaaattttcatgaatgttaatccaaactgtagtatatagtattcttatgaagaaatgaggacacagtgtcctatcttcatgtgcgctgttaaaatcatgacatagtgacaaagataagttttggtctaggtatgcaaatcatgcaaatccttgacaccatccctcttggatgaaaggggattaattcccactatatagatgtgagatacaattatgaaagttctaatcatatactcacagctacattacaaattagcagcaaagagaatatgtaccctcttgaatttcttccagtattgggttctccactctctggattgcacgtttgatagccaatgatttttgcaacctaaacaaaataagaccttcttaagcaactggcctcagcatttgactttcaatctgggaagaatcccacatgctattcaatatgcccccatagcactctgcctaggtacttcccaaactagcacccattaggcagcaccttactgcactcacttcacagaagtctttttctatgttattgcatcttacattttcctcggctgtctcttttcctgccagccaacagttcttgttgtttttgttattttgttttttgagacagggtctcgctctatcacccaggctggagtgtggtggcatgaacggtttaacttgtgctataaacctaaacctctatctatctctaattgtgccatacacatacattttagctacagaattctggacctagatagcactccctgcaagcttggacttgccacctggaattcagaaaaagtattctgctccctggtgttaactacctatgctgaccagttgcccaaaagaaccttagggaaaggtttctcttattgccccttgggccaccagtcaaaccatcggtgctcttaggactgccctctaaaaacacagaatttgccatttacatcagctatgtaatctgcattctggcactaccattgcctggcacccagccattaagcctggcagcagagaacagtcatagtcttctcgctagttgcccgctccattttggcaagatgaatgctgtatcattgggaaagcagacttaattggttttctgggggtgtttagttaagtcaccccacctcagctccaagttgatggaagtgtcactttgccctttccaacaaccagagcaaataaatgatggggacatactccaaaatgtacatggctgagtcctcttgctctcctttttttttttccccagtgactttggggaggtttgggcagtgatcctgcatacacaatactgttcttgttcttcttttctcttacagagcagccttgaatagctctgtctaaaattattagcaggggcagccctaggctccaagagatcacagccctcatgctgggcctgaacaaagaccctgctttttcccaacaattagccctgcaaaaaaggacatctatctccctctattaaaaccaccacgtgccttcaagtcagcccattgtaaagctaattaaataacacgcctctctccccatgcaggtctcctgattagctttcctctgtcagaaacctctgcaaagagcctagtgatagacaagccaatgttccacttctccttagccccgctcccatcgccaattagccgtcgcctttgaaaagccatccttatcaatgttggtgagtttgttcacgctccatatccatccaaagcccagacgctagtcacctccaccttaaaggaatggataaggttcatactgcttttaaaataaattatttggaaaggcaaaagttttcatcacagtgtaaaatctttggccagcattccccacatcgcaatacacaagggctgccgccgccattgcaggagagtgtcagagaaggacttttctgaaagtcagagagcctgggcaagatgcagccaaggtggccatttctaccagatttctaaaaacaggatgcagaagaccaccctttaggttaaactcccttagatactcctcaccgccaaacagataaaatccaagcacagtccaaaaggccaaaattggtcctctttaccttttgaccacacctcaccttctcccccacatagggaccctgctctctgacaatcctggacttgtggcaatcccttgaacacactctagttcttcactcttttatgcatttttacaggcttttttcccttctggaaagccctgttctacctgcccagcacctctgtcaagactcagcagtaaatcacctcccccatggtttccaaggccttgctagataaaatcaggcacttcctactctgtgctctcagcagcacatataggtttccaatggggcgcttacgttaccaaaaataatctgagcccctcaagaacagcaatcatattctacttaaatttgaatttccagtttaaacacaaggacttagtgaatgcttaataagtgttggaagaatagataactgagtaactgagtaaatgaaatgagtaagtaaaagaatgactaaatgaatgaataaaataaccactttataccaaatgtgatctaagatggtacattcaggcctacttccagcttcgctacagatggtctttgtgcatagtaaagggcgttattattttatgacatggttttctttgtttgaaattgtcagatctcctacacatgcacacatgtttacacatgcactttttaaatacaattttttaaatgataaaaatggagggagaacaggccagctattttctaactctgcttaatagttctagagcttaacttttcaaactagtctttgaggtttctagctgatttaatctttagaccataaaaaatttccttccaagtgtttttaggaagactcaccagtcttcttggatgtcccatacagatgagtagatgactagactataaagaaatcccatatacaatttaagttttccatgaaatgctcatagacctcaaaattagcaatgaaaacaagaaaattttttccttttttaagaatattttattttaaggttcagatacacgtgcaagacatgcaggtttgttacacagataaacatatgccatgggtggtttgctgcacctgtcagcccatcacctaggtattaagccctgcacatattagctatttatcctgattttctctttccccgtacccctccaacaggccccagtgtgtgttgttcctctccctgtgtccacgtgttctcattgttcaactcccactgataagtaagaacagacagtgtttggttttctgttcctgtgttagtttgctgaggagaatggcttccaggtccatccatgtccctacaaaggacatgatcttgttcttttttatagctgcatagtattccatggtgtgtgtgtaccatattttctttatccagtctatcattgatgggcatttgagttgatttcctgtctttgctattgtgaatattgctgcaatgaacatacgcgtgcatgttatctttataatagaatgacttatatttctttgggtatatacccagtaatgggactgctgggtcaaatggtatttctggttcttgatctttgaggaattgccacattgtcttccacaatggttgaacaaattcacatttccaccagtagtgtgaaagcattcctatttctccacagccttgccagtatctgttgtttcttgactttttaataatcgtcattctgactggcatgagatggtatctcattgtggttttgatttgcatttatctaatgatcagtgatgttgagctttatgtcatatgtttgttggacacataaatgtcttcttttgagaagtgtctattcatgttctttgcccactttttaatggggttgttttgtttttcttgtaaattcgtttaagttccttgtagattctggatattagacctttgtcaaatggatagagtgcaaaaattttctcccattctgtaggttgtctgttcactctgatgctagtttcttttgctgtccagaagctctttcatttaattagattccatttgtcaatttctgcttttgttgaattgcttttgatgtttttgtcatgaaatctttgcccgtgcctgaatggtattgcctagattttcttctagggtttttattggaaaacaagaaaaattaaaggacttggcaaaatagattttgaactctgccaaatcccaaacatttaaaaacaaccaaagtcaatgagtgggtctcatccctgacacatcaagtcttatggcaaaaatcactcactgcctgatgaatcctgtgtaccttcatgtctatgcatgatgacatttagggccagctctttccttgctattttaccaccacaatctcaacttttgaaaagttgtgtctttctaatattcatgggcaccttccagatagaaagagaaattaagacacaaagcaacaggaagattccatgatcttgtagttaatcagtaattgtatcagtaagagtttgcaacctccaacctgagatgaagcaagcaaacattgtcattcatttggcagtcactttgttctggcaaggttcctacttgttaaagtggaatgctcactttataatgatcataatggattaaaagctgtaaaattagactctggctggcagtaagttctttattactctcccttaccacagtgtgcctccattctcagatgtttccttaaagaagagtaatctaagacctctaaatacataaaaaataggataataagtaaagacaaagagaccctcatttttatatagatttgtctcctccagatgcagcttggcatgtatacatgtatacaaagcagccattgagaattaagcatgtgaaaatcacacctgttaatttgtcaaggacagaccaagtaaactataaggcagaaataaaactgtttcaacaaagataaatggaaaacatggttgaaaaagaagaatgatttggaatgaatgtcatagtattaatcaaataaaaatataagatgcatatagtcaatataatttattcaaatagtaagaagagaagaaatatgtatcataaatgaacattatcatgagatattgggtacaagaattcaatacattgggtaaacagactgtagagatcttaagagcttaagatttcagagaatagcatacattctgtggtctagaaaaagctgttttctgatccaattgagactgtgagcaatgttaagaggcataacagccaaatcaagacacacaagaagcctctcattaggaggagaaagagcttggaattggttgaagggagcagccgtgttgacagttcatgtcaatacattccagttagcaggttatttaagcaatgacttcaggctaagctggccttgtaattctgcaaatcagatcccatagaagagcaattagcagacattcatttcatactctcttcataaagtttgggtcattttaaattttttatgtgtcaaacttcagaagtaaatatgaatacacatcacctctttcctttgattaaaacaatagggatgctttaccttatttagcatgaaagatcacaaaataattccaacatcacctcacagcacctctgagaaatgcctaagaggtgggaaaggatcccagcctcactgtatgcagtatctgtccagggtacagagactctctccaatgttttgcacaactttgatccaagtcagctgtgcaaaatactgaagatgcatattagctcaactctttcaaatcattcatgtgtccaaaatcactttcacctaccaaagtccttaaaatgtgattttctcctgccaagtctttagtcgtcatttgttggtttttttaattagaccttttatcactatgtaccataatttacctgagacattattttcccactaacacagagtgtgtagggggagagggagggaaagcatggcatggtgaataaagagactattaatccactaattcctacttgtctccactcagagtcggaataagcaaagctgtcattgggaggtggatacagtaggatcccaagtgatgtatctgcctgagttcaagtatgaactggaggaggaattaaatcgcagttgggaattaggggaaaggaaaggaaagcaagggctcagctccctacccctgggaactaaggagcaagggaaactgacatgaaataaactcctgcacccaaaacattcaaagtcgggtgcacaccttcctagcagctgcagcaggaaaacactgggaaacctactaaataagagcagctggtcacggaacatatatttctaattgtgctttttttttaccacttatacgtgtatattggaattctgtaataacatgttccaatagagacttcaagacaaataggacatagcattacaaacacaaaaacaatacattctgggaaatattccattgttttaaagctatatatcccaaattcttcaccaaaggccaaataagcacctacaagaagggagaagaagtaatgagatggggaagaggacttagaagatgacttcaggaataatatgtattgacaccttcaatataagaggtatttccactttccttggattcacagtatttattccctcaaattgaatatattcattttcttaaaagtcttgtatatggtaaattcagtagatttgggatgtttgccacacaactattagtgactttctttgaaacttaccgaagaaaatacaagaaaagtgaaaaaaaaattaatgtcttaagcagaaacactcgcattaaatgagatttaaacaactgattaataaaagtatgatgaaattatcctagaaaagtctactgacttatttttccttcttagagttcaaacacacagaagtaacttgaaaattaaatactttgattgtaattcaggaggtaagggggggcgttaaccttcctatttagagatgaggaaattgatagccatttagcataactagattttcagatctgcattcttcacaaattgcgcacatagtggctgctttatgttgcttttcctggttactattatttcacataacatgcccaaggaccggtacagtgtttcataccaggctacagagtcaggctgacctgagctcaaatctggggtctgtcactcacaaagagtgtaacttttggcaagttatttcaactacataaatctccctgcctgaaaaatttacttgtctgtaaaatggagttaataattcacagaatctttggtaagatttaaacagggtaatgtatgtaaaatatatggcagtgcctggctaaaagtgaagaatgaatactggtagttttattcaggtgaaaacacacacacacacacatacacacatacacacacacacacacacacacacacacacacacaccaaaccaggtttgaactcaggtatcctcaaaatactcatgcactgtagtgagcagtattgaggaaccacttaatacaaataattattttgccatagattaaggaggtagttcgtaggtgacatatgtatttaaaaatctctatccacgacagtggacagacaatggagaaagaatactcttttaacaaataataggggagaaccagatacacatacgaaaaagaaagaaactagacctttgtgcataaaagttaactctaagtggatcagagacataaatgtaagagctaaagctataaagctcatataagaaaaaacaggattaaatcttcataaccttgtgttgggcaataatttcttaggtacaatgctaaaagcactagaaaaacaaagaaaaaatagataaattgggctatatcaaatctaaaacctatggtgctgcaaattctaaacatccagaaagtaaaaagacaactcactttatgggagaaatatttgtaaattatatgcccgataagggcttgtattcagaatatgtaaagaactcttacaactcaacaataaaaagacaacccaatttaaaaacgggccaaggattttaatagacatttctccaaagaaggtataagaatgactggtaaacacgtgagaaaagctcaatatcattaattattaaagaaatgcaaatcaaaacgacaatgaaatactactgctcattcaccatgaggataaattggaaccctcttacattgctagtaggaatgtaaaatgaagcagccactttcaaaaacagttgggcagttccacaaatagagttaccatacgacccagaaattctacccctggagaaatgaaaacatattcacacaaaaaacttgtacattaatgttaatagcagccttatttataataaccacaaagtgaaaagcacctaaatggccatcaaattatggataaataaaatgtgccatggccatataatggaatattattttgatgataaaaggatatactgatgcctgctacaacatgggtgaaacttgaaaacattatgcttagtggccagtcacaaaggtcacatattatataactctacttatgagaattccagaataggcaaatttataaagatagaaattagaccagtagctgttgaggtgtggagacaggaagaatgagaaagaatgaagatcgactgctaatggatataagatttctgttaagaagaataaaaatgttgctgggcgcagtggatcatgcctgtaatcccagcactttgggaggccaaggcgggcggatcacctgaggtcaggagttggagaccagtctgaccaacatggtgaaaccttgtctctattaaaaacacaaaacattagccaggtgtggtggcaggcgcctgttatcccagctactcaggagtctgagactggagaatcacttcaacccaggaggcggacggaggatgcagtgagcggagattgtgccattgtactactccagcctgggcaacaagagagaaattccatctcaaaaaaaaaaaaaaaaaagaagaagaagaaaaatgttctaaaattaaattgcaatgatagctgcacaatactgtaaatacactaaacagaactgtacactttaaataggtgaattgtatagtatgtgaattatatctcaataaagctcacctcaataaaccgtttaaaaaaaaaagttggttttctggaggtgaaggcaagacaaaaaaagagggagaatttcctatcatccaggaaagcctgcccagtggggtctatgaacatcatcttaagaccatatgcttcaccaaagttcagtggaaaaatgtctaacatttccatgaccttcttttctaaacttcctaagtggcttagagagaggctgcccgggaaactccaaatggaatttaaaaatattatctcctggctttataaacagcaaggagcactaatgaagtgagggagcagcggtcccaggaatgggatatttcattcagattgggagccccgtgtggagtctaagctcatctctgaaagcggcaggaaggccacggagaggccagaccagggtgagggaggtgaaaatcaacacaggagagagaagaaagaataacaacgctcaaggatacataaagcagagccggagtggccactcttccaaacaccagtaaaacaacccctttccaaatcgagctctgtcctcattctgccaactaagtttggatgaatgagtgctcctcaaggcaaaccccctcaccctcagtttcacgtgactgggaggcctcaggagggtctctccataattctagtctcaacaggaccatccctctcatcattcccagtcccctggtgctcaccagctctgcagcttggctgtgtccgtctcagcacggcagccaggttgcgtgatgttccttgaggatgagactgaaccacacttcatagccccaacgcctcatgaagaacaagggcttaataaatatgtgttgattaataggggacaaagtaaagatgctctaatgtcactgacaccctaaaccagtcagtaacttggaattacccatgatctaactgaggaccaagacaccaaccatccctccactagctaggacaagtttggacaaccaggatacaaatatttatcaaatcctctgctctgtggcaagtattaggctaggcattgaggatacagaaataaatggtgaagtccttttgccttagaatgagaggaaccataacacaaaaagtcttctgagctgatctttgggttttattccaaattactgcaaagtttgtgttgttttcttttgttttgttttaatttttgttacttcttaaccaatccttataatcttgggtagtacccacaatgatcctgacagattaatttaataacctggtttgattctccacagaccttaactgagtgtccgtggcaatttaggcactctgctaggtactagaaacatgacaaggacaaagcccctgacctcaagctgtatatagtctcagaggaaagacaaaacaatgattgcaatatggtgcaatgatctctacaatacaggtattcaccagtatcatgggaacacaattggggtctcaacacaggtattgattataataagggctccacacgagaacaatgtggaagataaagtcaatgggacttgtgactgaatatgaaaatagagtggccatctgctgcttttctatctgtagtcttttccttctttttccagtacaggaccccccattttcctttaggaaactgtctcttttttacacagtatagttctggtggaactgctgatcacagtaccccctacaccttctattcacagaggtggtacatgtctcacatggtgaattagaatgccccagccccattatttcattcattgccttggggatgggcacacagaccaggaattttatatataaccattatgaacaaggcattctttgatgaggtctatgactatggacttctcttcttccaccaaagcagatgtgagctagaatgacagaaaaggaaaaggggaagagggaggaggaagagcaggaagagaagagggaggaagaggagggtaaaagagagactttagaagattattggattccctggaatcaccaggctgactcttctactggacttcccatctgttaagtcaggaatttctttcttacactgaagctagtttgattcaggtttctgccacttaaaaacaaaaagatccttccttaaccaacacaagtgttaaggtattaaaaaaaaaacaaaacaaaacgggagagggagtcaataactaccaattccttagcctggtgattggtagctgatagtgaccttcatcaaaacaagagagaagataaagacagcaacaacccctccactagctacagagttacaggttacagagtcaagagaaagcagtgagctcagttttaagtctgaggtatctgtgtgtgactcaggtgaacacttgtcacaaaaaatacccatggaacacaccctccatgtattaacccttaagtgatgacaccaaaatgcctttcctccctattattctttgatttataaattttctttaggcccagcgtggtggctcacacctgtaatcccagcactttgggaggccgagatgggtggattacctgaggtcaggagttcaggaccagcctggctaacatggtgaaaacccgtctctactaaaaaaatacaaaaattagccgggcatggtggcaagcgactgtaatcccagctactcgggtaatcccagctactcgggaggctgagacaggagaattgcttgaaccctggaggcggaagttgcagtgagcccagatcgtgccattgcactccagtcctggcaacaagagcgaaactctgtctcaaaaaaaaaaaaaaaaattatttaaagaggtatttttttataataatttatttttcaaaataaactgaatgtgatatatatgcacatagaaaagtactagttcatagccaggaagagcgaaaagattatgcatttcaaagctaccagaacagcatagattctctcccccatctttgcagcagaactttcccttctgttaaacacagggaaaaatgatcactctctacctgcccattctgacatagacattgggaagtttggaaaatgagaaaagtaagtgaccagtaactatgggggaggtgcagaagtacatttcagaccttccctccttagccccaaaaatctactggttgagttttcatatcagcatgcccagctcatgcctcctttttgtctctctcactgcagcagaattaaaagattactctcacactcaacgtctctcctttcacatctggcctgctctttcccactcaataatttcctaaagcattcccttaagttccttaagttcccttaaaaggttgtgaaaattttatcttacgtgatcgaaccagaaggataataataaaaaaattactcatactccttctgaaatatcctgaaagatatttgagaggagaggtaatttataaactctaataatggatttcagagtcatattttcccctcactaatctaaatccctgtttttccatttaatctcattgtgttcttagtcttcagtggatctaaaaaacagctgttgactccctgatgacattttaggaagagttaagtctacacttgtatttaatcttaattaattttatacttaattccaactcactgctcacctgaagctcaatgtctatgaaagataaatgaaaactctgaagaggaaaagtcaagcaagagatgtgtggatacatgttctagcaattaatggtatggtactattaaagctgagtatgtccaaattatggaaactgccctaaatgtcataagaaagtcagttccttgtatactttataatttaaattatattaaaagctctttgagataaaaataggcatagagcaaactgtttcttcaactgctttaaaaacctgtgagatcagaaaggaattttgaaagggcagatgaaaaagtgattaattgtttactaatatatatatatatatatatatatatatggaatttccctcttctgtagcccagttagtagggctgagagatgcaggcagccctagggaaatgtagggaaatgtggataaatgtactgaagctacaagcctaatccctgagcccctcacccctgccttctcccagttctgctcaaagacattgcaattccattcttttccaaggctctccctctccccgtctccagagcagcagctctgcatcacattgagtttaaaataaagaaatgcttttcctaaagaattcgcacacaaataatctcattaccccagtgcttaggtttatacagcagacgtcttctgccaggaaaaggaaaaaaaaaatgcactctacactcactcacacggaacagctgcgaggagagaaatggtatttaattcattgtgaaatattcaacaatggctacactgcacttttaaaagccttttgatagtaaaacccacagggaacagcccatcctgtgtgctgaaaagcagcttccccacaattagtctctctattcagaggtctgggaagtctgtgtaaacttcagcacgtgctgtgtacactgtgggtagcttcaagggtataacctttcagaaacttcttagggtttagtcttgctcagtgactctgtctgctcacggagctggctggttgggggtggggggggcagtgtaaggggacaaagggagtatgatgcttaggtgaagaggtaagcaaaccctctagaccctaactgaatgcccaacaaaggaaaaaccattctctggaggagctttgcaaattatcaggcttccttgtgcccttaaatgaccaatatgggactccaagaaaccacagagaagatataaaagaaatcaggtaacagtgtcttgttttcccttttacatccctgtggaattttcatgggtctctgctttgtgggaaagctgggaaagtttatcgattcttatcccggaggtgggcaattgtcacagcaatgaagatgtgaacaaatgtttgggcaggcaaaatgtgtatggtggttaagaacatgcactttggaggaatatttacatttaattaccaacctgcctcccagaattagttaggcttctttggggaggtaagttgacctctctgagtcttatttatctcatctgtaaaatgggaatagtatcaccctcacaggaatattgtaaaagcaaaagaccacatatgtgcaatcctcggcatacagaaggcatttaatgaatggtaaccactgtacctctcaagcagctctagaagaacaggccttcttttggactttctggaataagattactagaattagaaaagaatgggctatgaactatttttcatctctattttaatttacaattgatcagttaagaagcaacatagaaatatgcacagatatctaacaggaagttccgagggatctaaaccatgttaaaaacacaacaaaagattacaattcaagaaaatgtggcatcatggtggttggttttattgttcagaaactttaaattcagagtttttaaagcccaaagtattgatgagatgtccaaatatttcaggtatggttgaagtgagcacaacaactttctgttatttctaatctgtattcaactctccaggaacagcccacaggcatttctgtctcaaggagctagccactttcattataaaacccaaaattcaaccagtgaacattcaccaggacgcaagctctaagccctgctcagctaagaatatccacctgatatattgaccaaagatgaaaatgctaagacattgctgggaagttcaaagtagttgacttgggttgggtaatctgtctagactggagaagtctgaaaatggcctcctcttgtctaagtgagtttgtagcagtagatgttaacagtcaatggttccaacagaagctaatgatcagaaatgagggctaagactccaaaagaatgaccttggttcagaggcagtgcactgaaagagtctgtagcatccaggagtttttctgccatagtcattcctgtatacagtctcttggccatgagggattggttccaggaaaaccccttgcctaagataccaaaattcatatacgctcaagtccctgatataaaatggtgtagtatttgcaaataacctatgcacgtcctcccatacactttaagtcatctcaaatttacttataatacttaatacaatgtgaatgatatgtaaatagttgttatactgtattgtttagggaataatgacaagaaaaagtcagtacatgttcagtacggatgcaaatattctttaaaaaaaattttttttttgctctgaagttggttgaatccatgaatgcagaacccatggatacgaagagccaagtgtacattgtttgcaggggggaaggtgttagctctgaatttctgcacccctatcccctttaggggcactatttctacatcttttcttccctatatgacataaggatgctggggaaaatctactgtgcactagaaaggccatgagacgcagatcatagtgtgacttttctgtggtgctttgacacagactgaagctccccatccctacctccagctcactttagggaggtcccaggtccacagttttcctggggtgtttgcagagatcatcctgaggagcatgaaataaagaaatatgttaaagaaaaaggagagatctggctagactttgggcaaggctgcaatgcttctgtctcagagacaatggaatggaaacaacttccagatttaaatacactcccttgggactgaccagagcagggagaagggatttataggaaggaagtttataccagagaattcatcccagttcaacaaaatgtgcactgcgtactctagaagtacaatgtgctaagtgccgcaggaaggtacaaatgtacctttcccttggaacagtagtttttaacctctttgggagtctcagacaactttgagaatcagaggaaagctacagatccttagaaaaatttctgcacaaaatttcagcaggatcacactttcctgaaactctcctgggcaagaacccctgctccatgagaaacagcaggtctaagacatggcagaaagttgtcaagattgatgttttaaaaatgtatgaggtatgtaagatagccagtaaaaatggcaaaggcaactggaactctgtagctacttaaatcactggtatttctgcctctcaggcactacttcagcaagtctcaggaggtatggaaaagactgatgacacaactttgaaaattggtggctttgtttttttggtttttttttttaatcccacctaacagagatcccaaagtcctgttttcttaaatagcaagaaagtttgaaagaggcaaacaattcttcaaaggtcatgaggaatctaactaggatgtccaggaatggagtgggagaagcgtatccctatttttaaaaaatagggatgatggggagggtgtggccaactgactagatcaagatgtggggcagggtctggactgaaagctgaggggccactcacactggcagctttggggacagccaaggttgccccatgcttcagtgggaaggtgatttttctcagagtgcaactacatttcatgtttgactgatgacctctgtcccatgagctatttatgctcttcagacagcagtcagggaacaagacagtgaagatggaacctggaggcattcaatagggaaaaaaagagagaaagaaaaaaagaaagagcgaggaaggaaaggaaagggaaggaaaggaaaggaaaggaaagggaagggaagggaagggaaggaaaggaaaaagaagagagagaaaaagaagtgggggagtgagagacgaaggaagaaaaggagggaggggaaccccgggcaattacagtaatgtatgaaaaggtaacctacgaaatcagagttaagagccttctccacgccatgcctggtgctttgccatttccacattcaatacgtttttttttttttaatttcttccttcacagtaattctgtgaggtgggcactattatattacaaatgaggaaactgaggctcagagggttcagtgattcgtccagggttgcacagctggtgggtggcagagctgaaacctgtgccccaaacagccctacccagctctcttgatcctttgttaaacggtaacgacacacactcttacctatctctctatgtccccaacctatctggaactccctgtaacctcttgcaaaactaaatctaagcccagaatctcttctgttccaaccgtctatttcttaagccccgcttggggcccaggcgctgccacaggccgaagggcgaggttcgggccgaggcagcccacgcccgtcctctcctccctcctctcctgggagtggaaagctcgtcccgggacgccccagctccgggccggcttcgcctgcgcccgcgttgctggcagcgccggggttaaccctcccgccctgcggagcaatgatttctgttttatttcagcaggggaagtgtgtgctgcctgattagcctgatggtttcctcttttcccataacctccagacccccatggcccaagtgtttactctctgaaataaaaaatctgctggtgtttttctttttgtgtgctcgtgtattttgggaggattgcaggggaggaaggcggggtggggttagggaccgggaggctgggggaggggagcgggccgcctcctccagctgcaggctccgggctgagacccctggctgcagtgcaagaaagcaacttattaatgagggagctgggtctcctgcctcggcagctataaacacagtgaacatctggagagagagcccgtgtctctaggcggccagacacagcactacaggctgtccctgcggcgcagcccgcccccaccctccactctcacgcgcccctcgcccctcgcccctcgcccctcgcccctctcctgggctccggctcccacctcatcggcccacccgaagatgtccattcacccagtgccgcggccggagccgagcggggcctgacgccagccggcggcgtccaccgtcccacccccgtgcgaggagttccaggagaggggtcaaactgcttgaatcgcataagaacccggtgccccagggaccttttcccaactcggaccaaatatttgtggtttgaaaaagttgagagaacgttttttctctccgcagccccctgggagtcccagcgcaatgctgttacttcctaggatgttcgagaagctgcgagttcgagggcgggccggcggaaggcttgcctttccactgtcactccacgaacccagcccagaggcttcggtttgtctgtcttggtttccttccttcccggggacctaaaggggtgatttacatttgtaaaggcctttccaagccctccttcctcggggctgttggggtcactcctgagagcatggggtctctggtctctaacctgggtgtgcagctctttctggccctcaccaggctggcctctcctttggctggtgaaatgaggcacagtgggcagatgctagcacattagccttgagcaagataagagtgggcaggactcagatgtgagtgggcatctggtttcttcgattcacctaaatccacactcacaccatggcgaaaggaaaaagaagaaaagcagcgtttatttattggtcccctgcgataggccacgaccttttaactatactaccctcatgcagtggacacaagaactctttggaaagagtgtatttcacctgtgaaaggtgagggttgggaagctcagtggacttagccaaggccgaaggcctgtaccgggatgtgctgctggggtcttgaggcataggctggctcttcccacaacaccaggccaaaccctctgcttagacttaacactcttcaattatactcaaaatgtataccaaaagaccttgtaatctgaatatgaaatagtaccagctcaaaagctaccaaggcagcaggaggtgggaggaaaaagaaagaggccatgtaggaagcaggagcaacttcagtccacagctgatcagaggcatgccctccacttatggagaatagggtcaggcatttgcagaatctcagtatcagatgagcaaactgacagagcgagtgtgcgggagatattaggcatgtggactctccctagcggactgcttgggctaggctggccttgctttccttcctctttccctggccctctcagagatgggatggggatatatggcaaggctgttcctgcatcaggcttctctcagtactctcccctgggagtagcttgtcagggcagctaggccccaacctcggccttctgtgaaaggctggaacctcaggtagggttacagcttgctcctcccaaacagcacagccatccaggcagaatccaaaaaggtccatgtttccccatctcccttaatgtttggactttatttaaagacaggagtttaattccctagtcttgtcctagaaaatagttgggcattagcatagacagttcctcactgagctagaaaattgaaagaataaaataaaataaagagactggagtggcccagttgtgtttctaattcactttgcctggactccctgtaagtcttctctaagaagaaccgtccagccttttctcagggacagcattagtccaatattgtaatcgtccaatgttacaacatccctaaagcacacacactctcaggaccgttctgttctgaagaacaaagaacctgacacacaccctttagaaaagaaaagcacaccctgaatgaggaaagaagagaggggtgcagcagatgatagtctgaaacaccattctgtaaaaccacagacctgccataagaataaacatttcagagcaaggtgagtctccatttaacaagtctctctggcactccctcagcgctctcaacacttaaaagccaaattggaggcatctgtgcttcctgctgagacatcccacctggttgtggatagccctttccaaacactggcccaggtttgatctctcccagccgctaggccatatgagaaagccccaggagggactatgaactcggaatctcagcgtatctcccacttgaacttccaaagtttatttgggaaagacattctttagttccaccattttgttagtaaatttgttttagagattttagtgagatccaaagccacacattaatactgccaaactttatgtcataaataagtgtaatatttcacatggaaaccatttgctctagcatgtaaatgtacacccacacacacacttgcatagaagttgttttaaaggagaactgaggcttccccttttccatgtattttctcagtatcccgggcatggcactggtcaccaaacgtgttcaaccaatcagtgggtcactctctgactcaatgaaacccagtttggactcccaaaatgcactttgggtcaatgagtcataatagcaaatattcatatcaggcttgctaagtgacggcactgttttatgctttacacatactaacttagtggttctcaaagtgtgatctctagaccagcagcatcagcagcacctgagaacttgttagaaatgcaaatttttgagccttagcctagaatcactgaatcagaaaccctgggggtagaactccataaccagtgtcttaacaaaccctaaagtgattctcatgtaccctgggagtttctgcttcgataagtctggggtacggctcgagattttgcatttctaacaagttctcagatgatagtgatgctgctggtctggggaccatgcttggagaatcattggtatagatccggaaactgggttacaagattaagttgtctaaggtcacacagttataacggaagagctgatgcaaacacaagcaacctgggtccagcgtctgggttctttcctactacactaaatagatgtcctttctcatgaagaatgggaagtggcagataggctgtgaatgtggttgagtgaaggttttactgtgttcagtgaccaaagacatagcaaactgcattctacaagaaaaagtattgtcttgtttctcaaatcaatcaaagaccatggtaataagactataggttcctcctcatgaaggtaagttgtgtttcctatgttctctagctccaggctgcttcccagctctaagcaagtattttgcaaaagtgtactttgctcacaacatcacatccataagtttggctgatttcagacaaatccatccttgaaatgaaaaataatttgatactataacactttggaagagtgctaagtaagcatcgtattttctgatatgaactatgaccattcatgagcatcataagggtgaagttgaaatcaaatatggaccgctggcattgatgggatggacgaggtcttgtgtcctgtgtgctcagctgggtctctgatgtcggttttggaaaacaggcagtgtctgacttcagctaggtctaggcaccactctgaggctcgctaccgttaccctgtgtatccaacaggactgtgggtaggaaccagtcatgacagttaatgacggtaaaacgtcagtgagctcttagagacaggagcaagaaactgaaacgtaaaaatgattcttgttatggtggttggagagaaagggctgaggttgagggacagaatagaggaagggagcagagaggaggcagggtcagtggctccactccagtcagactataaacagcaacagacatttcagccgtgtcttgtgtaagaggctccattgattcacaaggttccctaacagaaggatgacgagaagctgagacagaaagggcccattcattcatgcagaacaccagcactcagccccattggctctcgctaatggctccaggctgatagggaggagggggaagaggcggacggtaggaggaggtagaaatgaaagaaaatgatgactacaagattgttgtgaagaaatgtacagctgcacaggcaattgcatgcaaatgtggcttccctttttagctgtatagctaatgtcctcagattcatctatttttctctttcatgttatcttcccctcctgttcttgccttgtctttttctgggctccccactttttttccctttcccattcatctttcatcttcctttcccattattccctaccatgctactaatatccacctttattttctgtccattttcacacatctcttctttcttccaccatacccgctttatcatctattttgtccaatcgattcccgacagaccttggcgctttagtattctctcccactcacctgataagtctttccctcattcatactttctctctgcttgattctctcttccccttccctccacactcccgccaccctcctcctcctcctcctcagcctctgccccttcgtgaataggaacaacattctgaaaaggcttgctcattccttgatggcccctcctgtcagtgttctctgcactgacagatgtgtagtccttggaaaagaagttcattcatcccttctgagagcatgaacgtgaagggggagcagtggtgggcagtagccatgagacggaggacgggaaggaaactgaagttataaataggataaaagaagatgaaaaaaatgtcgagtattttttctctttctttatattcaacacatctccaaggaaatgtaccacagctggagaaatcactggttggtctatgtcttcatctcccttccctataaccccacaatccccgtccaaacaacacccatcgctgaggagagctggaccacagcccagaaataatccctccaactccttcgtctgggaagctcaaaagttaaaggaggggctagaaaggctcagggttcttgccaaacatttccatcagagggagtataggacagtgggaactacaaccatcacatttgtgaagagattgcccccaactggtagaggccacaccccgatggaagctgtgtaccatctctgagctgcagttgatggcaacccaggtcattctaggaatggttattatatgccccaatcttctcaacctaccaaaagctggggtgaccccagcttccttcttgcaactataaactatgagaagaagatgatattaccctgctataagtccttgcattttaaagctgttcttcatatgcttcccagacactgtctcataggccatgaaataaaaacatctttacctttgagaaacttgacaaagagcagcatgaaaaatcatctccacttgggagtttatgtacttcagtttaaggaaaaggaaggccatgtctctttgctatgaagaagagacattctgatcttcaggctatgagcaaatggagaaggcctcagatgttaataagatgtaacttgtagcaagcagagaccatcgagagctgcaagtgttaaagcaaggcagctttaatctcagttgcattgggagatataagacttaagccttgtggcattaataggattcaagaattatacaaatataaatacagccattttgaccttttgcttatacaaacaaaacctattttgtttagaattttaaaggatcacttttctcatgtcctcaaatttttagtccttaagtctgacgtgtgagcaggtacaaaatcctcctggctcccttgtgaaatggataggtagctgagacatttgtatttatgcttagaagaactgagataccaagcagaaagtgacagcataaatattattatgtctacaatccaggacagtgccaaagaatacctcaaagatcaatggctattgagtcaagggaacatgggacacaggaatctatttcattctgccctggagagaaaccaggcaaatggaaagctactccccatgcctcctcacccaccatacacacagcccatggagtgccacagcatcttgccctgcgtctgtttattcctgatgagcaataaagcatgggcaacaaagcaaacatttattttacttctccactgttatttaagtaattgaccaaagaatgttgtggggtaaaataacactgaaccaaaaagtagccttcaagttagtgactccccctgccatgccctgcccaggtctttccccagaattacattttcccaacatgtaagagtaatgacatttttatgctaagaattcatcctgggagaaaacacagattttgactagctatttggtattcaaatatgttatcataacatggtctcatgtgaaagtgaacttaatatctgaattgatcatttcaaaattcccaaattcaaatttaatggtttttgtttaaaaacaaaacaaaacaaacaaaaaaaaaacactagctggtaaaccaagaactagtggaatttgtgagaaacagagtgtctcctgaaaacagcatggagatgaggacttcagattcctgaggtccctgggaatgcagatccattgatttgagagttctctggaggagactcccactcaccagagggcagcactgccaccagcaagtggaaggagagaagggagagagagacagaggaaaaagaattgggatccaggtgggcatggacagagaggccaggaacaatggaaacagatgatcatcgaaagaaagcatgttctctaagaaggccgagcaattcacacacctctgtttatccagctcagactctgtgactgcaaaacttctaggctctctgacaacagccaaaacgggtgtcaggaaatgcaggataggcaaaactatttgcaaggtgaagacctaaagcaacctttcttgggcccattcctagagtttagacttcctgtcggggaataaagtaacccaaaatttatggagaaggcccgggactttccattcaagaacaatagcatctgtacccgcataagccatggcagctgttatttgaaagaatgcagccctcatcacatttccattgtccttcaactctatcctcattcccagcttttgtttatgttcctacctgagacacagtgttcaagaccagtaggaacttcctgagttgccatctcatcccaaaaggggtagcaaggtctttgctggtgataattggactggaaaccacagttcattcgaggatcttcataagtgttgctaggtccttgcctctgtgcaagaaaaaatagaagaaaatatattaggaggaaaatctctgttgtttagccctaaagaactatgacttcatattatccaatcacatgtaagtaagaatcatctatagatgatgacagaacagagccaactcttgttttcttcccttatccccccacataaagacgcagggaacgagaagaatttctgactcagactatgtatgaatttatcttcctccatttcttcaagtgtttaaggactaccttttctggccttcaaataagaacccatggttaacagcagggccgaatgctgaccatcttgaatttatacactcctggcttatttttaatggtaccttactctgtaaaaacgtcatgaaaggatattcttacaaggcttactccacaatcatacaacaagtaaatgatacatgccaaaggaaaaaaaaatggacctatgtaataaaattcacctcattttttggttaatcagtgtgtataggctttaaatacattggttgctaggcagaaattgtccatttgccccaattttcgaagacttgtgccacactcttagtaattttatgaactccataaaatatacaatcccaatctacatagtactctctaaggaagacagatgtgctgtgtggaaggtcatgttttgctgtgtttaaaaccctaggctttgaagccaggtatacataattcaaatcccagctctatcacttaccaacatggagcctgggcctgttccttaatccaaaccttagttcatgcaattgtaaaatgaaaataatagaaactggaaacatgtacatatagctctagctactcgggaggctaaggcaagaggatcacttgagcccaagagtttgaggctcagtcagggcaacatagcaagacccaacctctaaaaataaagtgaaagtaataatacttacttcatgaagtaggacgattgaatgaaataatgtatgagaaaattgtatataaagcaaattaaaatataaaattgcatttaataaaactatatattgtatgaaatgcatgtgataagtatgtgaggcctggtcttcaatataagttaggcattattttaatttaagagatccttaacattcctggaaatggccacataggttaaaaactaagacacaaaaggaaaagtagcaaattcacagaaagaagatttcctgagaccaggattctaatcgacactggcccatcctcaactttctttttttcttttttattattactctcttgggtccctgcaccttcataaaaaccccaactaaggaaaccaaactctgctagaatttaatatggttaaatctattgacattaaggtctcaataaaggtagctcataagatggtattctcacccctgaagactagcttgcaactcccagaaagattctccaactggagaacttacgtcttctcttcttctgagcatacaagaattcagtactactatgttagattcagttgcccactatctgctccctttcccaatttgcaatggcccattcacttaagatcagtaaaaataacagaagagaatatattgacacagagaaaaatgacaatgaacccaaaaggcagaagaaggttccatgcacatgatattggacctggtgttctataatattcataaaatcattcaaattagagctggatgaagtttactttggggctgtttatcttccaactgcattaaaggtactgaggatgtaagtgggactcagtggaaatgtcaccagttgtgttgcatcgaaggctaacatccttagcctgctgttgccaggggccttgatgagcactgtgaaaatgtacaatggcagatttgccacctatatgtgtgtggggccaagagacaggggaaccatcagcaagaatacactactgagcatcagtcagaaaatgtttcctggccgggcgcggtggctcacgcctgtcatcccagcacttcgggaggccgaggagggtgaatcacctgaggtcaggagttcgagaccagcctggacaacatggtgaaaccctgtctctactaaaaatacaaaaattagccaggcgtggtggtgggcgcctgtaatcccagctactagggagactgaggcaggagaatcgcttgaacctgggaggtggagtttgcagtgagccgagatcgagaccgtgccactgcactccagcctgggtgacagagcaatatccatcccaaaaaaaaaaaaaaaaaaaaaaaaaaaaaaaaaaagagagagagagagaaaagaaaagaaaatgtttccttacttttggcttcaaaccattttgctggaatgttatttaatgctatatgctcctgaagcagctacattaaatacttcttttggattcccaacaataagcaggtctttaacaaaactttgaaactgaatcagttcaaaacacacttcctagtcttataaatcaagccttgtgctctcaatatcatcctcatctttttcatattcctttagagccttttttcaaaatttaatgtcaagtatcagagttgtaggaatagggtcttgagtgagaaaattttgattctaaatgctgtgaagaattctaagttacccacatctgtcttcttttgggacagcatgcatggtttgccaaaaacaaaagatcctcgtaaagtggtagtaggtagttggttcttttaagtaggtagacaggtagtttgttacaggccctgctagggtggtgggaacctaagaacctgaattcggatttaaaagtttgggttttgtctgctaaagaaaagccacttgaaggcaaggtgacattggcaaagaggggatgaagaaaagtgacctgggaacaatgtgcagaggacagagaaggtagataatcggtaagtaggtagggcacaaaataatgtgggtccacacctgggtgataacagggtagccatattgtaggtcaactcacaggctttgagtaacaaccatgcacagaatcagcttgattttatgtggttggtttttttcctggagtctcttctgcccacagctgggctcttggtcaacacgttttttattttataaatgaaaccctctgtatatttttaaggcatagttcctctgtaactgtcctccgtggagccactggatcctatttttaagaatgagaaggcaataatgtacaaaaactaccattaaccacgagaatctttaccaggggatgctcctgagaagcctttcatggttttgttatctagacacctgcctgtttattagacatttcatgaactgacttaataactatttcatagagtatgaaaatgatatttttactcaagagaacaacatcaccagttccaattcattatgaaactgcctcagttgaggagaaaaaaagcaggttattaacaggtcagaaatctgggcagcccagcccccacctcattgcttgaaaagatcaccacaccaaacaggtccctgcttattgggcctcttcattggcatcttcctttcttggctgcaactggagatgagtcaacaagatgcaagcaacactccccatctctgccacatgtttaagaaaaccatctgacaggttctcactcacccatcccacaggtgattgccgaaaggacctaacaaacatcacacatctgttcagtgccccctggcactctgcatcagagatggtctcctttttttttttttcttttgagatagagtctcactttgttgcccaggttgaagtgcagtggcgcaatctcggctcactgcaacctccgcctcctggcatcaagtgattctcctgcctcagcctcccaagaacctgggattaaaggcatgtgccaccatgcccagctaatttttgtatttttagtagagtcggggttttatcctgttggccaggctggtctcgaattcctgccctcaggtaatcagcctgcctcggcctcccaaaatgctgggattacaggcgtgagccaccgcgcccggccgagatggtcacttttaatcctcacaacaatcctgcaagattagtattttcatcttcattttacagaagagcaaacaggttttaagaggtcaagtaaatttcccaaggccatgcagctaataaaacaatggagacagaattctaacccaagtctatttgatttcagattgtcttttctgctacgtgcacaacatgcagcttgcatggcttaagtacaaattgctcaagaatggtggttactgttccataataggtacttaatgaattatggcaatgtgcattcatggactaatatatttggtgcacctagtctatgacaagtattatgttagatgctaagaatgtaatataagcaacaaataaaccatggccttaggagcgtacagacaagtaaacaggaaattacagtgagggatgggacagaattaagtaccaatgtgtagggggaggggaatagcagcagggaaggcttcctgcaggaagcagactaaggtaataactgttaagattgagtaagatttgccctgaaacatttgatgaagggccacatgagcaaaagaagaggaagataatccatccaaaggtaaaaaagaacatatacagctatgtaaggaggaataagaaagattcagggaggtgttatagagagagaaagacggtgttgtttggaggtgacaagcaggaggaaaaggtatgcccttgggcaatgaggatggtaggagtggagggtaagtagtaaaacttcaagccggagggcagggtaagaccacagtgtagagagccatgcaggccaagcaggaatctggcctcaggagagagccactagaggccatgctagaggcctgggacatggtgaagcaatgccttcaagaaagactcatttgatggtgctgagtaggacagacagggcagggcaagaaggcgaggaggctgacacaggtcaggaggagagctttgctgagccacattgggaaaaatcagtaatactgatcttgactttatttaaaattttgatttttttcataataatgtttgcattaattctgatttttcaaagatattacattaagatattattcaacttgattactgagtttgggggcaccccatgtggatgcctcactcacctcactgtagtccagttctgaagaaagagttgggccatgggtgtcgaggggaagaggaaataagaaatattggatgtgttttaaaggaaaaatcgacatgattttatgactgattggtcataggagatgaagagagggaaatccaagatgccacttagattgcttatgtttatgcagtgaaaatggtgaatctacgggacggacataaataaggagagtggaagacaatgttgcctttggttgagttcagatggagtgagggcaacttggtggagggtctctaaggtgaatgcatgatgggagaaggcaggaaagagtcaagctagacctagcagcaaaaaggatggaggtagagcacaactcaaggaaaatggcagtcaggacaataagggaaagaattgaaagtggatctgtaaagctgctgacagttaagaggagaaacaagggagaaaaagcacaaagaagtactggttgaagacgtaggaggaaaaacaagcaagtatacaggatcatggaagccaagagcagagctttaagcaccaggggtggtgaacaagaggccactaagaaaagggtggtcttggccggacgcggtggctcacgcctataatcccagcactttgggaggccgggaggccaaggcgggcagatcacaaggtcaggagttcaagaccagcctggccaacaagttgaaaccccggctctattaaaaatataaaaattagccaggcgtggtggtaggcacctgtaatcccagttactctggaggctgaggcaggagaatcatttgaacccgggagacagaggttgcagtgagccgagatcgtgccattgcactccagcctgggtgacagtgtgagactccatctcaaaaaagaaaaaagaaaataaaagagtggtccccaggcagccatggaggaagggattcccctgggcatcttaggaaaacacacacctcttctctgctcgtcatatgcagtggtgagccgtggaggaaacagcatggctctccctgtcctcttagaaagaggctaccagaggacatgagcccacagcctgaatgctccacccatctaatcctgggaatgaaatgaagccccggaagcctggaaactagttggacaatggacacaccttggtcctgctctgctctgaggtgagccagccctaaagccaccacctgggccgaccaccaccaccattcctgcaaggaagcactcattggtttgtgacccttccctagcaccacttcccagtgcttcaaagtcaggaacttggatcttgctagcccattccctcctccactgcccacagtcatctccctggaactgcctattcacctgtcccctccagccagccacatcttaaagccattccttttgctcatagctttccctgtctccatgccccaaagtccccaaaaattgaaaaaaaaaaaaaaagaataggagaatatatttttacaacagaaaatcatgaacatgaggagtctgtgtctgtggagtgggtgatctattctttcggtcttctgtctttagcagaacagtcttcaatgtccacatgcgatgagtaactccctagttgctcaccttctgtatgtgttacttggagcctaaactccataggagcaaatctgtcttgtctttgcttgacttcagaatcctagggtttagccttagtacagggtcataaacatgtaagacactatacatatttctagatgctagtgctttctaaaaatattttaaacccagaagcaaggctgagtcaacactgggtggatgggcactatgatttgccaccatggaaataactttgtattatttttctaggaatgtcatagatgctcatgcactttagcagaaagacacaagactagaaatcaagcagcctgggttcaagtcctgctgtacatctaaggagctgtgtaacctctgggctattccttaacctctctgaacctttgcttcctgaggagttcggcctccatgatctccaagttccttgccaactctgtgtcatttttgctgatccatccacattctttctcctgaccttacgactgacaaccttcattggataaacagccacaccacggtgggcgagcctgcagagccaaaagttatcggaggtataatgtgggtctgtgacatacaatgtgcccttgaactgcatgaaaggtcttacattgtttgtcttcattctctcccgaagccctgctccaacagttttgtcaccatctgccccacatttcagtagagaacagtgaagctcagtaagagtcttgctactgaacagttataggggctctcacctggcaggtgctcaattaaagtgtgtgcaatacctaggccatttctctgcttaaacccttcctcctggttgcatgtagttgcccttgtgcgactccatgcacttctgataaagtctggacttcctcatcctcagaagacgctttagcacctccgtaccctcccaaccaccctacggataggctgtttggcaatggtgaggaacagttttggtcagaggtatttggcctcagaaggacatgggcaagggcgtggtttctggggcacatctgttcagagggcacgtttgttctgctcccttgagaggtaaaagggaaggaggcaaacagaaccactccccagctctccggagtttgctgatcaagcctgagggtggtgagggggtgcagccaccaggagaagcaggaacaggcaaaataggaaactctcaaagggcaatttaattttagactcaaggccaggaaattctttttaaaacaataagagtaatgggcttgggccttggtgaaagtgcaggcctgacacgctgcaggtttctgcagaaaaaattctgaagcacagagggttgtagagaaggggatgtctaattatgctcttaatgcaaagctgtgcttagcttccctagggaccccctggggaagcacacaaagtcggaggtagtgcagccaacaccaacactacaactcataccagcctgagaccaggacagcctccactcacagccaacactcgctgaaacaggctgaaggacggggagggggtggaacttgagaccacagtcctggggacctgcagttgacactctcttgctgagaggtcttaggtgagagacattttatttgtaagcttctagatctgcaggtttcaagttgcccctcgcttagcatgaagccttcagaagcccagtggtaccatgggtgacagctttaggcatcttgtggtatggagatggagactgaggctgactcaaaacctggttatggacacggttggtggaacttgccatggccagaagactatccagtaatttcaatttgctcagcaatctacacaatggagtttgggttttttgtttttttttgttttttccagaatcaggaaaaactaatttttcataaacaaggcatacaaatacatgaatgaaaatacattataagttcttacatatcaccaaatatcaaataaataaataaataaataaataaataaaataaatgtgtttgtaaggagttgttatggatgtgttcccccaaatttagaagttgaaatgtaaaacaccaatgtgataatattaacaggcggaggcattatgaggtgagtaagttgtcagggcaaagccctcaaggatgggactaggaccctttaaaaggacctgaaggaatgggtttggcctcttccctcccttccgccactgaggacacagcgttcatcccctctagagaatgcagcaggaagggtccatcttggaagctgagacgggactctcaccagacacagagactgccaatgccttgatcttgaacattccagcatccagaacggtgagcaataaatttctattctttttgaattacccagtctcaggtattttgttatagcagcactaatggaccaagacaggagtgctataacaaaatacctgaggaaactccagtaattcatttaacctcttaggatctgaatttcctgatattgcaagatggtctttacattgtggtctgactctgaaattctctagcttgtgatgattgaacctagtagcttacagaagccccacagtccaagatgctggaaaaatataggttattttcttctttccttcaatttctgtgacaaccactaagagttatgagcataaataatttccctaaacattatgtttcagcagtctcattcccactttggttttaaatttctttttgtggattcccacttctctagtaccaaataatttgtccattgctctccaggattcccagagagaaggaaagggtgtcttcactaggcttcatggtagcaagcacaatcactgcataagaagtgcagggacagcagagtgacccttctgtgaacacatccaatgactggagtccggaggcctatgggctggaagtgagtgtgccaacaaccagagccctgggtaagaagggaactgcatcgcaaggaggcccaattaaactgcaattactcaagataagaaaacgaggtctgtttacacaatggggttgtaaaccaccggctgtgacaagagaactttgatctggtggcaagggagctgtttctcatgcagggcagtgatgaaacaaggaggtttcccaatgaggatgtctccatcttcaccccagtagccccatcttcttctggtagcacccttgcatggacaagcggaaatcctcaccccttcccagccccagtatccacctaacacaatcaaaaagtgaagaatagaaagagatgagatagtgactaaaaggaaaagagaattgatggaggtcatctttgtggaggcgcttgacaagcatgttctcactgaaccgtcacagtgaccttccacgtaccttataccatgcctattttacagatgaagacactgaggttcagaggaggtaagtaatttgcccaagatcaaatagctaaagagtaccagacagggccgggcgcagtggctcacacctgtaatcccagcactttgggaggctaaggtgggcagatcacgaggtcaggagatcgagaccatcctggctaacacagtgaaaccccgtctctactaaaaatacaaaaaattagctgggcacggtggtgggcgcctgtagtcccagctactcaggaggctgaggcaggagaatggcgtgaatctggggggcagagcctgctgtgagccgagagggcgccactgcactccagcctgggcgacagagcaagacaccgtctcaaaaaaaaaaaaaaaagagtaccagagtaccagacagaatttactccaggtctttctgattctaaaacccaagtgctttccactagaatttggctgggacccattccacagctgcctggaccaggagtaaaggctctatctcatgtctggtgtcaagaagacagtgtaaggtgcgttggcttctgcctcaccagagggcctgaaggtggaaatagagtcctgtggatcaatcaaccagtcgatcaatcaattacggaaggaagaaagaaaatgtacaaaagaggaattgcccaaaaggttttgtgacagggagctgctctgagggccgtggttaatttggagctctttttctgcaatgcacttagctaagcctcatggcaggactaccctctatgctggtaccaactagagattcagctgaccccccaggtacccatgtcccactggaactgcacaggagggacggaggccaatgcccagagctggcaatgactgacagcctccctggggtccctcccaaggtgacatccagcatgaactcaggcttatttccagtgccctgttcattcagtgctcgtacgtctgcaatacccttgatttcacaatattttattctgtatagtgaaagaaattaagtgtctaataaatgggatccaatttatacaacattgaaggctttcatggcataaattcacaagtcaaaaaacagtcttttgttggacagtttctgaacccctgttttcattgaaacaacatagggaccatgttttaagagaatcacatttgatttagggagagtgaaagagtggcaagttttttgttttttgggttttgtttttgtttttgtttttgtttttgtttttgttttgagacagagtctcactctgttgctcaggctggagtgcagtggcatgctcttgcctcactgcaacctctgcctcctgggttcaagcgattctcctgtctcagcctcctgcatagctggaattacaggcgtccaataccacacccggctaattttttgtatttttagtagagacggggttttatcatgttggccaggctggtctcgaactcctgacctcaggtaatccacctgtctcggcctcctaaagtgctgggattacaggtgtgaaccaccgcggccagccaagagtgaggagtttttaatacagttacttcaccctcaaattaccaggaatgtcccttaagcccagagtcttatcataggaaattctggcacttggggatatgtagttagcctcttgggcataggtgccttccctgaggtggagcacagtgggccactcctgcccgagcatgttgttctatctcccaaagtctgtggctctgggaggaggtgagtgggcagttcctttcctctgtacagcccaaggtgtttcctaaagcccgcatggccaaaggggtcactagtcccccaggaactcctccgcacatcctccttgccggtgagacatcccaggctgggccatgtttagtcaaaactgagagcagcccagcccgctcattcccgccactctcagctgggccagcacagtgctgtgaaggggagaatgacgcatgagaggacaaaagtactgggcttgcaagggacttccaggctcacagcgggcttgggcttgcagaggcagcataacaggaaggagcacttcctccccatggatgaaagggtccctgacacacagcccatagaagtacctggaaaggtcatccctcccacacaatgaccagacaacttcccaaagtgttgcttctccacctccccactgtgacaccacctcattcattatggcctcctgaagggctgaccttacgcatggggaaaccatgagtcctgcttttgagaaactgacgctgaggcagagaatgtgaattctgtgcaaaaccatgattacctgaggctggcatggattttaaccactgtggctcccatggtttccaggcattcttccgcagcaaatgaccagataacgttaatgtgacctctaatttacaagcaaggactccgagacttagctatcttcaggcgcagaaaatactgacatcctattttcgaagagattgtttcttggccaactaatgcagcatgctaagtaagagcccctcggagcaggaacacagtcttactttcttttgttagatttccctttctaaagcaataatttactagtaaccaagacctgcttagagcagtctgtacacacagtcccattctgctttcaagtttgatctgtggctactctagaccaggtttctcaacgtcagcactatcagaatttggggatggataattgtttgtcataggaggctgtctggtgtactaaaagatgttcagttacatccctggcttctactctgatgccaggagcacctcctaaattttaacaatgagacacatctccaggcattgccaaatatccctttgggggacaaaagcaccccctactgaaaaccccaatactctcatggttttcttttcactctgaatttaccatacatgggacagagtttcttcttttttttttttttttttttttttggtgtgtcagactaactaaatcagagactagggcaccaggtaggaggacttggattattggattaagcaccacgggttgagctctggacagggaggctccaacagaaccgagaagactctggttgcctggggctctgactttcttatctaggaaagttaatgaagctatgcttacccctccagggtatcttagattgcaactgaatgtgaggtttgtttgctggtgtctctagtgccaatgtcctaaggttatattttgtagacaatttacagattctctgtttatcacagcccagtctaaagttagaggttatggtttgagttggtttactaaacttgagtttataccaataagtgttatttacttcttaatttttattagagaaagagtatgtgaaaaaattaaagggcttctttgcttgctctggaaggttgcctaaatcgtttcagggacagagaaactgaggcccagagagaagttaggagtgaaagtgcaagaacaataattcagcagctcttttgtacaaccttctgcttttacccaagcaactttgaactttttagtgaaaaggatctcacatgttaatgtttttcagataaggctgtcatgggtgggagtaaacggattatttggtttgaaaccaatggaagccattcaaaatttatttaaaatatccagggtgttcaattgcagggaggtgtctttagttgaaattatgcacttagagttatttggtttgggatttttttattctcccacaattttgagataccctgcctaggatgacattatattatatctgcaacttttatacttataataggctttttatctcagtgtctaaactaagtacatatttgtgtgacatttctttctttctttctttttcttttccttttttttttttttttagatggagtcttgctctgtcacccaggctggagtgtgcaatggcacaatttcagctcactgcaacctccacctcctgggttcaagcgattctcatgccacagcctcctgagtagctgggattacaaggcatgtgccaccacacctggctaattttttttgtatttttagcagagactgggtttcatcatgttggccaggctggtctcaaactcctgacctcaactgatccgcccgcctcagcctcccaaagtgccaggattacaggtgtgagccactgagcccagccatggcatttcattcttagccaaaatattaatctgttttaatttgattatagtacctgtaaatagaattaacatggactggcttttaaatcttatttttcaagtcaatgacacattttgctctgaaatcacaatatcattatttattttaacaaatttctacaatatcgtctttaaggaaattttaatgtcatttgtgttaactttaaataatgacctctatgtgaggaaaaggaggaggagcccttttctggcaacttcttcagccctcgatatgatcttaaactgcaagtcctttggcaatcgctactaagcaaactcgagtgactccttgcctggacttgtcgtgtagtggagtgttggggagtgggcagtttaaacatatttctgatatatattatcgtctaaacctttttctgattctaattttttgtaaaagtaaacggtgcttacatgaacacagaagccattttaaaaagaagaaaaatgtggtaaaaacagctactgaagagagatgtctcaatcatccttaaaatgtgtcttttcccttgaacagaatagctactgagagtttttggttttttttaatgctaaaaaaagaacttcaggctgggcgcggtggctcacgcttgtaatcccagcactttgggaggccgaggcgggcggatcacgaggtcaggagatcgagaccacggtgaaaccctgtctctactaaaaatataaaaaattagccaggcgtggtggcgggcgcctgtagtcccagctactctgagaggctgaggcaggagaatggcgtgaacccgggaggctgagcttgcagggagctaagatcgcaccacagcactccagcctgggtgacagagcgagactccgtccagcctgggcgacagagcgagactccgtccagcctgggcgacagagcgagactccgtccagcctgggcgacagagcaagactccgtcaaaaaaaaaaaaaaaaaaaaaaaaaaaaaaaaaaaaaaaaaacttcaaacaattcaggtcttttaatatacaattacagtgagaggtcacagttaactgtgtcatacttaactttaatcagtgttaaaaactatacagaatctctggcaagacagtcaaagacaagtcagaaatgcgttcttgtttattggtgttaattcagatccataaatgtactgggaaaagttaataataataataatataataaacttatttgcgactgggctcagtgcttcacgcctgtaatcccagcactttgggaggcagaggtggatggatcacccgaggtcaggagtttgagaccagcctggccaacatggtgaaactctgtctctactaaaaatacaaaaaattagttgggcgtggtggtgggcacctgtaatcccagccactcgggaggctgaggcaggagaatcgcttgaacacgggaggcacaggttgcagtgagcagagatcaaaccactgcactccagcctgggcaacagagcgagaccatctcaaagaaagatcacttgaggtcatgagttcgagaccagcctggccaacatggtgaaaccccttctctactaaaaatacaaaaattagccaggcgtggtggtgcaggtctgtaatcccagctacttgggaggctaaggcaggagaattgcttgaacccagaagatagaggttggagtgagccaagattgtgccactgcactccagcctgagtgacagaaaaaaaaaaaagaaaaagaaaaaaataaataaaataaacttatctgtccgtatttcactgtaagaaaaaaaaaattcaacatttatgatggctatctttgaataaaaacgtaacagaatttagaaagaataattaatgacacagctgctgatattagtgtcttttaatactggaactgatcaatatcaacattataagatcctcacgcaatacatttttgagaaatttgtcaaagcatttctattgatcagcatatagcttgggcaaggatcttctcacctatggacaaaaaacttcatccagtcctattttaaagtttctttgtcccctcttattctaggatttatgaaatttttccataaacttattgtcatattccattttcacttttaaagtctgtgattagaaaacttgcattattggctttttatgtctgaggccaaaagtaagttcaattataatatgtataggaataaggtacctcaatatgtaaaaaatcatcaaatgaactgggcagtgaaaatcaactggctttaactgttcatcatatttgagtcatttctctcaaactcaaacatactaaaacttcttcagcaaatccatcagtatttggttttcttttatatgctgataaaatcatagataatcttacaattgacatcctccaaaagattcaaagctgattcgaaccttggagttcaggttcctggcttctctgtctactgggggtcaggatacaggaagcacaaggaggaggggagaagattgtgtgggcaaaggggcagggaaggggccaccactcaccaccactgcaggacgaggcgctgagtaagggacggggctgctcccagcagaatccacaaagtagctcattctgctctcagcacctgtgtgagagaaggcgttggctgagcctctggatgctcacaggtttgtggattagaatacacaaggaagacacgaaccttagaactaaaagtctccttaggagccaaccagttcacttctttgcatggcagggaaagcaatggaaattcagaaagatcagtgactaacccccagcaccggtaagagcagacctcagacagaaccagttccctggttgcaaggtaacatggataacagaccatgtctacacactgcagacagcaagcagtaaaccagtgcacaagaggcacatttttgtagggtttctgagcaggaaccagttcttgtgtgtctcccccacccacaaccaggcctggcagataagtaggcatacaatacacagttggggtgtaaattaattgataaaggaataaacatagaaaggattggagaaaggaaggatggaaaaagctctcctgaagaggtatgtcacccagtaacccaagaaacagataaacagagagaaaccctgcaaaagggattgagcattattgatcttgaaaaaaggagaagggctattaaataacttgttgagagctattttctacattggaagtctgagtgtctagaatgcttgagcaattttctggctgaagggattttccagttagctactggtcatcattacatatcgaacatctctgttgacctaaatactttcgaaagttcattacacactttcataaacttaatactatgcatttaaaaagtcgttcttgaataatctcgaagattaaattcctaggcataccaatcagaggccaaattcttattgttaggaagtgacgctttaacttcactgctttccagtttgtatttgtctgcccttttccttaattctacatttaaagcaactgatacatttcaagaaaaatcaagtaataagaaatgtcttatgttcaatttgcagtttggttcaccatcttgatcccttttttcatatgaaatgtatttaaatgtttaaatgatatagttaaacaggcttggcaatataaaactatactgcctaagggctacaacaacaaagctactaatatcatatggttaagggatgtaagctacaaacctcctgaagtcataacttatcctagaactatactttgtgtttttaactaaaactttgcctttttcttatgtcttttcttccagatgtagaatgcagtcaaaataacattagttttaaaaaattaactaagggtctgaatagctagactatgttaatcaagattttgtcctttagttttttaggaaattgatctccactacagcaaaaccaccccaggaagagctcctcattggtgaagatgaatggtaggaaaagctcaaagtaccctaggccagggacattgttaacatctgcgtcaggggtcactactcagtgtttgtttccaagaacagtgagtacctatgatgggtctgactctgtaccaggcactgagcatgaaataagagtaagatgcatgtcacgtggtttagatatgcctgtcctgaccatacactgtgaggatcatctcactgagctccatggctcctttcccaccaaagtgttcctcgtttttactcttagaatcaagttttaaagtcctgatgaatcatcatcaaaccatatatcccacttcaaagtttttgatctactttgagatctttggttgagacataaaagttaacaacattgattgtgtcatatgataatggcttaaccacaatcaaattccctagggaaatgttgatcatccctccagggtcctgcagggcaactaataccttctagaaatgaatactttttggaattccccccagtgatgtgggaatgctgtttcatgtaaacattcaaccctctgatttcctccaaaaaaagccccaaggatctcctgagtcctcacagacctcagttacagtagtctccccttacccaaataggatttgttccaaaaccctccagtggaggcctgaaacctcagatagtacagaaccccatacatactatgtgttttcctatacatacacacctatgataaagtttaacttatacattagacgcagtaagagattaacaacaataactaatacatgactagaacaattataacaatatactgtgataaaagttattgaatgtggtttctctctctctctctctctcaaaatatcttactgtactgtactcacctattttcagaccttggttgacggagagtaactgaaacctcggaaggcaaaaccacagttaagggagtacgattgtatttatccaacaatcatgtaataggcgtcctttgttagtggcttgtttattcatttggtaaataatcactatgcaccactatgtgccagacacggtcctgggcacttgaaacacaccagtaaacaaggattcctgacctcacggcccttagattctatcagactcaggaaaaatctgagaaagacaggatctctatcttcaggcagtggaatcgacaggctcacacataactatagcataatgtgataagtagttggccaacaatatggaaaaagaaataggaagcagtcagttctgctgggtgcagggaataggaaattgtgaaagattgcatagagcaaggtgtaaccacatggccctataaatcatccctagagtcccacaagtggcaaaggaccttcacctttcaaatgcctattttacttacgtatttctaagagaaaggacttttggaattggcagccacatcctgaagcccacctcaaagataccaagggtttctgtctgctggccagacaacactccccctcatagcaacactcctggaaaaggggtcagtggaaatatgttttctcttctcattgacagagtgagagaagaaagctctggcccaacatctggtgcactctgtgctggactgtattcttgaagctatgactgtatgaatgacacttcccttggggaaaagccctttgcccagagaggaaactgacaagagggagttgccagggctctcaagggctctcgtctcaggaaataactcttggacagaaatggattgctgctttattatttttttggagaaagaaaaaaagaacccgccctttttccacttgtagattgtgacacagaacagctgctagagacgtaaaccttctcagaagaagtaaatgaagtgtttaggtagtttttttagtagcgtttgttttttcttttcttttttggctttttggcaaaagagaattccctcccacaagacaactgcttgaacatcagctgcaccaacttttttcttagcattgcacacgtttattgcataaatacaagcaattgtggcatctgaagatttactccccagcgaagaagcatccatgagacctgtttgggtgcaaaaatgatttggacgctgggtaacagagggtcttgcagagctgagtttatttttcttgaaaaggacctgcgccacctgagccgcaggataagtgggtcagaaaggaggctgccctgctctggactgtggcttgctgtgcccccccatgctccctcccacctctccagccccctctcgccgtgacccctgcaccctccactgcaacatggaactctgttgttttcttaggcacgcgttgccaggtctcactcccctgcccttctcatgttaccccctctgctaggaatgcccatccaccctcaagatgagtgaaccctgcctcctcagggttttaggctcagctcagaggttattgcagcctggaatccttcctgagccacgcttcaccccagccagggttagcggctccttgtttatgttcccaaagtgtatttctatcacggtgcttatcacattgttttattaccatctgcttctgtttgtctctccagctaaattctcatctacttgaaggcaggcaccatgcctttttcatttttgtcttcagcacttaagacagaccatggggcataatggaaactcattgtttttttaaatcagtgaatgagtaaatgaatgaattggtctcacaagactaaaaatgtaagaggtagatcagatgtgaatatatttgttcctcaaaatagagaatctgaatagattgcaggtctagataaagaaccacttgaaataatcagtttgtttcatgatccatttctaagggaaaaccgtttccttctattcacatagctatttaatgccccctcatctaagaaggcttttcccatcaccgcatatgaatagcagcgcctttctccgtactctgacacctaggtgtttgttcgttgtcttctccaaagtccactctgttagaatttaagctccccaagggggagatttagttcatttattcactccagatccctggatcctaggccagtattggaaagtagctggcacatagataactgttaaatacaatagtgtaagttagaaaacttgtacacactttttcagtgtaaacccctctttttacaaatgaggagaaagactaaggcgatgctgctaattggccaagctgagaccagactcctggtcttcagcctcctcctgtgcttagagaagatgcttctctagacctttgttacccagcgtccaaatcatttttgcacccaaacaggtctcatggatgctgcttagctggggagtaaatcttcagatgccacagttgctttgcatttatgcaataaacgtgtgcaatgctaagaaaaaaattggtgcagctgatgttcaagcagttgtcacgtgggagggaattctcttctgccaaaaagccaaaaaaaaaaaaaagagagagagagagaagatgcttctctaagcaccctcatcaccctggatggcgaggacagaaacaagcatgagatggagaagacaaaaaagtcaacactttggcttatgtgggtgtctcatgtccaaaaaatcactttaaaactatggttctgcttgattctagagagttctattcttcatagagcgagtgaccacttctccaacttcccaccctccccaaactggcaacccggccaggacctgtaggctctcacttcctttcacccaaagcttgccagggcagggcagggcaggttgagagacacagaataaaggaaaaattagggaggagagggactgttcaggccaaggcagcagaagaacaagaaatcccaaagagaccaggcttgaatcaaggctgaatccagttcacatcaactctgaccctgcttggctgtatttctagataactttgacatcagttaagcctttttcatttggggttatgtattcctaaaagaaaaactacgcttttaggtaaataccaagtaaattacactttaatttttttcttttgaaaacaaaattcttttgaaatcagcagtttttgccaaactaatacaatgttaccgcaaaaattaaaatacaaaaaagtaacagatggatattagaatcacctgaaacctcaccatgtagagataattatactaataatttgttcaatattcttctgggtattttttaatctatctaaacgaacatagatgtcacacacacacacgtgattacaattttaccttcatgagattattctccacatgttcttttgtaacctgctttgttcactgacatttaacataatgctatggacatttttctctgttgataaatgtggctgtctatcctaaagatgatgactgccaagtattctattgtatgtatatatcatacttttaaagagcctcttattatcgtataattaatttgtccccaattctttgtcattataaaaattcctaaaatattttacattcccactaaatgccgaaaaagagcattttggggacaaagaaaatatgcattccatatttgaatacatattgactaactgcattctataatagaccagccaaaattagactcccactgacaaaggcatcatgttttaaatttcaacttgccctctcgtcttcatgttagcttcataggcaatgaattatggttaaaacatatcctgggtatgaagatggcacatggggaattcaaaagcacaataaagctgtggcagaaaatgtagatttctccccaccacccctcaccccagcctttcctctttgaaaacaatgcaaaatttgaatagatttccaatgagcatttatcctaatgtcaataatttaggattcctatcaattcaaacaaaaagcatgtccttttggcttggaatacaggagacaaagaatttggcttccagggctgggctcggtggctcacgcctgtaattccagcaatttgagaggccgaggcaggcggaccacccaaggtcaggagttcaagagcagcctgacaaacatagtgaaattccatctctactaaaaatacaaaattagccaggtgtggtggtacatgcctgtaatcccagctacttgggaggctgaggcagaagaatcgcttgagcctgggaggcagaggttgcagtgagccgagatctcgccattacactcccacccggcaacaagagcaaaactccattgaaaaaaaaaaaaaaaaaagaatttggtgtccaaaacaactaaccatgtaaaaaaaacttgctccaaacaacagcacttttgccaaactaaaggcaacacctgggctaccaaggcaacatctttaatctacaatgtatagagttttaatttcttttttctgaatactatagaaatgtatttttgaagactcagagtatctcctctttcaggaagctttcccctcccccctaccctctttggcaattgcatggacctccttgatgcccctccatgggatttactgtaacggtgtaacaaagttcatgacacttcctgtatctatgcctgtttctgctcctgaatgatgagtaacttgagagtaaggatggtgtcttttcagatgacacatagtagccatgcaacaagtgtctgtttactaaatgagggaaagtacctaaagtacttgaaacagagttggtgtgtacaatccttgtgcgtcctgagcttatccaagagagtaagttatcgtttggacattaaaaaaaaaaaaaaaaaaaaaaaaaatccctgtgatgaagtgtgtccttgtgtgaccctgaggttaggcttctcaagagttaactacaagcaagatggcacttttctctaaactataggatgtaccagattgatgagttcatctatactccttcagtgtgttctttctgattctcatgagtagcccacgtgtatttcccaaatcatttgagtagatgtcttccctgacctgtcactgtaacaaaagctcccaaatccaattctctaagaactcaggtttaagatccatcatatctaggaaagctgaacattccttactccccatggaaactttgtggttacaacgcatagaaaagaaaaaggattagaagaactgaagatggtttttctgtctcactactaaatctacaagaacctcatttgcttgactaagtaatccaacattacagtagtagtgaatattccttcttattttaagtagccagcactgacaaatgaaggctgtgttccaaattatgggctactgtcttctgtgtcttaagctaagtgcatttattctttcactaaggttacagagcagcaactcacagtacaattaacatctcagtctttgtttcttcacaacttcactataattattccgccaacccttgcttaaatggaaatgagtcatatccatctcctatttctctaaaaataaacccatctcctaattaagcataacactttcaagtcctgtatgaattgacatagctcaacgaatccttcttagaatattaaaatgaactcatgtcattataattttaaagagtatattgttttacccttccttgaggagtaactcgctactatctcctgaaaaagagaaagactagaagatgttttactctggtataccatagcagttaagaaataaggaatgcttcatagattattttatgcatttccttctcagtggaaacaaatccctcaccatacagtactgaaatggcattgtcaacaatggacagaaaggtcttgcttctcctaggcatcaaggaaatacattaaaacctgccgactcttaggtctaggaatctaactaagaaaatgccaattctagtctctgaaacctttgaaatactaacaatctacactttctagtcaatcatacttctgtcagaacatcttcctgaagatcaaaggtaatattcaatacactgccttaccataaaagtggccatagcctgtgtacaaatgctatgcctcaaatcctgtattttaccatgaaattcaacaaatgatcacacttggccttaggatgtactcctgagccagaagcatggtaagtactcataaataactgaataaataaataaggattgtgttttacttcgaacctcaaaacaaaaaaagaataagctggaggaataatgtagagtactctttgctttccaagaatggtcgtaatagaggccatggaataagagattgttttccaagtcaaatgcaaagaagggccacgagattaaaaacgtcaactctaatccaatgaatgctgccaatgaaacctctgaagagactagcattttaaagaattacattacagactcttagcctgtgaagcatgtcagacataatctagagtttagacttggctctggctctaaaggaattctcaacaaaactgagaggcaccataaatagaaagagatattacaagaacaatgagaggggactggatagttgcaataatgcccctttaaaattgaactaaaagataccagctgccttagatctctcaaatccagcaagcaacttcttggactatgtctgattgtgattttcatggtggagtttcatttgttttattacccgaaatgtaaggttccaatttctcagtataatgctaaacagcttgctagcattcttatataaagagggattgtgcaattccagtgaattttggagttggaaaaaattcatcaatcttctcatttatttcaatgaactgagtcctaagaggttacgtgtttagcagtgatcaagaaccctggagttacatactatgggtgaacgtagaactgcttgctgcgtgtatggccatgagcaaatttcttaacctcacaatcagtttcctcaactataaaatgcaggtaataatatcaacactttcaggattatagaggaggatcatacaaaacacaaatacttagcagcatgctgtataaatagtaaaaatggtcaataaataataattgttattattgctattttatcagtagtgcctggcaattagtaagcattagtaaatgcttactaatgtcactaattagtaacactactgttttatattaattacttttttctactgcccaacatggcagaggttatttaagtgttagagctagaacatggatagctaaatctctcatctctttttctaaagacttgtattcaagtcatgaaaacaggattccctttcataatcataggttgagtagcattagtcaagaattttgcaggagaaaagagccacaatttctgtttaatggtagtctgtttgtaccattgttatgcataaaaccaagaagtaagcatttttcttacagtggagaactaactcattgaaagattgcatagcacaaatggtgaaatattgcagcttcctgagttaaaccaacatctttttgatataatgtcgatcttttgtggacttacgctttagcaactagatacaaatataaggaagtagtaaagcactgcggaaaatagtgcaagatttcttgtttgttcatttttttcatttttgctttttcatttgtttttgctttttctttagagcagtgcctcccaaactgtaatgtgcatatgaatcacccggggatcctgttacaatgcagtctgctgcagtaggtctgaggtctggccagacattccacatttctaacaagctcccacgtggtgctgatgccgcaggtcagaggacttcactgtgagtagcaaggcagcgctggactaacttggttgaactcatgagtgattataacaaggtaggtgtttaggaggcagagcccaaggaggaacaggcaagacttctgtgccaaggctgagcagatgctggtaacctcaggtgcaatacaaacccggctggggagaattgagtagctcaggacctgtcagtgtctcaggagccatatgccagatgcacatctgccaagacttcttgcttttcctaagaagacatggttctagttatttggtcccttttatcaagaaactggcaatggtgctttctcccatcaacagaagtcatttggattaaggattacaagaggtgccaagagataatttaaaagagttatttgcattatatgtttttttttacaattgtaaaagactcacatgttttggaaactttttgtacattgttttgcaaacttttatgcatctggaattatttcaaagtgaaaagttttttttaagtctctaaaaagactaaatctcttttaaatctctaaaaagaccaaaattctggagttttctacctttccacatctcttgaaaatttatatattttttcctccccattgagaatattttcctgacatttgcactaaatgtttgttgcttactctcatgctagtaagtactacccagcctgttccctctaagttctgaaggcagctccaacacttgattactggaatatgaaatctatcctcttttgaaaaaaaggcagatcagaaacatccttccctcactgctctagataccatttttttctacctgaactcccaaagcatgtataggttatactacactacttaataattatattgtctttcatttttatcctcttttctagtaaagattattgtgttaattttaaaaatggagtttacatattgtttcttctgtgtttggtatggtctccagcacaaggctgggcatggagtagaaataaaactgatatttgtcagggaagggactgacttacttacccaggaaactaggcctgggtagtctttcttcaaagtcagtatcttcataacaatgaataagtaatccacagataccacttcagaaaacaggcttaatccagtgttctcctagataagcaaatcagtctaagcagaaaaatctatcctaaatttgtgtaaatgtcttagagttacttagattcctatgacatgcagttccaatcacaagctctgggttcacattccattggctctaatcagggtccaccatgagttaacacggtcatatgactgagcctcagagtccccacctggtaaatggggatgacgagagtggagtgcccacctcaaaacttcattgtagattaaatgaagcagtccctgcaaagcacctagcaaggatgttggaacataccaagtgctcagtaaacgttagggctgagtattcctccttaggtgaaatgaagaagaatggatatgataactagaaaatcatctacattaaaaggtggagttcaataagctatactttcagtacagcagggataaaggagatgaggaagcaaaaagtaagttatgtcttcacatctaatttttcccaggattgaagaaacttaaaagatttgcctgaaatgccactaaattgctgcataccacattaattttgctcaaatgctaaatactttatcatttccataatgaagaaagaaagggaggaaagggaaggaggagggaagagggagagagagaagaagaagaaaggaggggagagaaaagaaagaaagaggaagaaaaaagagaaaagaaagaaagaaagaaagaaagaaagaaagaaagaaagaaagaaagaaaggaaggaaggaaggaaagaaaggaaagaaagaagaaagaaagaaaagaaagaaagaaagaaagaaagaaagaaagaaagaaagaaagagaaagaaagaaaggaaagaaagaaaggaaggaaggaaggaaagaaagaagaaagaaagaaaagaaagaaagaaagaaagaaagaaagaaagagaaagaaagaaagaaagaaggaaggaaagaaagaaagaaagaaagaaagaaagaaagaaagaaagaaagaaagaaaaagaaaggagggagggaggaaagaaagaaggaaaagaaaagaaagatagaaagggagggaagggagggaagaaggaaggaaggaagcaaggaaggaaggaagcaaggaaggaaggaagggtcccagctcgtgggacgtaatcattcccttctgctgtttgatgtgaacagttgggaattttgaactggtaattagaaaatgatagtcactatggaaaacagatctattcaccaataattaaaatcacaaggtacatcagaacctcagttatcagtaagaaattcaccagtgcaatcaaagagagaaatctgttgattatttgtttgcagtgttttgccttctgcctcaccctcccctaggtgagaggacctgcacccacacacccagtttgttgaagtattacttcagacagtccttgacctcactggcactctgatttttcatagccctatgctgtttacttctattctctcatatttgtaaaccaggcggggcgcaaatgattgctcaccttttagagatgaagggaagaaggcacagacacgttcaatccctgttctctgttacaaagctaatcactgacataatccaagtgcacagccactttcccttctccgacccagcgctggttcaagttctgaccccacttgcctttgaactccattatcgtccgggaccggccactggcccaagtcggtgctctggccacagactgccagatgccaaaggatcccacccctctaccagcttcccccaggctctgcctcaggacatcctttcacagccagcaactagcacctccgtgtaaggagcctgccgggcaaagatgccccctccataattaggctctcggcttggcttcccacatcctcagcagcggaaccaggacggaagaggctgcatggatgcctgaactgtttgttatttcactattgagttggcaaggatggaagtagttgatttacaattagaagcagcatgcttcttcaaatattaatattaataactgcactactgaacacatgaaaagaccttttcatcttcaaagcactttgcagacattaacccattagctctcccttccctccattcaggaacaacaggtgagcaagactctcaacagcagcagtggccaccctgcagcccttgtgcacagcccacggcccctgaagaaaaagcgttttctctttggataaaaataggccaccaaacccaaaaccacaactgatgaaagagttatagtatcagtaattttacaaatcaaatggagctgatggagttatcattttagaattggtatttcctgctgtttaacaaatacttttttctcagttgcatggcagtggtctaaagtaagaaggaaaatggacttgagattaaaaacaaaaacttacccaaaaggtgataaagaaatcctgcaatagaatgcattgatttcagtgacccagcacccttttaagtttgcctgaagaaaatactactttaaaagttggtaacagagacctttaacggtgggtgaggagtcacatacaaagtgtcacggccagataaaatcaccggatgcagaggaattgccatcgacatctcctgccactgagtccagctctaccgtggggacaagaaatacctccctaactctgagacaaccgcggcccacacccacaccatgtctcaacaacagacttaggaacttgtagatctttggacaactgcaggtcagtcccaagacagagaaaaacaccaaacaggctagtttggctagcaagattcaaacctgtagcaatttcctctctattaaaagcaattcattaaactactagcaggagaaaaaagtaaaacaatagatttactaggagtgaaagagaataaaaagaaatttatatatttaactacagctttatttctttggaagtgctccaatttgcaaaaaaaaaaaaaaaaaatcagggtttctgacaagtaatctacgggtatctaaaacgtgcatggttttacttttgtgaagcagggaacatttttaaaaacatagtcttgctttcagactattctgacgaggttaggaagtatttttgaaaattgttaaacaattaaatgggaatatagaaagacgtgaaaagagaaagagaaaactcacttgtatcctgaatctccctaccgacttactctttaattccacagaaatttttttaaagcaggaaaaggaaaatggactgaaaagttttaggcagaaactgacacacacctcacttactactttgccggagagcagatcctgagtgagcttccctcaaagtctgtggtctctttccaact

SEQ ID NO: 1614 - DNA, 63551 bp, Homo sapiens
cagcattatgaatgaaattctttgtttttaatttcacacagtttaaaatacaatatgaaatcaggctacagtatataaaaaactctccagcaaaatgatgtgccagcatcagctactaaaataaacaaacaaaaaactccgccataagaatttttttgcatttttttttaaaaaaacatcgacacttacatcgctacatctctaagctacctcagttctgatttttaaaaagcacctgcttttcctttttttcatcttgcttctaaattttcagcttttaaaaaatataaattatatgaaaatacaagttggaaaatagtcaaacacaatataacatctttttcatccctatacttctcagcttaaaaaaaaagtattcttaaaaaaaaaagttcaataactgaggcagtattcctgataattttattttaatatatatattttatatatgtatatgtatacatatatttatggttccttgaaacttctttggaatgtaggtaagagttcaacaaatttatatagaccccaacagagtaagcggcatgcacagcatgactagaagagagatggtgtatttctcaccatgaaggttaggcaggttaatgctgtaaaacccagagtgttcatctccaaagtgaggaaaagcacatctgatctttgaatgctacctccaatccccacagccacaaaaatcagggctctatgtaggggaagtccctctccagaatggagaagggaacaaaagtgactctgaaccctaaagccaaaaccaacaaaggttaaggcatctctgggaaaataagggtttcacccagctagaccagatttgcccatccttcctctgaagttaacgtgtgtttttaaaaagcataaacgcaacatttccagtgtataaaccacccaccactcttcctgggatggtctctggcctttggacaaaggagaaaaaacatctggccagatcgacaaagctgtcttaactaatacactatctacaaatcttgaaaatggtggacttagagagaaagggaattttagcaaacaagcgggcggaggagcactaggaggcactttcttatatcttatctgctataggaactgcaggagttatactcacagaaggagagtttccggcataaatttaataggaacggtggatgatttgagaaagtgattttatgcctggttgcaaacagcaagcaataattgatacccggccctggttctactcttacccattattgaaatgtggaaagacttacctagaaatctaaggtattatttcagctgcagttttgcatgtctgcaaacacacacacacacacacacacacacacacacacacacacacacaacattcacacacatgcacacattcacacacacaccttttgccagtgcccaacaaaaatcacataatctaagagaaaacaatgtagtccaaacagttccacccaacactccctgagcagctcctaaaatattttgagagcttcattaaggcacctgcatccaaaagatcaaaataatacagctgggataattctgcctttgctttccatatggatgctccaattcatcagtatggggacactcatgaatcacagagctatgttcctgataattctgggtctgcaagaggatctgggagtaaataacaatcaattttcttaaagatatgctagaaagtagttagtacttccaatttctcatccaaatcccaaaaagggccagccctgagaagcttacctgaaatatttctttccttctctcatggaagtccataaaagccacccctcctccttatcctttcaactgggcaactatagagtgagggagattctaattgtattaggcacttttcctcactagttagatgttgacttttcctctaaaactccattttcagattccccctcacaaccagcagaaagatgactaccttgcttgactatgtttgtatttaaaccttgggggaactaaaaatctattcaaatctcatggacaaccttattttcctcactgaacctccttccttagtttcctttgccttcaagtcattcctctcttctggaattaaccttcacttaccctgtgccaagacatcagacccaagcaagaggccctggcatcacctgtgccattcattttgcatacacagtctcacctgacatcctaccggactaatttaaattcttcaaaggaaagccttgcacttctcttccaaagacagccaagtcacattttattgaaatgctctcttaatttccatcacttctaaaactcagcaagtctaaactcttcaacttaggtcgtgtctcaagttactttttcactcaccaatcagaaagccgtacacttctctctactgaataacagagttggcggtgagggggtgcaaaaaatggaggactcttggaaaataagacataaaagaaaaattacagagtgttagtttggaacgacatgcattcaggacttatttcttaggacctgaggggtaatgcccatgcatacagcttttattccaagtcatctatgctacagatataggactaagaaagaaccaagtcaatcttcctccttcgatctcccttccaggacttcaacagtgctcctacgtttactgtcgtccaaaaccagggatgcaaaatacattcagttcaaagacttaatgcttcttagctcaacattaagtccaaaccccgagaatccactgataacaagtaagtaaagggatgtgctaattttttttaattgtagatgacattcacacacataattcccctgtacccaaatcagcattaattgtccttcttatataagtcccatgaatttgggatccctgatctcagtgagagcgttttgcttttccaatggggtctatataaacagttttctttcattgtgacagaatcctcagccggcaaataaaaacaaacttacatgatattgcaatactgagaccaccttagagcttaagacgatttttaagaaaaaaaatactggcacaaaatttaataaaataaattttaacacaacaacggttttggcccctccccactgaagtccatctttgcttcaaaactagagtgataggtaaatagttctcagattttcagtgcatccccccccaaaacatgtttcatcccacccacctcttttttgccctcccagacctaaaaacagaagcaaattaattgccttacatcagtttcatgagttctgatgtgacaatgtcacttgctaatgggtccacaactcaagacactttttcatggatgatttttaaaaatgattggacacattagtctctttctctgttaagccagagccttcaagcttctgagaaggcccttctccctctcctgaaaatttgctcaagaatttctggtcccacccaccccacaagtcctggctttcctttcccaactgcgcacaattgattacagctgcaactgacttagctcccacccctgaaggtaaaaaatgagttctggaaaataaaaaatagaataacaattcaaaattcagagtccaaccaacacggctgtccttggaaggtctcagcagggtttccccagccccttcagtgccatcactcgtcggcatctggcttgacgtccagcatggcgtgcagctcctcaggggtgtaccccagcaggctctgcaggtcacacacaaagcggtacacgtagcgtttccccgctgtcttgtggatgatgtttttgtcgtaatagtagcgtaggccacggctcagtttctcataattcatcttaggtttgtttttcctctttccccatctcctggccacctgaaatttaaaaagaaaaataaaggaggagtaggcaaaaatctacaagacaggccaaatatatatgtttctatgcctatgctatacccattcatggtgacccatgatgctcaagtaagatgatttgagattcatgtagatatagaaaatatttttcgggcctatctcctgaattccatttttcatgggttgggcaaggatgggagtcacaatgattctttaagttgatgaaaacacagtgaccctgaactaggattaaatatgtgactttaaaaaacaaacaaaaagccacactatacattctcctctttccgcatattattagtaaaatctccttgctttgcaagcatgaaatctaacagggaagtgtgaagcggaggagctgagctgcaatcatacctgcctttcatcaacaggaagtgttttttttccataccagggcacaaatattttctcatgtctgccagaacaaagatgttgtctctcctgttcattgttttttatcctcagaattgggcatggcacggaaccactactccataaacatgtgtgtaatgaaataagaaactaatgagccaatctcccaaggcctcttgaactgtctggcccctttcacactcacagagccaccgggctaggaagaggctaagtcacaggaggcagctctatgggtgataactgacctactgccaggcacgttaatgccttctatcagctaatcctgtaagacaaatggggtaacatagatcttttctctattttccaaataatgaacctggagctcagacaggctacctagcttgctccgggtggcaagtggcagagctgggaatcccaatcctggaacacgtcattcaggcccacgccaccccttccaggagttttctctcatccttcctcaacacagtactcgcaagcccctccttccttacctcatctgggtcagaaagtttgaattcccagccatctcctgtccagctgataaaagactgacaggatttatcagtgagtaattccagaagaaactgccatagctggattggtccactgcctagaaacacaagccattgtgaatcattacaccagatattcagcactctacgcagctaatccccacacacggcactcccacatccctcttctctcagcccatccagccaggagaaaatgaaggcaacagacagtgcacatgtcggaggaagtgttatgagctcgaacagatagaaaagacaaaggcctccctataaaacaaaagcatggaagaaaatgtgtcaagtgctttattttgattaacttaaggatcggttcatttttattgctaaacaaattctagaaagagaacactgtgcctatcctctgggatattctaaggcagcataatcttttacacctgcaaaaactaagtcattatttttgccttcagaagtaagaaacatattaacgaaggaatgaatgtctttgccagttccaaacacaagttatggctcataagcactgctctgtagtagggagcctgtggcccctgatttgtgagtaagaaggatcactatcctccggccctcttacaaggaaatagatgttaaatatctgttcagtcataatatttctctccactgccaccaccctgcccttccagtccacttacaggaaagcacccaaaggaaaaaaaaaaaaaagcatcattactatttgaggaattaacgtgccacccagaaaatcctcaggggtcagatgaggactgtcagaaattctgcataggttcagtatattctaaattagacacacacacacacacacacacacacacacacacacacacacttctctgtcttagccatcaacactctgacagtcaatttattctatgctaaaaggtttatatcacaccgatttcctttgaggatacttttctcatctgaaatgacaatgccaccagtgattcttaatttataggtgtcggtggagagacaaataggggttcaaaagtccatgcttcttgttacactgccccttataacataaacaaactgggcagagcgggactgggaaagacccagtccatgtctctggatacagcccaggaagcaccagctcctacaggaaagctttgctcactaaggctctaatttttcaccggagttgcaaatttgtctgatccaaagtaaactgagatttaacaggaaacaaactttaagttccctctcaatctaaaaaagaaattgccttcataatccataagggtaatgtcttgttgtatctcatatttctacaagacattttcacatgcatcgttgtgcttgctcctaaaatccacacccaaccctctgctgtaaggagaggcacaagtggtcttacggcttcctttctaatggtgcagaaaaagtgctcagcaaagtactgtgactttgctctgagccacggttagcgaaatggtggttctgggtctagtacccaggcctttagactcaaaggaccagggcaacctccaatgaagtaaagaaacagctactgacacgagctatcatcccacagccaaaggaagtcctcctccagtaacaacttcctaatggtggtttccaaggctcctctcagcacttgccacgctaaatatgaaaacatgaaatagctctacctcctctttctgagaatggaccattagctctttaaaactatcttgcaagaaataccttacatgtattccacaataaaatggctcagtgaatgcctataaaataaagtaacattcgaacaacagcccagagggccgcactggtaaagccgtagcttcctctgtttctactttcattcaataaaaaccgtttcgtattcaactcagggacatttgcaggtttcttgggagttgcctaaagtcatgagctacttgttttctgcctgggctcacaaaactaaccgtgacattctcagaggaatccactgagaagccatcctaacaggcacaaagaagtaaaacagcaaatcgctctcaagaaatgcagctgccagagccctggtcacagaataggtttcttggagaaactcacgataactatagagactgaagagagacatgaagaaaaccattctatcccaaagctatgtaaaagaagcctcggaggagagggggttgccttagaccctgacagagaaaaactaatgagtgctatgcttgacggtgcacctactacgccgcagacactgtgagtgacgctctacactcgtttccttcattcctcccaataattctgtggggtggatgcaactgttgtgctatttgtttctaccacttcacagcagagaaaactgacacactgcaaggccatttagatcagcagtggagtagccgggactggaacccatgcagcccatccccaggttcttcatctcaatgctacgttgcccctggacaggaccaggccaaaggcctggcatctaaactgcctgactgagtgcaatgttccaagggataaggggacctgacttgaaaaactctctcccctacttctcacagcagttgcaggacacgggatagccagtggttctcccagtcatccgaccaccagtggccgtgccaggccccgccatggcatccacctccacaggagatatttccagcatcctcttgtggtagccattatgttacattacttcattgtttctccttcccaatgttcacctttgaacctctctcccactatctgaaaatctctttggggcacggggtctcatgacaccaagccgaggaaagggatgggaagatcgagatccttcccccggatgagtctttggcagggagctgtcagcacatctgctggtgctggagaacagggcccaggagcacactgcagtctcctgcccttgggacttggcagccacaatgcagagaagggaccttcaattcccgtggtttgcaccagctcccagaggacgaaccctctgacggaatggttagttttccttttctaccagtgcattttccaaactgaaatgtcaagcagtcataggctgtagatgccctgccctgccctttctctgtgatgtcagcatacgggacccggtgagtctgggacagggtgagtactcgtcagaggacttttgtcctcattgtgacttttcctttgttcaaaaggaatgaaagaaaaaaaaattaaattcaggccctagaagcccaagtcctaggtgcagagctctctaactcttttttttttctgtttacacccaaggaaagagggaggatagataggaaaagcagatacctaaagaaataatgggaatatgaatgggaagaaatctctcccgttggcttcataataggacagtcaacataacagagatgtcagttcctggctccctcccccgattcctgtagagaaaccccacaggcgcactccagcctaactggtgcacacagggctcacccttcagaaagcccacatttttgtaccaagtgagaggagttcatgatggccgctgaagcgtcccctctagcacctttttgctgactcctaaactgcctttttgttgtggggagcaagagaactaggaaagacatggaaatgttcttccagccagaaacactgggccagggtgggcgcagttcctggctgggcccgtggatggtctaatacaggagcctgtctccacagcaatgcatcaccctcacttcaggtctgggaggggacttcagggccacttggaaacccaaagcttagaggcagctctggggttggaaggcacactggctacacagatccaccagcgacacccacatccaggcccatcagaagttctcacacccaagattggtgcagacaatgaatgagtccagcactcccagttacgactcttctagagggtgtttctgtgtgcttagcggaggtctgcccaaatccacagggctccaggaccccatcccttgcccttgctccaacatatcctaaacttgtaaagcctcttcctccattccccctgcaactcccccttatccctgtgcccagcctcttccacctacccaaatggactgtggtctcagtgacctttgtcccctagagcagaaaacggtactaataatagcgccagtcatgggaaggggagctcacatgttcaatgtgactcataatggtgtccctgtctgggatctccaaggcagtcaacagcacccttcacgatgctgcccgggagtgtcacacatcaggaatccagtggcatcactgggaaagtatgcttctcaagtcgaagctctgagccacaacaacagaggggtccctgttagaaggaggtctctttccagagccatgcgggcgggagagcaccacacacacactccacacacccatctcccatggcacggagcctccacaccccctgctgtctgctccctctccaccctccctctcaggcggctgcaggggaatttccttctactgctttgttcttctcagcctctggagaagaggacagttcttactacacactgacaggtctgatttgaagaacgtgctacaagctctgaagaagaaataccaggtaggaacttggagagctcccaagcctacaaagcaaatcacaccaaggatgttcaccccctaaggggacccccaaggctcctcaaatctaaggcaacaatctcactttttaaaaaaagtaaagcttcaagtaaattactgctcatttgggtcatatttccttgtctgggagctgcaaggcccactatctgtctcaatgaggagctggttattaaaaatcccctgctattctggtcccttgccctgaggctgagaactgagcagcataaatacatatatagcaatgggctaggacaaggtgttagtaacatgctcttgatggaaatcccttccatttcccgatttgtcagtatcattcttctcattttccagatctgggagttgcctgcctgtgacaaggacatcctcacagcaagtgaacagggtcaggttgaacttcactttttccttctactccttcctcatttccatttcaaccacaagttctcactcttgtcacctgtgctctgctgagaggagaacacaggagttttcttccaaacagaaggaggtcaacgctgggcaggcaccttcccaggcagtctcctcatatttccatagtacatggcttacaccaagaccaccccattggtttggtctctgtccatttctcccatcactagaatatatgctgtaaggacaaggactttgttttttcactgcttcaacccaaagcctagcacagtgcctcaccaacaaacaccaacaaacaaaaaattctttgctgttgaatgactgtgtcatttgacatgttctccctgagaacacagactatatcttactgagccatatatcctcaatgccaggtatgatagcttgtcttcagcaggtactcattaaatattttctaaattacattactgaaacaaacctcctctgaagaaaggcatatggattagaaagtccgctcaaatggcttctctctattaaacaatatttggggccaaacaatatgggtgaccctcaggctgcatttcatcaacgtgttcccaaaaatgaaaatgactacctgtcctttgggagttaatttgctactttaagaagctaatccctttagctctattctaaaagtcaaatcaaatacctcggtgtgggcaggacaccacatttattttaacctatgaaactctcatggttggtcacccttgcaatagggctgactctgccctgatagcacacatctggcaggtggccctaaaacagaggaacaggcctgctggcccctcccttccagccaggtgtctctacccacagccaaacgatgatggcaaaaacagaacattcgaatccagaaatgacccatctgttcacaagtgtatcaatctgcctttcatgctaccacaggaggacgcacctctgagggtggggtgggtgactccccagtccaagcatcacccctttctgtcaaccctcttctaaatcaccattcacaaaggcccctaaatctcctgatttccattaagtttaaggacaaaacagaaaacatcctgacagtttcttggcctctggaccaagctcaacctgaagctgcacaaagtcttgttgcctgaggatgaataactcaagaaactgtattgctggactgactggcaatcaagaccctgagaaaattattttaagaagattaagggccaggagtgcttgatattttggctgagttctatgtctctcatttcttctgagttgtatattttctttgccccaccctgacccaatcttatctcatctctaacacactccatgtataacattctataactggccaatacggccgtggtttaaagactcactctgtgtcagtatattctataaacgtgttcctgtatcagtggctaataactcaagggcagtgattgggaatataacttccaataattcaactcaaacaacaaagaacattctgacaggtgtttggaaagcatacttgctgaacacgatgatgaacaaacaacaactttataaacttgtatttgttgctgagatagccagtatctaaccatgaaaaagagtgagaaaacagctctcaaatcagttaaaaccagtctttgactgccgagttcatgtctcttgcatgttagatcaaaaacgaaaggaggaggagtgtcaaaaaatttaaaaataaaagccattttacatgtcaggcagtggagtactgagtgatgacggcatcctataaaattaaaatatatgatgcctgtgggaaagccccgggtagggagttgagggtacgaggctttgatatcagttcttacctgaatcaccatatgcaatcttatgcaactcatttaatctctctgggctttactttttcctttcctaaaatggaaatagtaatctctgcttctctttagtttataaaaatgtaaattaagtccttattacaaaaatctgcatatatacatatatatagacagagagagagaaagacacttaaagaggtgaacaatttaggagcaactgaatatacaataatggaattacaaagaagaatgaaacaacagaaaatatatttttaaaaacaattttcagtaaaaaacaagaaaaaagatgcatttaaaaaaaattgtaaaagcactagaaaaaatctaattagacttccaaggattaaattggccttcgtatggcaactttgaaaaagtagaaagttggaggttaaggaaaaaaaagttacagtatacgaatgtaaaaatttttaatattttcaatgagaataagcatttaggacttttttaagttagggaagactctgaaatccttgttcccatgttaaaagtgcacacgcaccaaaagagacagcagatgcaaactgctttgcaagtgaaagtatcacaggcatatatggtttagggaaatcttggccacagatggacttagatcctcttttcccgatgcacctttttccttagttattcatgtccctcaccaagtattcttcacctaagtattgtatagagctcacctagagcaagttcaacaccgttccccacaaatgccaatagtttgggcccaaagagacgggtcccaccagcattaactggggttcaagcagaacctcttgtccagccatcagggcccaagacaggcttgacagcaagaccaggtggctggcaactggccagtggagtcctcccacctggaacagggttaagtgaggcttatttggccagtctgacttgggtctgagaacaagacagttacacatttttagggtatgagggaaagacctttgtttttgctctggctctgcacacctgcaagtgctcaagtacacatgtgtgggggcggcagcaggagaaaggggactgttcctctcttaaaggggcagtctctattcaaatgcaaccacctctttcttctaaacccatcagtaactctgtctaacacattcaagctaacactcagacacaaacttggacagtgagccagtgaagctcaagtcaggaagtgggtttctttatagctctttcctcctgatgtcttctaggtaaccggttcttttaagaagtcaccagagatgggttaggtttggatttgggggaaggggataagaattttgttataaaccaaagaaaaggtttttccagccactataaatgtacaaagaaaaatcttcctaagtgtgtaggtaatgagaagaaagaaagatatgttcactgatcagggttagaaaacaggactttagaagtctgaagattatagtcttttctcagtaggattctcaacttgctctctggaatttattttatcctaggggttaagttttccctgcatgtcaacaatgagagaaatcactagttaggtataatagaatccttggaaggtagttgaactagatcctaagtgatcatttgcacaccgaattttgtaagcatttatccagcatataatctctgaacactcctcaaacgtagccagagtgtgttgaatagcaaaacacaatattaacaactgcatggaggtagcggaacaagtactttttgtttcaccataacgtgataagctgaaagtgtcctacctacgcctttaaagaaaaaaagaacagagaacctagccttgagaggcctccataagaaactccaccgcctcagctctgaatgtcaaacacctccacagacctgtgccctgtgagcatctccaacaaagcaagtcccatccttgtttcagagtttaaactttcacattcaatcactctaggagaactttcactctcattatctctcagggagaggtgagtcatacaaaagacaataaagtttggggagttacagtcaacaacatgcattgaactcagaagcccatcacggactactgagagtgtcgggacacatggtcttgagtcctgccacatggaaaagctgtgctggtctcaacaagccatgtttacagctcaggtccctgcagctgtcacactacctgttctactcagttctcctgcttcagggaacataattgactggctctaccatgtccacaccagcacccctcatcctggggactgctccagccagggactgagcacagtgagggcatgcaggtccacccctgtgagacacagagctcctccagcagacgaccttgacccaaagatcccctgggcccagccaaagttttcttagaatggagctgcagttgagggctctttctacccaaatctcctccttccagacctgcagcatggtctgaaggttccgctgccttctcttcgctgcctttttttccttcatagatgctccttccgtaaacatcttgcacatctaatcatgtcttggcacctgctttccggcacactcaaactaacacagtattttgaatattttctgacatgtgaaaaccctgaaagtcatcttatttgttgtttgctgtgtaacattgggctagacctcctcctctaaaaagaaaaaaaaaagtctcgattccctcatttatacaatgggcataacagaaacttcctcatgtgatatttggtgaaggatttaaaaagtcagtgtatatgaaggagtctaagcacacagtaggaacttaatacatctgggattgagctaaataattgaaaagacctaattattattaaatgcctgctacgccccatgacactgccagcaattactgcaattctataagtaaaatgcgttgttccctggcctcaaggaacttagaattatactggaaaaataaaaggtttggagaatactatggaatgtaggtgacagctagcacttagagcctagcttcctgtatacccagcactgctccaagtgctctccataaactaattcattagttctcacaacaagcctatggtatagaaactattattactgccatttgcagatgagaaaacagatacagagatgttagcttgccaaaggttacacagctgctcactggcagggcctgactccatgctctcaattctacagggatggcccctgaatgttgcccttggtaaaactgcatgggatgaccactctttcttgtgtttaacttggacttctctacctgcaggcatccccaagtgactgatggggtgctgatgagtgctccaacctgcaggcatcacatgcaagtcaccttagggagacaggaagggcagcgcttctcttgaatgagcctctacaaagagcagcagctgctcactctctgcagcaggggaggccgtccagagaaaagaaagaagtgccaagggggcaaaggcagggtcatctgggacacctggcagggcctttcccaacagaggtgatggggagtttccgaggcctgttgtttaaaggcaataaagactggtgtggatgtctcagcagcacgctggctgcattctgctcagtggaaacattttgcttcctccaaaggtggagcttcaaactggagacagagtggaattccagaacagtcaccacccaattccattatttgtagtgagactttattaaagaaacagtgaccccaaaaatctaagactcagagactcttcctctaaaacaggcagtgggctatacccagaatagaggggtcaacccgtgagtctcctggtatccaaaatccaggcaccctcaagacctcagagagttgtaaacagcaccagggtgcaggatgtattgtacagtatgaatagatcccttctgtccaaagactgcttgcaaggtattaccgcagctgaatcaagacactaagatgcttcagccagttgtggtctttgaaagccatgacagaaataggcaatcaccactttccacgttttttaaaagacatttagaaaaaaaaaagttcatagtgaggacgaatctttttaccatgtgatctttttctactggtagcagatgattaagaaaaattcatacaaaactaattagataggaggcagaaacagtggaattactcacaggcaatagaaaagagctttgcctcccaaccagttcaaatcttcccgggaattttcctcctcagtgctccaaagtattttcccgtcaatcacataactgagcagcatgtgagtctattactccactgagatccccaggtccacgccaggcacccctttaggatccactgctaaacccagcaccgtgaatggaatccctgccagcatctcagctgctggctgacaggaaggctctatttaagctgagggggctgccagcttcctgcaactagttaatcacaacagcctctgagcaagaaagggaagacactctgtttctgcccttctcattcccaagctcttttcctcttatccaatcaggtactgcccaaggatggtctacattgagactgtgatggcttcagcaagcctggaagccagccccagctttgcctggcctgcagacctcagtgaaatgccctaacttctctgggcctgactttagccaattcacactgtcttacacaacagcatttacatggagagactttagattccagagcttcgctcctgttatctccccaaattaaaaggctctacgctgttcctaatcacatgcccacagcacaaattcacactgcactagtaacctgcttttactctttccttatcactaacttaggctcataccaaaagtttcctcagttgttgtttgtacctgaatacattgagattattttgcaatcgagccttccttcagaaaactgtgatttcagctaatgctgccaaatctcaggtttcattctgaactgaagggctttgaagcacttccttttgcagtaaagttgtttattttcaaaaacatgttttagcagtagttttgggttactgatccctaaaactcaactacgagccagaactctaaggttctggacttggccctgggactttcttattgtgtgactttagactggctctagagtcatctatgaaatgacaagaagaggatttatttcagggcagaatcaacttgagaggacctagaggagaatgcacagggctttttttttttttttttttgagacggagtctcgctctgtcacccaggctggagtgtgcgatctcggctcactgcaagctccgcctcctgggttcacagcattctcctgcctcagcctaccaagtggctgggactacaggcgcccaccaccacgcccagctagttttttgtatttttagtagagacggggtttcactgtgttagccaggatggtctcgatctcctgacctcatgatctgcctgcctctgcctcccaaagtgctgggattacaggcgtgagccaccgcacccggcccggggcttcttttcctgcaagactagtacctttgtgtgtgtgtgtgtgtgtgtgatgtctcacacacacaaaaaaatttggaagttgaattccagatagtcccaaatttagccttaaggaaactgaaggactgcctacttataaatctgcataacaccataaaacataatttcattacagttagtgaatggctttgggtttagcctttttcaggctcctagaaaacaagaaaatcacttcattcataaatgcaaatcaaagagtgagaacacacctagacattgataagggcattaccaccagacctgctcaacaacagctgcagaagtgataggactccttatctgtggctatgtctgacaatctggaatgaagttcaataaaggtgatttataggtcaataattctggacggaagccaaggccagctctcttccctcccacatacccctaacccacatgcatatagtgttcattagtgacaagagggagataaggtcctaatcagtctaggcaggcaactgcaataaccaaggagtactctcattatctaatatgaagaaaagattttctattcaggtgagacatttggtgcttaagattcaattcagaagctacctctgtgcagaatgcaattacatacatggccttgaataagtcatttttttgtgcctcagtttcatcatctatgaaatgggactagaggggttgagaggaagagagactactatgtgacaacccattatattattctatacctactgaaatggagaagcaagaggaagaagagatgcctatgtttttcaaggacttggaaagcgttttgcttaggtctataaaatgtatatagaaagcattgggctacttctctaggactgtgttgtaattagaaggggttcataatgtatcttcgaacaaaagaaaatggagctttctgatggtatcagtttgataaccgtaaacagttcacagtaaggtaagaaggtacattttggcggaagccaacattgcatttgatgtattcttaactcagctaacaggcaggctttcaagccacgttatctgcccccgcatcttgacctcatttaacaagttgctatgggagcccagtgaaggttgatgcaattttcttatctttggaggaagaatgtaactgtgcaggagaatgtgaaaattcagtttctaactggcttccgcacttacagtgcagtaagaaagacatcctatcaagaagtaaaatgtattcctttggacgtgatagggacaaagacccagactcctggtgaaatggcagggagatggattctcttcccagcttggagaatctaagcatgcaccctttagttcaggccaagtaatagtgacatagagctatgtgtacccctactgtgtggccaaacatactctggagcaatcaaattttaagggaacagacagaaaagttgagcagaacctgagaaggtgagtgtgacttttacaagcaataaaatgtattgccaacaagtctatacaatgatttctgctttccaaagtacttttgcaaatttcagctcatcttaacatgtctgcataaagctagacagccatttataggcactctagtgactgcctcaggtggtgggtgaggctgtatgggcacatttcatccgcttccctattccctaggacgcatcttaaatgaggttggcgggggcaccatgagggtgtgagatcaccctcagagggtgagtctgcagtacaggcaggaggtgttcaccaggtatcaattacagggaaaaaataaatactaaaatgtgggctgctcctcacatacctaacaaatcccaactttcattcagaccacaacaataggagaatccagttcaagtctaaggatatttaaaatatcttgaatccaaggagacagtgagcccacatactcgcttttctgcactcaatatgcgctcaaacatttgctgaaataattgaattgttataattgagggtttttttctctatgtctagcacaatgtctagcattcatttatttaattagttgatttaattcaattacactttcacagatttcctgccaccaagataagaatgaacacttctacttcactaaaagtagaaaagggtacaaggtaaatttgcctaaaaccacacagtgtgttagagttgggaggaaacacagaggacttctgttttctggactattattctcgccatcacatgagatagtatgaaaagtgaaattgcaattgtcaaggagaaagaattaaatggtaagaggcttcaaaaatgttttttcattaaaatgattacttcagactttgagacttttaagagataatcaccaccccttctcttctactcactaaatgttttactcccttatcccatttctgaagaaagagagagagaaaagaaggaaaggagggaggaagggaggaaggagggagggagagagggagggaaggagggaaggaaagaaggaaggaaggaaggaggaaggaaggaggaaggaaggaggaaggaagggagggagggaggaagggagggagggaggaagggagggaggggaaggaaagaaggaaaggaggtagggagggagagagggagggaggaaggaaggaaggaaggaaggaaggaagggcagaagagagggtgggcaggcaactatcaatctatccaaacataactcagacctagagcatagttttctctgcaccacaaaaacagaagcaagcactgccaattagagataatgtctacctcccaaggccacaaagtcattttagagctacctctgcctttcctttctcttcccaattaagcagcacatctcccttcctttatcactatattcaactgcagtctagttctttaacccctaacaggtataactgcatgagctggcactcttgtacttcctgagagtgacttaatacacttttcctcatcccagacgtttttaatggaaatggatatacttcctaataatctcctttcaaagatgggaaaggactcccttgaaaagtactaagttcctacatgctagccatgttcaagcaaagaccaccagggtattgtagaaagaataaagtaaggacctttaagttccattcctggccttgaccttgttgctactccaacatgtagacataattcctgagcactactcatgcaatgaactgcactaggagctacatggaatgcaatataagagagatactcctgatctttgaaggaggagtaagttttcaagcatttgagttgttctcaaaggtcactggttttcttcataaaagacctaaggcttccctgaatgcaaaaataaggattcagcatactctaaggatcagagagacacctcaatagaaacacagatcttgctgtttgtcatcatccacacaaagggtccctacatgaaaacatatccagggtggagagaattataagagaataaaggcctagaccacatctgagtaatcaaagctactttaaaataagctctactcacaacacactttctaatttttagaaaacactacaatcttacagagagatctgatgattaacacattaatgctccttggctatttctcagatatactctccacatgtttttctggttaagtagcatgatatgctacaacccatttgaagaaagcattgttttgctctactaccagagtctcaatcaaagttcaagctctcaacctacatcttcctttctctatggcctttcttcacccatcactatcataactatagctttcgctcctggaagaaaactgataataaagccgagtaagagaaggggcattctctataggccaggatggatctggacagggcgtagtgccactgaggatactgttcccacatttgaacagctggcctaaggagaaccgtgctgcagaagagtccagtgcggaggccattcagttgtgcctttgagagatgctgctgctgattttgtatttagaaagacctcccaagagcagaccaggaaaaatcccctgatgccaggccactagatagagtttccaggaacaccagatcattatagttcccttcccccagacatggaaaaacacccaaaatgtaagtttcctaccattcttggaaatgatccctttgaagagaatgatactatttgcttccaaaaatcaatggctattcacaagcagagtggctggagagagactaaagaattcttagagagacttctcccccgtgccctgcaaaagggagtctctcgtcgtctctggtcagaggtgcagagtgccttccaggaccccacccacagaaacgtgcagatggagttggcctaagcagcgggagggcgcctacctgtgtagccagctagggcagcagcaggaatgacaggcttgtccttattgaggtcagcacggtcccgcacatagtccttgaaggtgcccttgggcttgtggttgggcagggcagccggatagtcctctgagtcgaagctgtcataggagggaacacgctgcaggctgttgaaagatgactggctgctccaggactgggtgaggcgatcacaactatcgtagctctctatgctttcaaaagagtcctggcccccgagtttacctggaggtaaaggaggaggtaggaagaggacagggggaggagggagtgggaaaaaaaaaaaactgtaaaaaccctcttatggaggacagattgctaatcagatctgcaggaaggacggaagaagggagaggcgagtgggaacagaagcttcaggggtcatgggtttactctgaggaaaggggctgcactaggccaccatccgagggtccacggccactctgctgcctggtttgagaactccaagtacagagattcagagtcaaacgttgctcacatctgtcggagtagcgtttgggtcctcaagagttctaaagccagaaatctagaagctgaggatcacacatgttatgatatgatttctggctgatgtcgtaggcccaatgaataaatgaagaaatcagagcaatgtcaggctgaattccccactccagctcaagccaatgagatgacttcaaaaggcccagtttggaaaacattttggtcataagaaaaaagaatcccattagactaagagcagattagcctgttttgaccttggaactaagtgctattttttagcatttttcccaaatactattttaatatgaaatacatgtactgaccctatgccttttcaaatagagtaagatggtgtaagatgcttttcccaagagattttttaaaatcacacacactatcactcttctaaacagaaaaccatattctttatcctctccaagtaaaattatgtacttgaaatttaaacttcattggaaaagtgtaggcaatatttaaaaggtttattaaagagttaaggtccacagcagtgtcagaaatcctttactgtgtgagttgcttaaggcattcttaactgaccacaagatcatgcaagttcattaatttcccaaaccaggttataaacagctgctatgattgcacaatagctcctggagaaatttccattggcaaaaatgccactaaaaaggaggctagcaaaaaaaaaaaaaaaatagttttggaggaaaacaaatgaatctaagagcgaaaaaggctcgcaggaatggtttttatatgcaactttcagatacttttcaagtaacctaagttaaatcataggagactagatggtcacctcaattcagcacaggccaaaaggcaaagggatgtgacaaatgtttacggagaaatatccgtaagtcaactcttaattgttcaggggtggttgatctataaatttcaaatcccagaataaggctgacttatacaacttcatattagtgtgcctccagtgtatttttccctccatgacagcggagattggttaaaacaataaacatcaaacatgaacagatgcccaaacctaaattaaatatataggaaaatatgttgctcccaacattgtttaaagatccggataaaatgtattcggttgagtgtgtactttttgtaaaatccactgctgtgggttttctctacatcctgaccccctctggaactgctttaaacagaaaggtggtgtcatccgtttcatctcattccttcctccactcatccattcagaggagggtaatctctggaaagcaaactgaagagcttcatggagttatcagccctgcccacccagtccactagcaaaagggcacctcttcattcttactaaaaatgaatatatatttctttataattcttaaaaattctttcccatttacccaccagaaaagtcatctttttcacctttttagagatcatttaattttctttcaagaaattcacactaaatgatttaagaaaacagcctacaaccagaatgtcaaagccttgttttagcagaacaggaaattctgtggcgtctcataaaaaggtatttgttcataccagctactgatcttcatggtcacttattttctctttgagacaaacataccaaaagcctaagaaggagaatttatattttcatcaacaccgcaccaagtcgatagtatttatgctaaagtctctctgaaatgattccatttctatcagccaattttatacttggagaaaaaggacatcagaattttcacaagcaagatagtagagtttccaaggagtcccactaagcaaggggactaaaccaagccagaaccagtctctggcaaccccccaaacatgaggcaaatgcaaccctgttgagagttgtggtttacagcggtaggcagctttcattttagctcgatttcacaaccctggtgctgggaaccttcatttacgggtattttctccaaaaatgggtagaatccaactggattagatactcagttatgctgctgcgctcatgtagggaaacctgtgttctctaaactgtccactagccagcctttctgagaagggcctcggcgagctccttccaaagctatctgagtccaccaaacagacctcagagcactcaaaacagaagatgcggcagcacccagccacccactgagtagactcgtacaaagacagtccttagggcccaaataagtggggcatagaagcactctgtacgctgtaatgcagcccgtgaatactgtactatggttagtataaataacaatcagctaacagtaatgctttcggtctagaccaatcacagcatctcagaatcaattggccctttgcataggccctgtttgcagcacttctaacatgcagaaaacagccctgcacaaaatggtcttcccctcaagtttctgtggcctgaacttggagggagggaagaagagtggagccagaaagaaatacctcatgtctccttgtaagggtcacttttggtccacagtcattagtttggggttggaggggtggtagggaccaaaaccaagaatgaagaaaaggagagggaaagagacaattacacaaatgcaaagccagatgcaatttcaaaacaatgtgacaggagatcgacccaaagttacaacatggctgagcccaaacccacaggcttggcctcactgtgtagatgtacagaaagtcccacaaggaagaaagtcgttttaatgctttgactcgcctgataaaaaagaaacacatgtacacacacttgtgtgtatgtatttaaatagacatgcacccaaaaataaaaaagagccagaaaggggaaggccgactggtcccacccatccccttcggtctgaaacactaacaccctggggccttaagaaggaagattaggggttctgattttgcagggactttccctctgcagggcttgttggtgatccctaggcctgctaggaggaagtgtgagtctgaatactcgaagaagacgacaatgggcatgacccatgattcttcaaagtaaaggtaccattgggctctcctccaagagcctcacaataggcaccgcatatggtcagtcattgagcagaaatcactaataggccagccccagcctgacatctgacccaagccccgcttgatcagctttctcctgttcctcttcccatttataattctttcccatttacccaccagaaaagtcaggtttttcacctttttagaaatcatctagctcttgctaaatagacaaaccctttcttacaatagattgcatttttctcagaaacaaaacaatctggacactttactaggtaggctgtacctctgagtgtttatgtcctgttcctaaaaattgggtgcattttaccttttttgctttatgtcacccagctctatttttaaacactttcttccctgacagtgaatattttatcactattataatagtcacgttaacaaaactaccttcttttggaaacccctggccacctccgtccctggtcctctagctaaatacacacttcaccacactgctgatgactggttccaaataaaccgttggttaaccatcttgtatcttcccaaaccgaaaaagtcacaggaggctaaagatcccaggctggccagcagaggtcattccaggtacccagctaggatctacagtcagacccaggagtcctctgggaggagcaccaggacacatgctaagcttaagggttttccagggtggccacttgaaccatttttacttgattatgtcctcctcaaggaaaatagagcatacctttcaaaatgaccaaattcaactagagttattgagtaaaacattttgcccaagtaagatatttaatttcttagattgcctgattttgatttcactgtggaccccatggcctttgtcataataatggacttggctaaaacaccacgatggaaagttcttagtatctggacactctaagatgggaaggctgaaactgaggaatctacaggtctaataaataagaaaaaaaaaatggaacctgaaaaaaactcacaaagtcaggtaattcttgtaaacccaagagcttttagagaagaaatatgacctaccacgactggtcctccccatgcacatgttgtctggggtgacgacttcttgtttgatagcaaagtagtcattctgcaaggtgtctgtctggagagggtctcggagaatgaccgaggggtagtcattctcatacttgagggagaggagctcttccgagctgatgggatggagcgtctgataggactctgtgatgaagctgggctctgagaactccgatggtggaacacactgggcatgctcaataccatagcctggaaacaaagggtttgcaagtaaagagaggagagatttgtacctaaaataagcagttttcaccatctacagggccctatgatgtgggacaagctccttagagaataagggaaaatactttaaatcagaaaagcttgcatttttaaccttgtccactactaaacagctttagcccttgacaaggtaattgatttcctgacttcatatcctcatctctaaaatgggggtgattgcgatttttcccggagcactgtgatgaagatgaaatgaggatagaggtcaaatgcccaccaacattccccacacaataagctcttgacacagagtagttaatatcattgtgtcactggaataaaaattgtaataacgtaaaaagataaaacgaaaaaaataaaacctgtttcatattccctgtaaaagcacagccatcagataagatggtcctatatctcagagcttacattagtgcaacaggcctacattcattgtttccctcaggccatctcttcagtatggttgggtatcttacacgaaaaaggagaagactgtatttcctataatagaatttgaagctgcatagcacactcttaaagaaggattttggaggaaatgctgttatctccactagtaaaaaggaaagaacaaagaccaagatcaaatccctaacccaaccctcttttggccatcgtagtgcacagtatcaaataggaacaaaagtttaggggtctagttgcagtctctctgcatgactttcaggtgaagacatcagagaaggatcctagtgtgtaggaacttggtaggttaatgaaacatatatataggttgaaactttgtgctttgtggaaaataataaaataaagtaacaaagaagagtctacatctaagaagatattatttttgatagaattaccatgaaggagcctgagattcactgagataggggtcttttcctagtttgctattatcatgagagaagaggggtagaaatgaacttactaatgaagtaatccgaggtatagcgggattctggataggctgggttgactccattaacttgatatggtttcacatcctctgtaatgaacagatagggaaggaacaaagaggtcaatattcaagtcatgcttggcctaaaaggatcttggatgcaaagaccacaatgatctcaaccccttttctaagaaatctgcatactcattaactgggttggtatctgagtctgtcctgactgtggccttgtctaaagatgagatcaaaaaaatatgactaaggttattatttcagtagctgcaaaatgggatttagtatcttggaaagagaatccatgagtaatctctaagggctcagaaggcattcagcattcattctcaatgcattcgtgctgcgtgtatgtcgaccacactatagccaaaggcttgagtacatcccaggttagcaggatcaatccccaacccccaaactaatcaatttcaaaatttctcaaaaatatattgcagtctttaggccatagattttacgttctccatttcctctaacagatgtctggtttttgttttgtatttttcccattgccctcaggtttcaagttcaggcccagacaagaagcaggacactggtaaggtgactccatttggtgaaatgcgactgcgcttgtgtcaagggagagaagagcaacccagtcaagctcctgcccagatgccaactcccctaggaaaaggagaggaagggagacgaagtgcacctgcggacagaaagctctgaacgaccctgcagtaagcctgggatcctctaattaccctggaacaaatgccatggctccgattcttgtatggagtagtctgattatatttcaccataagaatctgacatagagtatgggtttgggtttttcctcaggtatttgatagcttgttaggagcaaagtctgatgggaaaacaagtttatgcctgcacagaaaaacagttcccagttgagataaaatgattaaactttgctttagcagtttatcagattgaaacatccccgtacctttcaccttccaccccaccccaaacagctatgttcttttgctgctgtgttgctttaattacagaacaaaagctgtagcctcagcacaaacatcatgctcatctcttcaagtaactgaacctgaagagggagaattctttctgcctctctcaacagaatattgggtgggaagatatgacttttgctctcaaacatactgacttatatcctaattctcttaaattttcttacattattcctttaccctaagtgaggccaaaccagtcttagcggccagaaggcccctgtgaatccacattattatacaaaaagcacaggatgggatgttaaattttaagttaaataaaaatatattgagggcaggcgcggtggctcacgcctgtaatcccagtgttttgggaggccaaggtgggcagatcacgaggtcaagggatcaagaccatcctggccaacacggtgaagccctgactctactaaaaatacaaaaattagctaggcatggtggcatgcgcctgtagtcccagctactcaggagggtgaggcaggagaatcgcttgaacctaggaggcgaaggttgcagtgagccgacatcgcgcgactgcactccagcctgggtgacagagcaagactctgtctcaaaaaataaataaaataaaataaaataaaaatatactgaaagttgaaataaaatgaagaaaaggagatgagtgatactgaagaaatcgcctaccctgagcttcattttacagacaaggacaataataggacttgtccttactatctcacagttattttgataatccaaagagaaaatgtatttgaaagcactttggaaacagggagacatgatagagatattaattgtaactacaatcagagatgggcttagatagcccaaaacacctagcagctccattttgataaatggaggaaaacagcctcttagtagaatatactgggttacacagtctgattgaatctgctattgtgtttagaagtcaacagtcaaatcagatctgttaggagcctgccgtatcgtttccctctataaacaggtcgctcatgtcaacacctatgagtgggtgtctgtgcatggagaacatgccggtgctttgcaactgcctgccatcctcggtaaaagcagccacagaaagactcacctagttctttcctgtattcctttatgtcttatttttcaacagaaagtgaaaagaaggaataaagataacatttttgagcacagagaaatctagtttgggtctctcttgagcactgcagaatggaatatattcttaaccaaaggaaggtataatgcggggtaaaagtgctaatcctgagttttgctcccctcccccagcgtctgtgccaagggttagagctgatgaccacagggaaaggatgggcctgggttagagagggcaatgggcttctaggcttacagtcagctgaagggcactgctgactgctggtaactgcaatttattttaagaaaaaattcaaaaaaataagcacaaaaacacccaagtttgccgcctgctgctgtttctatactcagccaggactgtggtacatgagtcacttggtccaaaaaggttggaagaggctgttaggggaggccatgtcattataaggttgcaacatagcgtcctgatataaccccagttcctgctccagatgtaaaaggtatgatgcactactgcaattccaattcagttagtgggcagagaaatctgtcttattaatacggtctcagacgctaagctttcccgggatgtgatgaggtattatggggcatgcatcaaggcagtgtgtattaagattgcagaaaacaaaaacaaaaacaaaaacaaaaactattcttgggttggctgtgggcactgcttgttcaaccagggcatgggtttgagataaggacctggattagaatgttgcaatccaagaagcttcagtggtacaatcttgctgaagattaatatctgaacccccaatatgtagaagaaaaagaaattacactcatctaagagtacctgctgtatgctgagcagtgtactaggcacattcccacatacgtcctacagtaggacacccacagataaaggcattgacgtcccaccattgggtgagccccctacctactctcacagcaaccccacataacctccacctctctctgtttccacatatttacctttctgcaggatctctagatgttcccataagatgtccccaacaaagtctggggccagctcgagaaagcagtctttacccagggcgcagagggctgctccattcatacagaacttctggaagtctacacctttcaggctgaattcattcacagcccacatcacccagtcccgaacatgggtttctgtccactgccgggggtctgaggaaagagatcagatgaagatccagcaggtcgggcttttaactcctatccaagcctcagagaggacactgaaggagctgaatttagctgagaatgctatctttattcatcgaatgaggaagcatcagcctagcctgcacatcattgagtgccttccataaccctcccctccatattcaacatctccgccttctctatttcaccagctaggaggtcactactgccagccaaaaagtaccacatgagtattctctgtccttgcaggcaaagatttccatgaatctcctctctcactgccttattcccattggacttttttaaagccctgaacagaacaaatggcttctttaatagcaataataacaagagattgctcatgcctctccctgctcttaactataatatacttgagactattattctcgattattttttatcttagccaattatagtggtaacaattgtagcaattagtagtagtcattcattcaaatggcacttggtaataacattattaggtgcctgtattataccagatactctgcaaagtctgtacttatcataagctatagcttgagtagcactgtagtattgataacatgcaatcttcatacatgacctgaggtttaacctggctacacccaccaatgacacttagaagttcagatgacagcaggtgtaatgcccaacatcagagctgttccaagagatccagaagtgattctagtgtgcaggcaagtttgaggaccactgtcttcataccaagatggcaagaacaagcccaggagacggggcagcctcagtatgtgtgtcatgattgtcctaacagatggcagccatggcccatagctgctgactccaatgtggttagtgtaacgtctgcctcacacactccaggtgagaaaatgtgtcttcccaaagggtctgaccccaaccactctttttccaactacaaaaccataccttttgggatccccagtcgttgctgttctttagtgaaaccactgaaagtagcttttaatgcttgagacatcatttctttgctgcttggagttaatagtgggacatctgcacattccatatctgcatgaaaaaattgcatatgaataacaaaaattacataggtaatgaaccaatcataaaacattacaaatgggctgtaagaaggcaagctgagaaacaactgtgctagcatcctcaccagagcaccagagcaggcaattttttttttttttttttttttgagacggagtcttgctctgtcacccaggctggagtgcagtggcgtgatctcagctcactacaacctctgcctcctgggttcaagcgattctcctgcctcagcctcctgagtagctaggattataggcatgtgccaccatgcccagctagttttttttatttttaggagagacagggtttcaccatgttggccaggctggtctcgagctcctgacctcaagtgatccacctgcctcggcctcccaaagtgctgggatcataggcatgagccactgtgccagcatgagcaggcaacatttaaggggctttccacattgtgctaggtctaaaatgtcctgcatccctgacaaacaaatatgtttactcttcctgaacacctctactagtttatacacagtccctgcttatctttcacatttaccgagaatattaatgttactacatactttcagttacctatgaaaatgaaataacaatattcattcattcaacaaatgattatctagcacttgctttgtgcaaggaattaaagaaacaacagtgagcaacacagaaatagtctccacaggagctagctatctgattcttgcagtagattcagccactaaaaatctatctacacagttaaatgttcaaatgcaatgtcaataagggcttcaaaggagaagtacatgatgcaacgttaatgtgcaacaggaattcctggaagtctgaaggaaacaggaaaggcctcccttagaagatgagagatgtttgacctgaattgtgaaggatgcatgagaatttaggaagaaaagaatactccagatcagtggttctcaaagtgtagtcctcagagcagggacatcagcatcaactacaaaaagatcattttgttttaagatcaccttatccgttctgtaaagagtgatttaggggtgagtatgaatggatgagcaagacattttagaaagttattgcatcagtcctggtgagagaggatggtggctttgactacaaaagtggcaaggcagataacataagtgaacatgacttcaagtcaacttgaagtgcatacaggacgaaaaatctataaagcttggttagtgtcagtagtgaagaagagtgaggcattacagcctgcagatttgcaaatgtatcatcatttgccacacccacatgcaccttaatctctgctatgtccatccagatcctcctgtatttgcagaccatgttcacgatgttggtacataaatacagctgaacgtaaacatcttctgaattaacctcaggcacagtttcccacaaaaagtgaataagcaaagaaatgagctgagaatccctactagctttcctgttaccttttgacagtgatacactttaccaaagtgatttctagaaacctgaatcttcagtgtatcccatgaaactgacttataaaatgactaagttccaggcaaggctactacagaaattcttcaactggccatttctaaactttgcttcgttaaaaaatattccccggacacaaacaatgtgttatgggctgaatgaaattaagcataggataaacctctgaagaaaggagcaaatatattgcctctgaatgtcgaactaagtggagattacactgcataaaagaaggacaggtggcactttctctcttgtttgcttttagtgatgctgtcaggaaactgctagagtccaggctgtgccctggaagaacagaagggctccctagctgctcttccaggccttgccaatgacgaggaatctgaagttccagggagtggtaagtttgggttgccctgggacatgcccaaaaaaatctagtggaaaaaatcaacatgtctccaggaaggttaacaaaatgatggaaaatcccagattgttagggggaagtaattgggggaggggatagaatgttgattacataacatccagcccttcaaacaatggagtaatcatcaaatgagtcactaagaaacacatggctgctccccatccatccccactctacacctccaagaacagctaagcggcaggtccagaaatgtcttcccttagagtagaaatcagttttactttagagaaaagggctctctagttaaccagagagtattgcttctgagagaagaaacaactgtagcagccccagctcccagcacatggctaaacacacaagtcaatcaacaaatgttgagtgaattaaatttttccaaatttgaagcaactttcctcccttcacccccatccaacacaaattcattaacttgaactgtgtgggttttgttgtgtgtgtttgttccctccattagatttatgacttgatgaaaaggaccttactgatggcggaaattggccaggacaacacatgtggaaaacacaggccaggccaaatggacaagcagtggttctgctgtagcgggaactgaagaatgagactgactaggaggcccccagaatcttctcaacatgaaagctgggacagtgggatgccagtgtgaggtgacagccaaggacgacagcagaaagcctgaaaaagaagttccttgagtctgcctcccataactacacaagccctggcagtgtggtctggacaggactgctgagctgacaattctccacgtaggtttctgcttcctgtcagggggcaggcacttctgggttctcacttgttctctcccaggaaagcagctagaattacttttgcctttccacctcaatgccatctccacaagcccagtccacgtgctgttggggccccatcagaggtgcctggctctgcccctctggctgtgagactcaagtgctagatctctttaaaaaaagggttcacatcccagctgggggaaaccatccctgtccacttaggacacttgcatttggacttgatcagctccagagaaggcacagcattgtctttggagccaaaggattcagatgtaaaagtcagaactttatcctataaagtgtggaattgtagtttaaaaagaaaaaaaaagtcaaactcccttctataactaagtgaacagttggcaaagattgtctttttcggttgtgtgagcattgctcttaagtgatgactaatcatgctcaaaaatgtatattaaatagaaaataaactcaccatataaaatactaattcaaaaattctcttcatgttgtttgcagattgtagcagttctgttcaatatactcatcaaaaacaatgacaaaatcattacacgggtgaaaaatctgacatgacttagcctaagcagatatcgctttactcttaaaatactttacttcatcacctattataatatttttacattaggtacaaaatatttctaattttagaatcagtgtctgaaagttaatcactacctccatagacattaactaattatattttatggaaaaatactgaaatctcctttgtgctaataattacaatatcttaaattcaaataacgtatttgtttcaaaatgctgagaatccggcctggagaaacactacgccaacacagtggagattctaaacacaacgcactggaaaatgaggacataaatatattgcaattatattagatttcctgcccactgattattccttgggaccccaaatttcagttaatatttataggaattcccctagacctctgaaaggacagttgtgcagaagctggtgattaaataaccattgcaggagattgcacagtatttagacagaagtgagcaggtagctttctctgaatctacagaagaataagctagtggcattttgaatgcagggaaacatctgctcatttttcattgtggcctaaccctgaaccacctcatagatgtttcaagtgaaatgtaaaacaagggtttccattcacttacatgtaactcaaagttaagggctgttcagtttccaagaaccttccagggtgtttcatgtgtcttttcataccactcttttcagttctttgaaaccgaatggctcttaccaacaatggtacacagaatctaaacactaggtggcttttgtttggcaagaagttcaagacatctggccttactgacctcacgagtttatgctctcactattctcaatcaatgatcatgtgaagactggagcgtctgggatcctagggttaggagatgagggatacagccaaggacaagaaatccaaggtgcatgtcccagttttgcatgaccattgaactgggcccaaccccatcagattatgataccagtcatgtgtgttgggtatggtcacactcaatagcagcatgaaagaaatactaagagtgagtaatatgccttatacctgagaaatgctttacagtttgccaagactcttcacatacactattccaaaatatcctctaaacataaaactggaggggcctggaaaggtatcacaaggtccccatttcacagatgaggaaatcaaggccctgggagatcaagagcttgacctaaagtcacaaggccaagagggaccagctggggctagaagccagtcttctaactcttaaagttcagggtctttctctctattccactgcaaacagaaatggatcagatatccaggaaaactaacatttttcagagctgagaaaaaaaaaatgggacttttcctttcttattttgaaagattttaggagtgattaaaaacttaaaactattccaagaaacccagggtttcatacagctagccccgtaagaacataattaagagccatttacagaatcaactataatcttttcttttcctggcactcaggcaactgaggcttccttccatatgaagcaaatgagttaagtgaaaacctggcttccttctctgtccaaccctgactcaacctaatgggtaactttgcatataacagaagtttaatttgttacataaaggcttactgaaatatattttttaaagtaaaagtaaaccaagaataaaccttctggtccacatggagaggataaaagaacagttctccaaactgaaagataggattctaaagacaaagaaaaaagagagagaggggcgtgcattgttgataacttgttgatcaaaatccataggttctgatttcacatacgccattagtgtagacacactggataagtcacttactcaattcactttgaaaagaggtctgttcataggtggtgtctatatccctcatagagttttacattttttatttggcaattttcaaacatacataaaagtagagagaaactctactcaaaatttatcaatactacccgtttttatttcatcttccacacacatgcacacccatacacacacgcagaagaattatacacctaatcccagaaaacaagtcatttcacccacaaatatttcattgtcacaaggatattttttagataaagggagatcatagagttaaagttcaataagaggcaaataaactcaaggaaaaagaaaaaaagccttcaagttactttctctcatgcttaaatctaggtctatatttcatgcattggcccacttgaaccacagaacttctttcaaagcaacactgtcatgatctggaaagtgccaatgttggatcacagagatgatttcaaatcaagatggtaagccagttccagggacttccatttcctacaagcagaaggctgcagtgatatttcctcttaatggtcaacatcctcatgaacttacaactgtaactaaagtgtacaaaacaaataaaaaggctcggagttctggccagcacagaagggcagtgtgaaaggtaatatcattgccaaactgccgacaacaagtcccagtttaggagataaggtgcctttaccccttcagaccaacacaaatagagaaatggctgcagccacactgacggctctgcttctgaagttgatgacccctggagggtggtcactggtctacaagaggattctcctgataaaaaagctaatgatctcagaagaatgtgcaaaggaatctcaaagaaagacagtctctattgccctctctcattcatataaaggcagggttgaagtagagtagaagggagtggtaagtgattcctgtgataggcactagaaaccgggcaggcaggacttccagcttagggaggtactataatccacaaagcttctggctaaggttaatgcaaagaagggagggaagtgtccctcctcagcccctcggctgtattttcataaacccaatgatgtgacaacacaatgggggacacgcaggactcttggctccagcaagagtgaagcaataaatgactcagtgcccatgctgaggccacccatcccaaccaaaccgtctattattgtcccaaacaacaggacactatgagacctggaagagactcatatgagttaggaaacatacaactgggtttctgaacttcttttaatacctaaccctttcgaagtcaccagccagtaaaaaccactgcaaagaagggagaagaagctgcagagaaaatccccaattcaccctccagtgacctgactgaccaaaaatgcaagccagtctcaagttacagtatctcggtttgctgccaatgcacacagtcactagggaaagcacgctctttgggtacaatgtgccaactcagaggagatgcctctccccagagggaagctgccctaagacaaaagagatggtctcctgcaaggcagctccaaattgcatggagaagctggtttcaggtcctgcagccaggcctgagaaagaagcctgtagagagggctcagcacactgaacatctgtaggaagtgacctcagacttctccctcttcccttcatccacctcctgccccatcccccaaaaggagttttaacacattattaccactgaagtcctgaggatttggtgactcaccaggctcacacatggttccaatgagcccttgaccattacatggtagggaagcaggaaaaacaaatgaaagcagttgtaattcggcagcgccggagttcagacctgccagacaaaagggattgcaggcatgttcccaaattcgttcaggcacctgacatgcacaagctatttttaatcactggatttatttctttcctacctcctccaccatcctccacctcagcaaatgtttcgaagtcagagcaaaacccaaatcaattccaggtgttcagggaaacccagagaggctcttccgttccaggatcccagccagaaagcagaactgcccccttggtcctgtagctaaattttctcgctcattccttagactagttcaaatctcccaccctaaacattgggcaaatggcctaaaataggaaatacatgaatgaatgtgtcctgctggaaaggcttttaaatatgtgtttttctctagcagcctggcaagtgaaggtacataaaccaggtctcaaagcccctcagatgaagctcgctttcattctctaggatgctctacccaccatgctgtgaggattaagtggactatgtgtgacaatgccaaagcttaagacatagtaggtgctcaacaaatcattggctacttgattatactgaaaagcatcttataaaatataaagacttaaaaaaaaagattttatttcccaatgcttacagaaacatcaagaaggaatctggcaatttctccaggtacaaataagcgactgagaaaataagaaaaacaaacgcaaaaatcagattctgagatataaatggaaattgacatcccctgaaactggcatttttttctaacagaatagactaatttcttacctattctgcatcctccaatctgctaacgggaaatactttttgcagcaataagcatctaaaatatgtttgccgtgacacttcagaactacatgaatccaatgcacctaagatgccttttggttgcaaaaacgtcctaagagttccactttagaatcaatatggcacaaagcaaaagtataattttatgctaagaactcttttctatgtgtttggaatctgccaaaacccaagctgcgttttaattgtcatttatgggcctctaaattaacgacactcaagcaatttaaaaggaagttttagctattgagattatgattcctgtgtgcaaggaccacctccatagggtacattaaagaatcatttaagcttcttaaatgatcatttcaagccatttacaaagtacttcacatgtttcaaagcatttcctgcatagataattacacctgactcccaccacatgacatactttatagttcctaaatgtcccagaacagtgtgacttctttatctgaaaaacacagagccatggtctctacattactcaggaggaaagaatgagttgggctctttcgtctccatggctttgcagagaaccacattgcatcctattggttcttcccacatcttacacttctgaatgaggaaaactcctgccctgccttcactaaaattctcatgacaggatcatacggcttttggtaccaacatgacataggataaccccatccaggaagacaatggagaatatctgacaactacatcttgctataatcccagcttccactaattctggtttacataatagcctttgaggcctcatcctctgagatcttgcagatgctgatgaattgggctaaccaatttattttaatttcacttaactcccacctataattatcattcctgctatttgactagaactgtatcttttagaaagcattttcttgaatattctcatatgatttttcaaaacaagcacttgtagttattatctttatcatgtaggtgaggaaactgaggctcacaaatgtttcttaagtgacttaactaagattatcaaaccagtaaagtgatataacaaggattcaatcccacatcttcagacacgcaagccacgtgttttctccctgcacctattcacagaattaaaagcaaatgaggcaaaaatgatggggcatgataacatttcttttttcattttctccaacattttcattctagaaaaagctctttctgtagcagggaagaacctcaatccccgagactctctaccgacagcaggctccattgcacgtcctacccagaactggcctggtcaaacctcggctcggggcccacttggcacttggtcggggggtaaaacaggcatcgggagagtggtgctgagaatcaccaagaaggccaggctgggcaaggtgtacgatgaggagttttctccatgggcaaatgaaaaatctgggcaaacaaatggagtagagcccgtttatttaggctggaagaggtaaagtttttctgcacttttgaactgttttctcaaggcctgcctctccctcccacgcaggaaacaaacacagagacaggcctcttccagtgagggcttcagttgttcaaagttagcccgggaagggcagaaggaagaaaggcttagagaaaggaaggaggaacgggggctaggaaggtggtgcagtggccatgggggtagccgccaagggagaaggctggagctgggatcagacagaggaggagagctggccaagaagggaggagagagggaagaaagcaggaagcagagaaagggaatattggaaaattgtaaaccagaacaaagaaacagaatgcagagtggcaatggcctgggaagaggcaacaaccgactcccaattaatgatgttcagaaagcaacattttttcatcaattttgaaaggaaattctctctcaactttcttatttatttatacattatataaatacatttttaaaccaaaaaaggaccgtttttccaatgggaaaaagtcttgtttgagatgaaagccagtcttcaaaaacttcttagaggaagctgaaaccccacatgtctcggtgctacagaaagaaaaacaaagtggacattcttcctgcgttctaaggcttttttatgcagatgtgtttttcttttaataaataaatctggactgagaaggaaaaagcatactcatacacattcacacagtgcaactgtctgttttcaacccagggaaaccacaatgaaaaataagaatacgcaagtccattttcccagtacatcagacaaggattctcaatattggcagccacaggcactgaagcaacacagtatgcgtgcacaccctgctccagcttccagatccacagaggagtacttgatgatgagtggtcatgaggggcagggcaggacctgaagaacgaccaccatacttccccagaagtcttctcacttaagacatttggttgccccatcctttttgagctacacaatttcacttataagccaaaatgattatttaaaaatgattagacacaacgagtttaaatctgccttcttatgaattctatcaataggcccttgctttgcttgttgagagatcagcagcacaaagcaaatttgtccttatctggcagcttttcccctgctttcttcctcctatcatcacttccgtccaggtttccaaactccgtggttccttcaaccattcatgttggcatggtttttggccactcccctcgctccacctagaagcattcctctaagcctatgttcctgaagagcatcacaagcattcataggtgaacatcgtgcttctcagaagttaaatgggaacaatgagatgatcatcttactccataagctttgactggtgcagactaagacaacactgatctaacagcctaactacaaaagccactcaaaggacattgccaggacctctccatagaaagtgatactgaaccagttctgtacctattgactgaattttattaacttcacaacagggcttcacatttatccatattaacttcactttgtttcgatccatgtttctaagaacttttttataccttgaatctgtgctcatcctattagccatcattctcagctttgcaccatctgcaatgcactaagtgtgctttctgtgtctttctctattctaagcccctaataaaaatgttgaaaaggcaaccagcaagtactgatccccataacataacatcagagaccatgcattactctgacactgacacattaatcaagacccgttgggtatagttgctcaaccagttacaaatcctcctgactttactatcattagatccacatatctttgtcttgaccacaaatatatcatggaaagactcagacaaaagcattactggaatcaaaatatgaggttacaatattcagttggtctcccacttgtggagccagttctcccctcgagtttctaagcatctggcaagtgaaaggtggctgatagtacaaatggttgagctggaattcagacccctgtacagtgaaataaagaaagacagagaaagggggtggggtggagagagagagagagagagaaagagagctgcagccacagcattgctttgcttctagaaacaatgggcagttagagaacaatggctacagacaaagtcttggtctatttatatctgccactgttagtcccagacaggaggaactggaagtctgccctgtatgcacagctccaactggacccaagttgggaggaagatgaggtcaccaagaaggctgcctgcttagaaatgggcttcttttttcttcgtatagttgcttcttagcctagaggttctcttaagcttgcttgccttctgctaaaatacagccactgctgagaagggagagatgagaaaagtaactgctgctctgcccagcccaaagcaattaaggcctctctgtacagaggttgcaggaaggtgggaacgccaaggaaaaaataaccaatcgatggaggtcaactctatggtttctgaaacaacagtcttattaggtctgttaattatacatgtttaggagcactataaaggagcttttccctgggaaagttccctcctcatttctttggagacaaataaagaggccaagagctgaaattcacagatatgtatgcattacatctcagggacaatctcttcttccctttatttcagcccctttttgatggtatctctattttctggaatttcatcttttgctctaacatggctttggagagatactcaattttaatccttcccaaactgtgttacttgtatccttaatcctcctacagccttactaaaaagagccaccagtagattagcctgtgacagacaccaaactgaacatgaggagagcctgggctggggaggaaggaacagggagggaggcacaggccgtgagcccctgcaggcatctcctcctgcatgccttcattgtgagtttccaccgacagcccttagcattaatgcgcaaccaacagtaagcaactgcaccctctggatccagtccaaccttatagccttaagaatcccacgtgcaaagctggaatctcccagaggcaagaaattcagggctcaacaaagagatcccctgagcagtaacttcagatttccactcatgcctcaagttcctgtcactaacttcccaccttgttcctggaaaaccaacatgtaaggagatatacaaatctaaataagattttttttctctttttcctttaaatagcttaaaatattttacagacaacatcccagataatgtcaacccattgggagggaactagtagcaaacagttaaatgttttataacttaaaattttaagcacagagcaggcacatgctggatactgctagggccaacgaaccctaggagccaagaaatggttaaaagggatgcatcacgttccttccccagccccacatgctcttcatcaacttcataagtgtgtcaagatgctcagggtccagaccatctggagggtgcgctcataaacttgaactaccaggacaacagataatgtgcacaagcccataacaagcaaacatactagtacatctttcatgctatgcaaatggtggagactgaaattcagatgaaacattggaccacctaaaatagaccaaactgtgaagatctaagtgagtgatctataggtcacctgacctggtacggtacttcattcaaacactgcttccttgactcctcccctatcccctgctcccaacagactaattattcccttctctaagggccctgctgaatcatcccagtgtaattcacaagagccacatgggaaccacatggtaggagtcaggagaaggcagagagacacacattcttaccctaaagcaaggctgacatcagagaagatgcagaaatccccaccctgagcatgttggtaagcacatgagatggccgtccctctgcctatcacaggctccaaaaaataccagcacgccagctaaacacaccaaaaaccgatggtgccgccccaacatggcacatctaatggaattcaggccccacacagtgcagtaaatctaaatatatgtccctaatgaggagtcagaaatcctgagacttcggggatttaggcaataattgtggggacccagctcaagtttcctgcactaaaaaggaggggcctagagagataagctttgaagggagcatgcttatgctccctaaaccattacgctcactgctaaacctatcatacgagcctactccaaggtttgtgtagacctacctaatctataattttggcctctatatctctttggctttggccttttttatggcctggagcaataactatcagcccgagtcctctcctggtgtgttcacacatttccctgcctctgtccctctatcccgccctcactatagctataggatgcataaagccttatccaggaccaaaaagcagaaaagaggaatttacagaatttgctataaaactttaacaactccttggagggatgttctctttccttgcaaccagacatagttataaaatggatgaaaagtggagagaaggaggagccaagctctgccactggtcaggggtcttacactattcctggaatacagaattagaagacgctttcgatgtcatctagttcaaaccttttcttttactggtgggtaaaatgaagctcaaggtgacatcaacttgccttaagtcactggttactaattctagaactctggctccctctcaggatttttttttcctctacatcattgctgtttacttacaacagtggactgggagggagaggctttctcctatatcttcactactatcaagtcctggttcatcattctggataaacactactcctccccaagttattaagaatcacagaggaatgagccatccaaagatctaataaatatgatgggattttacagattcatgatgctatccactcctatttcaggttataagtctggaataccaatggtcagactctaaggtggaaaagcttcctcctagcaaagatccttgttgcataccagggatattaagcaactttcaacagtcaactccgatagcatgataccatggtgtctgatggctctgaaatttgagggtgctattcctgtcaatccagaaagagtgaagactgcagttaacttcagtgatctatgaacctttatctaaaaagcactgaaaggcagagtgcctcatatcatttaaaggttttacaccactacccttctagtcctgctggtattccaaatagggtcactgagccatggtgatagggttgagggaatacaacaaaccccactgacaaagccagaacttaatatcaggggcactggccagtaagttgaatctgatctatctaattaatgaagctatctgttgacccccagaaaggccatggcctgaagtaacacaagcagctctagttgtgaaggcaaatgcagtcggaatgcagagacctaagggttccaggaaagatccacctcattgtgatctcttctagaccccacagatttttttcttctccttcccaatgggcttctctttaatggccccaaacacccaatcttcagcattctattgttcctgctgctgccccagagtctcgcccacacggacccagggcagacagcctcagacgcctctcccagtagcaagcccaagagggtggtaagtcgccaggcagacccaatctccagatcaatgggcgagaccaaccaatgggtggcgagcagacaaaaagtgatcaatgcaaaaggcggagggagcttaagccactctccatctgcctgggtaggtgagaaagggagagactgggatgtgcagccctcatccgctgctaataaatggctctgcctcatcaggaagccattaggaaattgcagccaccacagccccaagctccccggactgaactgtctgcatgcagctggtgaaagcgctcattatctctgtccagacgacactagctcactacacagtggagcctaaccaatgagccctcagaataaaccctgggcttgagtggtgaggaaggagggactgaaaaagtcccttgagattggggagatgcagcgctcccccaggtgtgtgctccaagctccagatcaggaatacgagcccttctcctcacatcccagctggacagcattctttttttcagaaagagctactgactgctcatgagcatggggcttcttttgggagtgatgaaaacattctggaattagacgttgatgatgatggcacaactctgtgaatgtactggaatgcactgacatgtacactttaagatggtaaattttatgttatatcaattatatctcaatttaaaaaaaagtaaatgttagagagagaaagagctactggcccactgctatgagcccaacaatgaataccttggtgatagatccctcaggcagagtttccctctagtgggagaagcaaacaccgcctaagtacagaagcaatagctatatgctcacaacagacgatgagtgctgggatcacggctgaagcggaaggttttgcaatgcagagtgagtgaactagcggggtccagaagcactaggggagggggtaggaaggagtgcacgtaagatgtcctgggtgtagggcgtgagggacagaaggcgggcaaggtgtccaggatggcgcccctggcagttggtggcattactgaaagggaagacgagaggatgagatctcccacagccacctccgccacctggaaatccttgtgagatggaagccccgcgatgctcactgggagaccgaccgtgggagaggctgggcacgggccatttccagaggcagacacctggtaactgcaatttctgggaccacttatgtgaggactaaagaggaagggccacaggttctaggagacgaacaaaatccctcaagttccctaccctaaagatgctcccagaaaaggctgccgagtgctcttttaaagtgatatgtgcatctttatacttacatacaaaagattctcaaggggaagaagtctccatcagacagggctctttcgccctccagtccctggtgggggagacagaggaaaagctgatagggcggtggggtgtgggggcggtgaaggctcactgcacaggaactgaggaaggtgcagtcacaacactgtgatgccagggatctttttgggaaattcttttccaaaagggatcatgaattttggcccctggaatgccccagagcacctctgattggttccctggccctgactcagatcgagccgggctccaccctccatgagtaaataaaggcagggacggagggagggagagggaaggagagggagcggagtgggcagacaggaaccagaaggccagcgctggttcagggaacacaccagatgagatttcagcgacgggtggtgtggcagaattcaagacataattctctgagccttacacaccactccagttgggattcagccctgccttggcagccggctcagtgctgctttataatatactgaattagtcactggattagcaagcacatttacacacagtggcgcacagctgtttaaagacgcaggatccccttttctaggtgccagattctggctataaatcaaccattgcaatcagcaaccagcaaaccccagaggtgcatggttcctgcagacatcttccttaggggaagcctgctagaactgcgatggccattttctggggacaggagggacatctgtggcaaagaaggaaaggtcggtgggctttttctgtcttgaatcttattatcttcagggggctgccaggtcttcactgacctggaccttcccggcagcagcctagctcaggaaatgacgcctgggagaacaggagttctaatcctgcctggctgtattatcaagtacagagtttttctcctaaaccttgaatggctgggtcacctcccagaaaagaaaagactccagggcaaagaggacagtacttcagcaattaaaataattttaaatcctgataacatcaattccaaaaaactgccttgttgaagtggcaagggcaatgtctaaaaataatgctttagagttggaatcataactcaagccctaactcacgttcggtaagaatgcgtgagaggcatttgaaaataattgaactggccacagggacggctctggcccacttggttatggaggtgtcaagtggaaaattttctgtaaccaggttaatagtaaccacagttttaacaaccgctgaagtaataacagcgacagcagcaatgaacttttgtacagaatttagtgacctacaagataatggtttattgagctcctgtggcaatgaaaaagtataaaagttttcacaggaattatctctaatcctaacagccctgaaagctctttattattacctcctttgtaaggatcagaaaagaaaggtttacagaagttaaataatttgtctaaggaaaaattagtaaagatcaagcctgaattcaaacccagggctgtcttacctcaaaactctgctctttcaagacatggtgctgcctccagtgaggaatatcattataaccaacataatgaaagggacgctgtgtgattcagggactcaattacttactatcaagcaccctaaatgtaaatccctctcctttgtcttagagggcttaggtacccaaagagaaatagggtttatctaaactctgtatcgtaagatcatggtaaaaagcctgtggcataaataaatccacctgacaaatataagaaccaagaaccaattactaaataaggcgaatttcatttaggctcctctagaacaggaatttagagaagattcgtaaagagatttgtgactagctcgtgtaggcagagcctagtgtgtattctgcaccagcttttggaaattcaagtattacttccttagaacttgtttgcccataaaaacactgaaaatattttcttacgaaccaaggcagtcgggggcaactgaagacttgcatcatctttgctcatcactctctgcctgcaccatgccactaggcagatattttgatcaaagccaggagaaaccagcggcaagtcacccagggcccaatctcattaaaaaaactaaatcgctgttcggttcacccagcaccccagatcctttggagactttgcagtcagcctgaaatttcaaagttctttcatcagatcatccattacagaagaggatgggtggaaggcatggaaaagccacaaagctccctgcaagagagaccttcagaaatccagaaatagattctttatttttaaaaatctccaattgaatcagaggttaacattatgtccaccgtggagatgctgattcattctgtgtgtgtgtttacttttctacaaatgtccctcttgcatcaagtagcttcaagccctaggcttgtgcctctgaacatcccctccctggagaactctcaagctggggtggagctctcacttcattcctcaattgtctaatctggagagtgggggccaaagcaccaattctgtacacaagtttagtaaatttggctagccacctttcatgtgtctactttggatttgaaaatgcaccatggaaatcaggtgaaaattttttttttttttttttttttttttactttcccactactaacacatcccaatggtagatatgtataagtgaaatgagtgcgttcttcctgcccctataatgacaagcctgacagagaacacatcacacagaagaatgtgccaagaatcaagacctcttagaagaatgttagaaagttttctctccaaatggattctgtctaagtaggaaggccttggcaactagaaaggtctaagatcaaatttatgacttgaaaactctatggctttgggcaaattatctgaacttaattctggactcaatttcttatctacaaaatgggaattaaggcatcaacctcaaagggttgtttaaagaatgtgattatgtatttctgtaaagcacattgcaaagtatctgacacatagtaggtactctctgtaaatattagcttcacttctctcactcctccaactgaactgcagttatgtaaagaaaagcaagcatccagcagttttgaagaatgtttggtttccattaggaggcaagggaggtgtaagattgaactcttgatcttatatgaaataaggatgcatttcctgtacacatacacatgactcacccttggggagctcatatgtatttagcatccccactccgtatcatatctcccactaatttaataacactccttgaatcaccaaagactccagagtactttctaaatgtgaactcattaactttcccactctctctcaaagaaaggcagctcactcactaggagcatccttcttggagaagaatacaaagataatgcagacatgtgtccatatctggtggcttaaggtaaagccagacttgggtatcctgattctcacatcaggcaacagaaggtaataagatgaccacctatgccaccctgcccagttaacagcagagaaaatattcaaaccgggcaaagctaagaccaaggaccccttaggcctgacccaaaactattggtacatggagggcaccaagccatagtgctgaaccccaattggaggaggagacacacttcgtgacctcactaggatttgctttacaagataagattttcctggcaagcattgaagttagtgcccagattcaaaacagcaaacttaaaactattatcttcatgcttgctataatcaggtgtaccgcccaacttcccatccctacctccccttccctagtaatccagaggtactcaaggtcactactggctacttaaggtttacatccactcccaaggaaacaccagcaaccaaaagaatacttcccagatggaaaacccgtcatttgaccttggaatgctctgcctcccataatgaccaaaataaggtccggccagaggggcttacgttttttggtaaggaacaacacattgttttagagagataatctgacataactctgctaagctctgagtgtctatgcatggtaccacagcaaacaccctatgtcccaaatggaaactagcagggtgaaaaaattgttcatctaagatgacattaatctctgtatgcctccttggtacagttcttttccacaacatgcagcttaagattcaacaattttttcattgtgttttgtgtttcctgaagcattcctccagctacctgaagctctcactgattaaaatagacctcctttactaaaaggggtaaactgaggcacagaagaacaaagcaatgtgccttatagttcagaataggtaaacaaaaattggacatctattattttcaaatctctttagattaaaagaaaaaaaaatgtatttctcaaagtccaaagtcaaccttctccaaagggaaactgcatgtctgtctagtaacctataggatcattcacacttttttttccttgagaaggaactaacttgccagcctaccaacaattttgccagtgccttggcatcaggcatatctgcacaacctttccagagcctatatcatagtgatctgttcaagctgctcaaagctcagtaatcatactaatctgtgcatagtgaccagtgctacctgctcaaagctcagtaatcagccagctatgtgggacttgttatagatgcataaaatatgtgggtgaaatctacctccaccaaaagagaaaagaatgccttgttgacactttgatctcaagctaacgtttattaataacatcattattatatttaagtgaatgtactagatactcatcgaatcaaagaaatgtttaaaatccatgtggctgaactcaaatgtcaggggatttggagaaactgactggagcttcatgttctaactctccgcttatttgccctggaaccttgggagggtaacttggcatcggtgcactgcactttccttatttgtaaaatattggtaactctaaggattaccatgagctcaaatgtggtgaagtcacatggcaaactgtaaaatgctaccagatatagccaagtattaagatgaactagcaaacaatatgcacaaacggaccttagtatttcccccaaattccacaaacacccaaatatttctgagaattctgaaaacaacagacatggaattttcaagttagctacagctgggtttgaatctgaactcctccactcagcagctttgcaaccttgggcaagtcgtttaatctcagtttcttcatctatgaaatggcaataataatgcttcactattggggcgaaataatgaggatactggcacaaagtttgcgcccaataactatcagaaaataaacagaacatgaggaaaaaagaaaagatggatggagatgagaagtgcttacacaagcaccagtagataaactctacactgtcatcaatgatcgttttccttgtttttcccccaaaaactggcatgctgaacttaggtccctgctttggaaagagaagggtaactgcgacagacctttctcaaaatgcagaaataacatcaatcagatgagacttcagataacccccatgtgcgggcaccgctcttccaccgccgccacagcccagtacatttgtagcttccggggtggctggggaagccaaggcaggtggtttcttgtccggctccaactctgctaagcagcgtgtgtccagtgaaggatcagccggtggccacctagacaccattctgtgggcacccaaagcacgcaggcctggcctttccctctgtgcaaacagcaggccagggccctgacttactgggcctgtcaggaagaggcactgccgtggctaacagcagattgcattctcaaggcaggagggactgtttctgaccagagcagcctatcaagaagaggcagattggatgaaataagctcatcactcagcccacagactcggcctgcggaagcagctggactagctgcttcacctactgaatgcttgacttacatctccctcctccaggtgagaacctgcactggagctgccttccgctgcaactgcagcaacggctcatggaaaagggaagctgaaaggaagaccatgaggaaggtatgactcttggttcagtgctacccaagacaacatgcctccatttccccaatggtgagctaggctggcaacaatttctaacatctctgtttctctgtggaagtagccctttaccaaagcacccaaaattcctcaatgattaagttgttattaacagaatttggggattaggatgcaaatccccatgttgcctacctcttgaatggcagtctacactctctccaagccttggctgttttaaatgttacctaaagtcataagatgtcactgttaggagaaatctgacaggtcgtcattccaatgaatttatttgactgatgaagaaaatgaggtgcataaaaatgcaatgacttgcctaaggtcacacagacagatactgatgcagagctgtggctggagaccaacactcccgactctccagcccacattctcctcacagagtggatgctgtttatttcatacacaatatttattcctactggtaaggaacaaatacggtaaggtcttccttatcatctgtgattcttcattgcattctgtgcatttatttcgtgtcttaatgatgtgagacaactgatgcataaggtatggaattaacttaaatttttggcaaaagatatcaaataggagaaatgtgtaggtactagaagtacaaaagtcggttacatggaaactctttcactgaaaatttcctgtgataaatttcttaaagggtatttcaaaatcagacttgggcaggggcagtggctcatgcccgtaatcccaacattttaggaggccaaggtggaaagattgtttgaagccaagagtttaagaccagcctgggcaacatagcgagacctcatttctacaaaaaagaaaaagaaaatcagactcaacaacacatttttattctgaacatgaatgatactaatgcatcacacaactctaaacgcatcacacaactctaattgcacacaaaaaaagtaattaattgagaacaggtataacacctggcacatagtgggagaccctagatacttcaaaaaacccgtatctacaaacactcaccaggcttagcagattcctgtgcctgaccgaggttattttccatttgtaccttgaaaatatgtacctgattgattttgtcatcttctctgaggtttaacgcttattctgataaactgatacagaggttttaacaacagtatgagtaggaggaaaagtaaccaaaaaaaaaaagttacctatctcataagcttactcaataactctgctctacccttaaatattcctactttcaaaggcaaaattcatcctgaggttcaaaacgctctttgggtcctggcctcctacttccttccttcatccctttctacaagtaagttttttttccttcatgtttatctaagcatctctttcattccaaacttgcagcattcttcccacgctgctctctatatggaaaataatcctttccctgttcttacacctccttcaaatgcttcagaagtgcccctgtttcccatgaagctgacctatgaaactaacttaacactgttgcaagagagagcttcacagacacagaaaataccaacagtcattgatccacacatattttcataaatgtaaacactggtcctcctgcattttttgccatggaagcacctggaacccagggaagacttcatctgagttgtcctgaccacccatctacccatgagggatttaaagtattcagaaatgaccacaggcaaggagtagaaacaacagacccaaaactgcccatggggccacctgagcctggaattcctaaccaggtgtaatgcttggcccagatgaaagcttttccaagaatctatgtaatatcacttaaattcgttcatctttagttttacaatttcctttcattcattctttcatactttcttactcttcctgtcctcattcttattcttgtctttttttaattcaaaaagaattttgcaattgaatccaccattcctttcctccccttctaaagaattgagggcttgttttttatttttgcttttgtttttgcccactttaatggtacaaaaagaaaacacaacattttttttgccccttttcagcccaaagtaaaatttcttatcttcgataaacatttaaacaaaacaaaacaaaaattgcaattgtcttcacttgtgtaatgaagacacgtccctctacttcaaagttcattttatctctctgtcacacacacacacacacacacgcgcgcgtgcacactacatgcagagtttacagtttctccacagaaccttgcaaagcaaaaataaatggcttatcacagctacccaaagctaccaagaggtttcaaatgcttgaagtgaacttgtctgaggttgatttgggtttctcagacactgagaaacaaatttaaaatataatccatgtttgggggaaaaccatactaaacttaaagggcttcaaactcttaatcgtgccttattagcttacttagatggtctaaaccctgaaattggcaattgagagaagatattctagaaagtacgattgaccaaatttagtgtctaactcgggtggccctcatctgtggggagagccccagttaatgtctgtcattctgatgcaattattaatagtgcccctttacactctcaaaggtatcccagtttgggtggtaaattatacgattttctatctctacaccattatgatctgaagtccaacagccttaaaatttctaatattactttgggtctaaaagcactatctgggtcaatattccacaactcttagagacagtactaaatgctacaagaaagaacaattgagaaaagtggaaggggcagtaataagccacatttgaagtgtcaagtgacaggcttgcacccaagcagtagacactggaaagcacctgggaaatatgacagcgttggccaagtgatcaataaaatatttacggcttgaatagcaatattttgagcgtgtctgttaagcatggctctctgccaatgaaaccagacctaccacaatccaccctgcagacctatgtctttctgtatctgcatggagattatacattatacaatcagaaggaaaagggggtgcagataggcgaaggcttcagaaaagcagccaagtagaaatagcctgtttatgcaatttggaaaacatccactgaagttttgaaaaagatatcatcaacccgacagaaaaaataaagcagaaagtagctagagacacatgacaagtaaaaatgatagatttgggaatagccttgacattcctaaccctgagttaagaacagcttaacagctgtgagcgaagggtagacctagaatactgcaaacatagaggcaaatgctatcagaggttccttgtgagcaggaaaatggagccaaggttttcattaaggagcagctaaataaaaacacggagatgatgttgttcatatacaaattcctctctgcggtgacagtgtgggcccaagcatactaactcttcgggaaaatgctccccataatgcagtaataaagaaaccaatgccttaaccttaaacaagtggcaggggagtgtgcctgtgtgtgagccatgggctgggacagctggcaggtctgcaggtagacacctggggctgtcttgtgccaggacaactccagaccatgtgccctgacacatggaatggacttttttaaaaaaaactaaattttaggggaaaaaacgaaatttatatgaggcataggcagcaaatgcaactcaactatctatggcctctctgcaagcaggataattaaattttaactgccttaagaaaatgaactagtttgccaagctatgtctcatcatcctgattatgagagattcaatgcacagcaacatcagtgatgaaggggaagaaatgggcagaatctggaggctcagcgaaggactgaccttggaggtgaacataatcaccttcctacctgtgagagagccaaggccatatggaagacgttgcaaaaacaagaatcctggttctctgcctttcattctgaggtaagcattgctggaactttcaaacatctttctaaagcaacacatctggactgccaggcctggggacaacccacaggatggaccctttccccaagccgtatgaagcactgagctaacaatgaggccacctgattcagctcagggggctcttgcagagatagcagggagccactgtacctcctgaacccccaaagcaccgaccagcattgccttctcacctgcctgtgttctaatttccagagtttttgagaataactcaaaattttaggtataaaatgcctacaacatctcatcagtttctaaatttctagagtgtggccttaggccaagtatgcatctctcagaaactcattttcctcatctgaaaaatggagaaaataatacttccaccacacctcagagtaagtgtgaagcataaaagtgctcttttatctggctgtgcccagcacacaatgcaggctcgatgtgtgcttcagaaatatcccaacaacttttgaatgacaagaacctaccaccttcaatgcaagctcatggaattccaccacagccatggattattcattacacaaaccagagagacatctgtaattacactgtcactgtaaccattgcagagttatctgctgtattctgaaacagggagactctcctgaaaaatcctgacctacactaaccagctctcagtttgcagagatttgatggagcccagagagacctgggctccgggaggttgaccacgagctggtttgtctcctggagggaggcgatgctcctacagggtggtctggcctctttaagagaaaaaaaaagttacacagacaaaaaaacagcaacacaaaccaaccaaaaatgccaggaatgcaagctctgccaaccaaataaataaataaaataggagatgctttataataactggacatgatgcatttctcagccctgcataattgaaaacttgacttttccatcaaccctgcaaatgttccccttgcctctagacttggtagccttcctgctctgaggtaacaatgacaatctccatcacccaaagtaactggcaaccccctccctgtgcctccaacagtgagagctggacttcaagacactctctgaaagttacctctcactatttgctccctggagaacagaatgaagtttcacgggcatgggatctcagctaagcaggtgaaaaggtcctccttaactttactcttctttccctctaaaataatagattatcaggaggtacataacacagccaccttatcttctaacaaacattcaagggcctctgaaaattctacactgatcaggatcattttttgttgacttgctctgtagttaactgctaaatagtatttattatggatcaggcactgttttaagattttgcacatattcatagatttaatcctgatattcatcctatgaagtagaatgattgtactcattttatagatgcagaagctggagcacagagagattaagtcatttgtccaaagtcacacagctgctaagtggccgagctgagattcaaatccagacaggctggctccagagtctctgctctgaaccatagagctctttagtctctaatggagtatggtcggcggggatctgggagcacagtgagcaagtgatctaatagactgggcagctctgcccttctttcttgtctacactgatgaagaaacaaagactgaccaagctgagcaaggacaaagcttcttcctatctctaagtataacgcatgttcccgatggatgtacaccctctgctgagggcgggtggggtgagaggctgatccttttattcttatagaacagcaagtatccaggattagagctcctgctcttatctggacattaagctcacctcaccaagaaggtagagcagagtgttgaaggaaaggaaaaattaagtggcttgggaatgtgttggctttggcacctggccccttcacagcaggctccaccaggagagaaccaggagtgaacccaatggctatatttgtttttaagctatttaagatccttgcaatcacactgttgcaatcaaatagcatatcccaccttactcttacacttgcaaggaaaagtcaattctactgttatttcagagtatatgttaatttagcacttaacgctgtcaaactcctgtgaagtctcaaaatagaataaaagtgcataaaggttcttggtcaggtcctagccaggaaaacaaataatccaggtcttgcggctcctgtttggacaccccactttcttactgcctctctttggcactcatgaatttgggagggggtggggagaaaattctggtttaatcatttaagccagataagatcccacactagctgtctccacacataagaaactaagcaacccaaagaaatcattctgacaaatatttaagtcacagctgtggataaaaagctacgctgtgagaagttaaactttaaacacatgtcctatatggtctgatgggcaaggcaaatccgcacttagccaatgtcttgtccttccactaacaaaagcagacagccctggccagaaacaccgtttctcccatccttgctttgcacctgcaagttaagtctcagctgaggtttctttgctgagcttttggaaggtatcttgcaacattactcaaagcaatatacattgcgaagttagaaacaggaattgattgtacttcagccactggctcactacatatttttatgtcaattatttacctttcctgtgactctattttcctctctgaggtatgggcataatgttcgcatataagcaactaaaggtccagaaaaaaaaaagttgattatagtctatatattttttcaagtttttgtctttattttttccaagataataaataatggtgctagaaatcaaacctctttacaatgaatggcagaagactgcccaatttctttggccagttgaaattttgttgtatcgaagttcacatacaaaagatgaccaatggcttggaaatcttttttgaaaaagaaagccattgcaaatatgcttattataatggacgctgactgtagcgttaggccttattgttcccattttacagaatagaaagctaaagaaagttacttgcccagagcttatttttaatcagtaactgaaatgacggcaccatatacattgtctctaatatttaatattaaattaccaaaaaaattgcctcagctgttcactgtgatctgaaacatgtgttgccagggctctttttcattcccaggatgaaagatcccttgtaggtatgtggactgacatatcgacacgatatttcccagatgaccaaatctgtctcttcccccataaacacccataacaacacatataaacaagctgttcttaaggaaaggacctattagttgagtttatatctttgatgtgaactatcttttcacttctatatatggtttcaatcaactgacaaacagaactcattctagcttcctcgaacccccaaacacaaccatcatagaaacagcatttctgaattgtaggcctaagtgccttaaatgtctccatggttccagctgcgctctcagcattgctcccaccaccatcatccttgcgaggagacaaaatctcagccttctgtgcacagcagccctggagctgaatgtcaggggacccagagggaggggacgtgacctacatgtctttattaatatttctgaaggacctcagaatgacaaaacatcagtatggttgtgctgaaagtttaagcagcgtaagaaagggttaaagtaagcaataaattatggcagaggcaaagaagtgttaaccacagggggcagcaactaaacttattgataatcagatacaacagaggagcctgttcttgaaattaattattttccagggtgcactgccttctccctagatctttctatatactttcacctccaaaatcactcatctctaaggatagctggcagtgccttatcctaaaagaaagcatctttccctctcaaactacatttgtttcagaaattctgtaaggccagactctcttaagttgcttagcaccaatatttgtgtcaaagacaaaaaaaaaaaaaattacttcctatccttctcttcttcaaatgcatataaatgaaagagttggacaacaccatgtaccaaagacacaaagtcacatttgggtgtttgatgctttccttccaacggacctttggtaccagaagaaaaatttatggcagattagaaacatgggtaaagtaagtaacctacatgaatagggtcggacgtttctcaaagttaagaggataatttcaattctcctccgatctccttaccctcaacccagaaaagaggggcaaggcatgtgacagggacgcttggggaggcaagaccttatttgaaaatctgcctgaaggccaacccgttagactgcccggggccctccacccagcctcagttctatgggggacgtggagtcaggcgatgatgtcctctgaggcagcgtccatctccccttaacattaaggaataaggccagagggttctcgctcatttgggaaaataaaaaaagcaggaatggggcgctggaaattctataagcttttccccaccactcacaaaaacacagctgtgaaaataaataccaccccccaaaccaagggtctagggccaccaacagtcctcctcctcctcctcctcctccttctcctcctcgtcctccagatccagctgccaacagcatcccccgctcctgaagaaatgcaccgcccagaagggaacggcgaaagggggaagaagtccaggggacccccggcctctggccgagagcttgggtgggggcctcggccgtcgccactcacccggggaggggaaaagctccagatcgactttttccgtcttgatgatggtgagagtcggcttgagatcgacggccgccttcatggtgccaggagtgggggacgtacgggatggtagcaagtttgcagttactgttgtttttctttttaatgaggattagtaacagggggaaggggacgggggaaatccgactttcttcccaaaaatctcaaattcccgctgcctttctttcccccgcgcccggacggtgcgcgcccggcactccaggggaagttggcactttgcggcgaagtgagcgcgctcgggtcccagcctcgcccgcgccgcgcccgctcctcctgcccggccctcgcccgctccctcctctccgccggcggctgcctcgttcgctctcgatctc

SEQ ID NO: 1615 - DNA, 63551 bp, Homo sapiens; identical to SEQ ID NO: 1614

SEQ ID NO: 1616 - DNA, 67515 bp, Homo sapiens
taaagtctttgcagcctcgctacggggcggagtcttgcctgtcagcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcggtaagtgtttggaaagaacggcagagggttttaaaaaaaatagttttcaggagcttgcgtgaacgggaaaggaaatgaaaatgcttttgtattgttaattacaagccaggagtggtaggtagacaagttttcttaaatgaccaagggatgctcaatgaaatttgcacagccagtggtttttgttggtgttttttgtttgtttgtttctttgattgcaaaagtggccaattcaggaagtgtgtttgactacatcttaaaattcagtctggcaaacgtactgatgtgggagtcagtattcctcatacgttcgttacatgtttgattgtggtggaattaatcttagttttattcccaatccagttgtggaaatagtacgttgtgtcggttgaagagcttatagatttgaatttagcataaaggttgtaaaaatttgcgggtttgcatgttttaatcttcattcaaaaaggatgctccgtgatgtattccttaatactttacattgattgaaacgccgtgtaacagttatgtaaatatcaccttttaacggtgtgatttttatgggaaggcttgacattctcattttcttgtttcttattactcaccacaaagagtactgatctgggaacttcaatttttctgtatcagaagtaggaagttagcttgaaaacactagcttgccatcagcaactgctctaaaatacgttttttttctctaacagatgaaattaaggggaatgatagtactgtaggcatgaacacgtttgaaatggggaaagaaataaaatgcaaaaaataaaataagagaaagtactggaaggagaaagactataattttctacattactgcttttcagtcccttttacaatgttgtcacaatgctaaatcacggataatcttactgtgacgtgtaagagcaacaaacttgaaagtaaaagaataactagctcaaaaaccatgcaattatagtcacatccagttgtaaggaaaaaagatgttatagaaatgtgtaggtaaggatattttaaataactaaattttaaaaagcaagatagctatttcagggatgaaaaaatggagtgattttatctcaagtgtgaaataaggcagtagtgcattactactctaaatgttgatcactttaatttttagaattgaatatgtaaatgaaaaactggtgccctacaagaaaagttgaggggattaatactttgtaaaatgtattttgtcgtaatatctattcattcattaaaaccatatttataatacaaaaggcaatgtctgtatgccaaaataaaacccaatctgtatatttgaaagtatattgtgttagaaatataccaccaaagtatagtaaaatgttagtgataaaatctaggaagtgggcatattgatgttcactgtaaaatttattcagttttgctatatgtttcaaattgttaataataaaatattagggagaagtgaaagacctctttcaccttccctagtgccttcacctttcttctaaaaatctcaaattgtcagcagtttgttgtgtatttttttaaaaaaaaggaattaatgtcgcattgtgtgatttgctatttccactgaacacatctcaggcatctttcatgtacatctgtacatacaatattccatagcatgggtgtgccataatttctataatcatgcccatgtgaataggtaatttgtagttttaggcacttattagtgttttagtattacatacaatgataagcatcattagaatgtacacatatttttgtttactatgttcaagcattgctgttgaacggcttcctctggcgaaattgctggcttaaaaggtatttaatttttttaattttgtggatatagacagatcatcttctgaaaaggttgtactaatttacatttaccaacatacatatgagaatgcccatttccccatatcttactatttttaaatacatcttttgacatttttctaattaatttataggattcctttgctaatgggtattaaaattttgtctgctatatactgcaaattattttctttcattctgttctttttctcttaactttgtttatggcacacgtttgtgcttttgaaacttttcattaaagtttaccttgtacacagtaaaaaaaaaaggttttaaaaatacagcttgataaattttcacgtacatatacctgtgtaaccatcacccccctccctttaagatatagaacatttctgtatcttgttaccccaaaagtctccctcatgcctcctcctggtcagtaccctatctgaagggtaacacatattgtaacctcaaatatagcttttaaaaatagaagttagcctgtgccacaccctcctgcctaaatctctcaggtggctcccattgcatttaggcagcaacccaaactctaccggggtctggaaggcaggccgtactgcggaggatggcgaactttcagtaaagagccaaacagtaaatctttttgtctttccagacatgatctctgtcacaaccattcacttttgccattgtatatggaaagcagccacaagcggtatgtaaatgaatgggtctggccgtgttgcaatagaacttcatttacaaaaacaagcaacaggcaagatttggcttgtgggctgtataatttgctgacccctgccctacagaatcccttactcacctctcgaatctctaacccccctcctccaccattttgttctagcaaccagccttctttttgatcctcaaacctccagtctttttcctgcacttgctttttcctctttctggaaagtttcttcccatcttccagtttcagctcaaataaaaacattttaaaagtgccttttaaataaatatttcctcccccatttattcttattataccaccttgcaaatgatcttcatagaatcatagcattctgaaattattttctttagctgtttttctttcctctcttacatttttataagatccacaactctttttttttttcatttctgtgggccatatcttacagctagaacaatgactggcacatagtaggcattcagtatttgttgaataaaagaatgaatgaaataaattgatgtttttactaatgttgagccacttttgaattcccacttggtcacgattatttttacatctgtctaagtgaatttggtctacagatttggtttttatttttgttttttgcagggagagtactttttcaatgcaatttttatatggcgttaatattagcctagtggaatgagttggaaagcttgcccgtctttctgtacttacagaaattatatgttccttaaagacttagtaaaattcctctctaaaactatctgaacctgttgtcttgggcctggattgggggttgtggggggatgcctctttttcaatttcttttagaaaaagtgattaaaccaataatgctttttcaagagcccatttctgagagttggtaattcactaggaaaactcatttcacctagatctcaaagttgtacgtagtaatctatgttttttgacctatcttgtcaatcatgactcttttcacaatcctcatgtttgtgtgttcaccttttcttatggtgagccttgccagaagtttattagtcttattgttggtgttttttaagacacttggttttactaataacaaaatctataatgaggagatgttttctacttaatttctgctattatctttaatttcttttacgtacttcctttgttcatatttttcttgtactactttcttgagttaaatgcttggttcatatatttccttgtttatttcttccaaaagcatttaaaattctgaaatttcccatggatattgcttaggctgcatcccccaggtttggaagtatagagattttattgttactcgttatttatattttcttattttatcttgttttattttgtatttatgcattattgaattattgtaatcacttttgaaataattacactccaacccaatggtttttctttagtgttttccatctttcaaatccattaaaaaaatgacaaagctgatttaaacaaccatgtcggaaactagatgttgtgataacttaatgtgcatcaattcattttgattatatactttcattaccgtcctgtattctatttagccttttggagtctaaatttcactgatattttcacttttgggggtcttctctgccatttcaagtgataattttacagagatggtaatatctttaaacccctctcttttattttcttggcttgcaattggcatttctttgttttttttgtgtgtgtgggttttttttttttttttttttttttgacagagtctcattctgtttcccaggctggatcactggcgtgatctcggctcactgcaaccttcgcctcccgggttctccagcagcgattctcctgcttcagccacctgagtagctgggactacaggcacaccaccacacctggctaacttttgtattttcaatagagacggggtttcaccatgttggccaggctggtctcaaactcctgacctcaggtgatccacccacctcagcttcccaaagtgctgggattacagccgtgagccactgtgcccggctcttttttgcttctttaatctctgaaagttcagaaaaagcttatttattaggtttaaagtttattattataccaggtttttaaaaatgtaattcacatattccagatccttatttttaatctactttatttgcccatttctcagaggaatattggcttctctctatgatgatagttgcatttatttctccttatatttctaaaaggttttgctttagatgttactataacgtgtgcaatttcataactgattaatgtattattgttgagttttacactttatcaatatggaatttgcctctttgtaccttttgccttgaattctattttccctaatagtaatgtttgccacttccacagtctttttggtagcatattaggacaatgatactcaaatgtgagtaggcatgcatatcacctcaagagtgccagtcagaaaaataacttaagtgcttccttactctaagaattcacaaataatatcaagaaacactgcaaaaaaatggatggggcaaaaatgagcaatgggaattggagacaaataagcatcccggtgctaacaagttcaaattacacttacaaaaatcagagaaaaaaaatttatgcagaaaaaaagatttggaaaaggttgcaaagataaagaatacaccaaaacttaaagaaattattaaggcagtatgtttcaaatgttgaagcaaaaaagaaatgccaattgcatgccatgaaaataaaagagaggggtttaaagatattaccgtctcagtaaaattctcacttgaaatgtcaaagaagaccccaaaaagctaaacagaatacatgaaagtcatgaaagcatataatcaaaatgaattgatgcacaataagttatcacaacatctagtttccaacatgattgtttaaatcagttttgtcgttttttttaatggatttgaaagacggaaaacagtaaagaaaggccgttaggctggagtgtaattatttaaaaaatgactacagtaattcagtaatgcaaaaatacagaaataaaacaaaatacagattgctgaccaccattcccagtgtatgattcattaggtctggggtagggccctagaatttacatttcgaacatgttcactgatggtaacaatgctattggtacagagaccacactttgagaaccactggcaagccggtcacggtggctcatgcctgtaatcctagcattttgggagaccacggcgagcggattgcttgagttcagagtccatgttgagaccagcctaggtccagaccagcctagaccagccgaggcaacatggcgaaaccccatctttaataaaaataccttagccggggcatgaatttgtgcctgtaatcccggctacttggtgcaggggtggagtcgggggagcctgagtccgggaggttgaggctgcactgagccttgatcatgccactgcactccagcctggaccaaaagagtgagaccttgtctcaaaaaataaaaaaagagaaccactggccttagtgtatgcttgtccatccctttatttccattttgttttagggttgtctcttttaaaaagtatatagctaagactgccttttgatccaaaccaattatttttcttttaagagatcaatttaatttatctaaatttaatgtgaataatggtgtttgtacctgttcttgaaattctactttatgtttaccatatgccaccttattttttttttttacttttgcgggattaaaattttctttttcttctagtagtttggaaatcatacattgtatttgtattctcctagtctcctagttgttactgaatgtttttttaaaaaattttatgggtacatagtaggtgtagatatatatggggtacatgtattaatgttttaacaaaattatttaaacttacatttctgtttccgtctccagaattattcaaaatatataatacacccctactgaataagagaagatatttaggactccacttgatcatggcacagttgtctttgtgcatgcttctaaataagtattgtatttagggtttttgccatcataactgatttttggtttatagttttctttcttgtactatttctgttggaatttttcaggattgttctaagtttataaagcaaagtggtacaatttctatactttattaggctctgggacaatttatagctcagggaaagagctgttctttgaaatttgttagaattttcttataaaacaatgtgaacctgctgccagttttggaagccatcattcataaacttttttcattttcttccacggttaaggacctagtttggttttcttttgcttcttatggcaataatggtaattcatatttttctaagaaattatctatttcactgatcttttcaaatttattgatataaaatcatacataataatcttttaacaatttttatttgtgtgtatatttgtttacattctgagtattacatttttgttttctttttcatgattagacttgccaaagatttacctttttattaatttttccagagaattgaatttatcaattctattttttattgtggtatagtgttttctgattcattatttttagctttaatttttattccttctgcattccttagatttattcttctgctatgatttttacggtatggtccagggacctctagtggtgccccaagacattttcagaggattcatgaggtcaaagctattttcacaatactaaggctttacttaccttttttcactcttatgctctcgcaagtgtacagtgtagttttccaggggctaaatgacgtgtgacataaaagcaaactgagtatcaaagaagatatgaatatccacctgtcatttattaagctagatactaacaagatttgcagaaatgcaaaacaatgccacgcttctcactacattattttttggttttggaaaatatagtcatttttcaaaaaaaatgttatttataattatacatatcagtttattattgctatttttaatgaattgatcatttaaaaaattcttagtctactttatagtacagtaaaaagctcttcaggatgggcacggtggctcacgcttgtaatctcagcactttgggagtctgaggcaggcggatcacttgaggtcaggagttcgagaccagcctggccaacatggtgaaaccccgtctctactaaaaaatacaaaagttagccgggcattgtggtgcatgcttatagtcccagctactcaggaggctgaggcaggagaatcacttaaacccgggaggtggaggttgcagtgacctgagatcacaccacagcactccagcctgagcaacagagtgagactccatcttaacaaaagaaaaaaaaatagctcttcaagatcttcaataatttttaagaatgtatagggatcctgagaccaaaacattttgagaatcactgttctattgcatattgaataaccagtttattttcattatttcttttttgataatgaacacatttattactatgaatttacacaaattcttcattgtctgtaaacagcctctaattcttttttagatttgagagataaaatgtgtattccatgaagtttgtgagttaaaaactctaactgggaaaaatgttaaccagaaagatgtctgattacagctaactctctggacctaattataacagaaacagaggctcttagaactctgcttttacaaaactatgtagctcttgaatttattccagacaataaaggagctctatgtgcctttattgatcaagaatgttccatgtacatcccagacaactcaaagctgatctgagattcgtctgacgttaaaatgaaatcacttaattatatcagatcaaatgttaggacctgtgatcctgggatagtaatctattgggagaatctggaaggaaaattacagagtatcctaatactaaaaattgtgtgtgttttatagtatagacataattatataataccacttaatcccttattaaaaagaaattacaagtgtgatttttgtgtcaaaaatgttgactaggtaaaaaattatttgaacaaagctagaaatgaagggacccttagcaaaagaaatactcgtactaatgcagattcaagtcttaatagttgaaactgtgggctgtgagagagaaaaatgtggagacaattgcaggtggaacctctcttaatccaaggaagaatacatcagtattacaaattaattctttaagttgatgaatagctttttagcagtttttgaacttgccagcaagcttgcagataaaaacatttctaagtaaattatatggcatatgagaagatagtaagtgcaatgtagaaaagtaaagtggaatggaggataagtaaaggggtcagtttttaataggatggttagggataatatcactgagaaggtgatatttgagcaaaacttgaagagaggagggagaaagtcatttggatatataaagggaagacagcaattgcaaaggtcctgatacagggccatgtctgtcatgtttgcgggagatagaatttatacatatgaaactgaggtgaaggcaatacaaaaaatgtgtaataaaacaattctatggtttttttttttttttttttgagacaggctctcaattgctcaggctggaatgcagtggtgtgatcatggttcactgcagcctggctgcagtgagctcagctgcctgggctcaggtgatcctcccacttcagcctcttgagtagctggagctataggcacatgccaccaggcccagctaatttttgtctttttggagagacatgggggttttgccatgttgcccaggctggtctcaaactcctcggcacaagcaagctgatggtcttgccctcctgaagtgctcagattataggcattagccactgcacctggcccatttctataaattaaatatataagtgcttagtaatgggaaaaatattccatgacattgaggttttttttttcacaaaatatcttaagggaggtgagtttaaatccaggttttccaggaagttattaaatggtttggtaagatggagggcattctaggtgggacaatgtgttggttaatataggtgtttacctatgttccaggcacatagtaagccctatatatatttcagctgttaatattagggatcaaatgtagtttatgagaggtaatagacttagctggcaaggtttagctggcaagaaggagtcactttaggtatgatcaagctactatttttaaccattaaaatagatctttgaagttaccattacatgttaaacaggatttctttcctcttttttatattctagataccaaaataatttccctttctcatcttgaaatgacctggactaacagaagaaattttcctgcattgcttgtgaggatcttacataaatcaaaactgcgatactatggaaaacctgataaaaagatgattgaaccatatcaggtacaagtaataagatatcatatgttaatttaaaagttataaattatagcttacacacctcactccatagtatgataacctgttcgtttaaataacatttcataagttcaatgtaataatttttaaatgtacgtaaatgtatattataaagtatttttctgcataatttattgtacaaaaagaaattatttctgtattggtgccctttatttccctgatccaggtggtctccttcccacctttttattttccttcaaccttttcttctcacctatgctttctgtgccaatatataaacatactctagtctcccatttaaaaaaagaaaagaaaagaatctcctttggccttatgactcttctattccctatctttctcttcaggtaagcttcttgaagaagtagtctacactagatgtttttactttcttgcctcccatttctcaacacagttagcttggcttttttccttagcttatcattcactagtaactctaattgtcaaatctgtgtgatacttctctattgtcttgactctctgtgccatataatgctcatgagctctactttcttgatatgtttgtgttctatttttttcttacttaatattatattgtactttcccatgatatcaagaactattttagatgtttcattaaacttttattatgaaagttatacatgcttattgtagggaatttggaaaatgtagaaagctgtttgaagatcttaccactcagagagagccactgttaacatggtgtgttttattccctttcttgtgtgtgtaaatcacatatatacacatatacaagcatatcatatatatatatacatacacatatctatgatatttaatcatatatatcacatatatgtgcatatgtagatgtattatatatttcatgtgagtgtgtatatcatatatcacattacattattttacaaaatgggaaccatattgtgcatacaattttgtgtcgtttaacattttcttaaatattttctcatatcactaaaaattcttcatccataatactttacagttatatatttttagcacattctatcataaattattcagtcattccccgatagttttttgccttctcattgttgcaatactttcctccctgattttttaactccgcttatttgttgccttcctacctctttgtgcctccatcatttcgcccttgcttgcctctccagtctcatctcttcctgagctctctatgcttcatactaaccaaattgccctacctggaatgttctaacagtaaccaattgttttctacctttcatacctctgctcacgttgtttcttctgcctagaatcctcttcctctcacttctcatcagattggcaaagccatctttaagattcagttcagtgcttacctctgatttaagtctttccatgtatacccatatgcctagtcactgggagaatcaactacatgctactcaggaccccactatatgcccttacataggtctatcagagcatgcataacccagttacacatacctgttaatagatttgctaatcttactctactgtgcgctccctgactgtagggaagaagtatctaacagtgcttaagagtgcatgccctgtggtcatatgaactgaattcaagtttcagctgtttaccatttcttacctttatgatgtagggaaaattatttatccttttaaagcctcagtttactcatctgtaaaatatggatactaattgtacttaccttacaggattgatgtgaggattgaattagtaaaggatttacctatgttccaggcacatagcaagtcctatatatattttagctattattattaggtacaatgtttgattcatctctgcattccagggcctaacataatctctggaatatggattcagtaaatgtttaatgaataaaggaatgaattacccaaaatgtatattcatcatttagagaaagggtctgagaatataacatcattatttaagaagaaattaagaattagaaaacactttacggactgccttttaggcccaactgaagttgtctgtcactgtattttaatactgagaaaaactccaaatactttccacctcaatacatttctctatctctaatctttagatgatcaatattagcaaaattgacaactgaatcattattaataaataattaaaatttagatgttattttccatcactctaaatgatcacaaataatatgctatatattatctgtacagataaaagtgacaaatatgtatgtgcttttactcattttctttctagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatgggttaagtattccatgaatttgttgtcttatcgctgttttgtttatataaatttgcaatgtaccatattaggaaaaaagaccacaaaaattactgaagctgttagaacctatgaaacctttaaatttatttgtccataaaattttcaagcaatcacataacctaataaatatacctatttattattttatttattaagaaaaattatctgagacatttattgttgattgaagaatgagctccacttggattgtacttattttgttttattttatttttggtcatataatattaagttaataacgaatatattttgcacttactagtaggtgctatctaaaaagaacttctgttaactttttgaaataatttcagacttacataaaagttgaaagaatggtatagagaactcccatataccctttacgcatattcaacaattactagcatttacctttgctttatcattatatatctctcttcatacatatacatatctttacacacacacacacatacacacatatgtatgtatatatattccttgtgatccagtaagagaaagtggcagccatcatacatacccctttaagcctaaacacttcattaatatttcagtgtatattttctaataacaagagcattctattacataatctgagtacaattaccaaaatcgggaaatttaaaattgatacaatactaatacctaacctatagtcagtattcaaattttgccaattgctgcaatcttgaaagggcttttcctagttagtattggtatattgacatcacaaatatttttggaccattaagattaatatattaaataattgtttttagatatgaccgtgattttttcactttcatttgtaagaattgtagattacattgcttaagtttaaatattgtttttggtttataatacctttattctgaacctgaatttctgtgtattctaaattccccagctaatccattaagcttaattacttagagaatattcagataaaggtagcagttgttcattgttttcttaaacttgtgtttatttgcaaaaaccttatatgattatttattaaaatcttaagcgttttgcagacattggtcagatcttgctagatgaagaagttattacctaggtagtctggtacacacagtctattacctcattagtttttgctatagaaaggtgaggaactaaactgatagagatattgtgacttactaagaaaacacagtaaaagttggcaagaggacgctgatttacagcatgctacctctgctatatagaattataggaccagattttcataatggaaactctctaaggtatgagaaattatttatgctttcaagtaagtaattgcagatacagaaattatttttataaatgatagccttggtgataatatattttaaatgtaccttttggtctttaaaacagttttacttcttagtaatgttagcgttggtgataatatatttaaaatgtaccttttggtctttaaaacagtattacttcttattaatgttagcagcagtctctattttcttccttatatttttgataagtaacaggacttttgccctctttttttaggaagcaatagactatttctgtaaagcaccaagtagtaaatattttaggctttgcaggccatatggtctctgtttcagcttctcagctctgcctttgtagactgaaggcagccatatgtatgtaaaggaatgtatatggcaatattccaataaatatttatttacaaaaacttgcagccatctgcagcctgtagtttgcctagcctacatgtgtaagtggattacaactctggctgtatattgaaatcacttggggagctttaaagagccactggtgccccaccctcagagattctgatttaattactctgagaatgggaccaaggcattgctatgggtttaaatctcctcagctgatcccaaaggtacagtcaaggttgggaactatggctttatgatctttaaacattacctgcatgaaactgactaatgatctttttatcctagcattttctttatttttaattgacaaataataataaaatatatttatggggtctagtgtgatgttttgatctgtgtatatacattgtagaaagactcaatcaacatatccatcaccttaccaaattgtcactttttgtggtaaggacattaagaatctattagcaattttgaaatatataatacattattattaactgtagtcaccatccaatgcgatagatccctaagacatttctgcaatctgactgaaattttgtaccctttgatcaacatcttgtttttccctatccctccccactcactccccagcctctggtaaccatctttctactctctttttctatgagattgacttttttagattcttggagaacattatgctaattgaaataagccaggcacagaaagacaaatactgtaagatctaactcataagtggaatctacaaagctgatcccatagaaacagagtagaaaggtgactatcttttttattgtttttatttatttatttatttattttttgagacagagtctcactttgtcacccaggctggagtgcagttgtgcaatctcggctcactgcaacctccacctcctgggttccagcgattctcctgcctcagcctctcaagtagctgggattacaggcacacgccatcaagcccagctaatttttgtttttttagtagagacgaggtttcaccatgttggccaggctgtactcgaactcctgacctcaaatgatctacctgcctcggcctctcaaaatgctaggattacacgtgtgagccactgcacctggctggaaggtgattagttatcttttaaagagaaaaaaaaaggcagttatgtaaatcatgttaggcacaggagatgcaaaagtaagtaatatacagtcctactcttaaaaattagtctaatggggtgacagctatgtaagataaacaaattagagtaaaatgaaagactaatgacagtaaaccatattaaaaatgtaatagacaaaaaggataaggaaatgaataaaaatgtaattgaagaaagaatggacagtaaagtaggagaatgtgttgcatgggagaaagtgttaagcagagattaggaaaaatatcagtggagtttaaatgttctgagcattataaatgagaaacagtatatagtgggaggagagttggtcagtaaaggaataaggatttgtggtaccatcactgccttctaggtgttcatgttggaagagaaactactggggtcatttatcttggtttatttttcatatttccacacatagttccaagttagaactaatatgtgaatttttttttttttttttgatacggagtcttgctatgtcacccaggctggagtggcgtggtgcaaacttggctcactgcaaccttcacctcctgggttcaaatgattctcctgcccgagtagctgggattacaggcgcccaccaccatgccaggctactttttgtatttttagtagagacagggttttgccatattggccggactggtcttgaactcctgacctcaagtgatccacccgccttggtctcccgaagtgctggtaatacaggcgtgagccgccgcgcctagccaatgtaatttttttaaaagactgaataaatggaaatctataaagatggaaattctattgcaaaacaaaggatatattatttgctggatgtgtatggctttgtatattgaattttgtacattattctgtataccttttacaaaatagtacatagctggcatacacaaataatacaccctttaaaatcttgagatttttcagactgtattacataatgcatattgattggatgatagcaacaagaatttttgattttggcgggcaggggctatttctttaattcggaaccctagcattttagagctggaagggaccttgaatataattaagtgatactatgacaatgaaagtacttcggaatatgcaaactatgatgcaaggtaatattatgtaatacaactttgcttgcttatatatgaatagactgaaactcataaaggtaaagtgaatatttcctttcacatgactagtaataggcagaaatagaaataaaatatcttcatcctggtttaagccttgtttgctacacagaaagttcttagaaaaatgtaactaaccaagaagaaaaaagcccaaatagctttataactattaaaggaattgaatcagaggtttaaatttttcccacaaagaaaatatcaggcatacatcatattatagagaaattctaccaaacatttagggaatatatcattctaaacctattccagagactagactagaaagtatattctcaaactcatattttgcttccaatataaccgtgataatcaaaaccaaacaagaatagtatgaaggagaaaaattataggtcagcttcagccactaatatataaacatatatatagatattctgaatggaatattggcaaactgcatcatgtgtaaaaaaaaaataagttcacatactgtgactaggttgcatttttcctcagcaatgcaaaattggttttacatataaaaatctgtgtcacccgccatttttacaaattagataatgagcattttaatagatacacaaaaagcttttattaaaattttacaactattcattaatttaaaaaagaaaatagcaagagaaggaaacttccttaaactaagtaagggggctgagcatggtggctcatgcctgtaattccagcactttgggaggccaaggcaggaagatcacttgaagccaggagtttgagaccagcctgtgcaacatagtaagaccctgtctctacaaataaaaagaaaaaattatccagttgtggtggcatgcacctgtagtcctagctactcaggaagctgaggagaaaggattgcttgagcccaggaggttgaggcttcaatgagccgtgattgcaccactgcattccagcctgagcgacagagcaataccaacaacaactacaaaaaaacaaacaaacaaaaaaaaaaaaaaacacctaataatgggtatttacaaaatcaaaaccaaacggcaaacacaattcttaatgggtaaaagttagatacattcctttataaaatggggaaaatggatgtctcctattattactatttctatttaatgttgtactggctgtcctagccagtgtgagaagacaaaatgaattaaaggtataaaggttttaaagaaaggtgcaagactgttactactcgcaaattaaattttatacagagaaaaaataacacaaagtattaaaaaaataggatttattatccttaccaaactaatgcaggaacaaaaaaccaaataccacatgttctcacttacaagcaggagctaaatgatgagaacacaaagaggggaacagcacacactgtggcctacttgaaagtggagggtgggaagagggagaggatcagaaaaaataactatcgagtactaggcttagtacctgggtgacaaaataatctgtacaacaaacccccgtgacatgagtttacctatataacaaacctgcacatatgcccctgaacctaaaataaaagtttttaaaaataaaaattaaaagtaataagatattagcaaagctacaaaagaagtcaactgattatgtatactccaataataaagagttagaaattataacttgaaaacatcattgacattgtcaacaataactataagatgtctagaaataaatgtaagagaagatgtgtaagacctgtgtggagatgattatgacacattattggaagacattaagaaagccttaaataaataagtagagataaataaactgggtaaagattgtatttgccactacataatcaatgaagaattaatatccaacatataaacaactcttgcaaatttttaaaagacaattcaacaattcaatagaacaatgggcaaaagaccaaggcatttcacagaagagaatgcatatatgaaccataagtatatgaaatgttgttcaatatgattagtactaagggaaatacaaaataggatcacaacaaattgtcatatcactagattggccaaaagtaccaaatttgaccatgtgcagtggctcacacctgagacctaagtgctctgggaggctgattctggaggaagccttgaggccaggagttcaagatcagcctgggcaacataagacccccccatctctaccaaaaattacaaaaattagctggacatgatgattctagctactcaggaggctaaggcaggaggattgcttgagcccaggagttcaaggctgcagtgagccatgattgtatgattgtgccactacactccagcctgggcaacagagtaaggccctgtcaaaaaaaaaaaaaaagaaagaaggaaagaaagaaggaagaaaggaaggaagggagggagggagagagagagaaagaaagaagaaaagaaagagaaagaaagaagaaagaaagagaaagaaagaaagaaaagaaagaaagaaaaaagaaagaaaaagagaaaagaaagaaagaaagttagttgacaataccaaggtttggagaggatgtgtatcaatgggaatttttacacattgctggtagaaacacaaataggctcattacttaaaatgattagggattatgctatagagctgaacatttacatatcacataatccagcatttttgcacctacatataataccttagaaaaacagttgcctgtgtgcacagggagacacatacaaaaatttttaaacaaccctatgtataatagtaaaaacctggaaataatccagatgtccattaacacaataatggataaataaattttagttaataaattgtagtatattaacacactggaacattattcagctgtggaaatgacaagaaaactgctacatgcagctacatggatgaattttattaatataatgttgagtgaaaaaagtagtcataaaatgcagaatataatttcactcatatgaagttcaaaaacaaagccaaataggattttgtctgggcaaagtgataaaaccctttttaagttaaagaaatgatagaacacaaagttctcaaagtgtggttaaactttttaaactgtggtggagagataagtggatgtgataatggaggtagaagaacactgataatagtctagttcttgagtttagtggtgggttcaaaatgttcagtatactattttgctttttaatatatattcatgtatattctttggtgtgtattaaatagcatattaaagtaatatatttatttttcagaaatctgcctgaatcttcgagatcccccaacaaatataattatcattccagaaaagcaggtgaaaccagaatggagactgccaaagctaaatcaccgatttaccacaaggtaaaatagtttcttgtaaaatgtcttaaatattaatcttcagtcttggttactgaaaaacaatgcattataatttgctcaaaatctacccagaattaagctatagcaattatgtagatatacattttcaaaataattgtagaatgctttttcactgtttaaaaataaaatattaatttagtgattttacctttttaggtcagaactggatgatatgccagaaaattgcatctgtgatgttattggccttttagtttttgtaggaagggtccagcggtcaaaaaagaaaggtaagcttttaaaattgaaaatcataaaaagtatttcagtgaataattttgtgttcatatgtatataacagttaccttcatttattttaatattctatccatatagaaaaccgtgaagatttttggtcatatcgctggattcacattgctgacggtacttcagaacaaccatttatagtggaactgttttcaacatcgcagccagaaatctttgaaaatatttacccaagtaagcgatttttaatatttttatattatgtttggaagtaggagaattaactttaaaaatgtagagtaaactgacttacagaagtagggtgacattgagttggcaattcaagcagtctgacagcatgtttaaatcttttctatattaatatcgttttttatagacattaacaacccgttggttgtctgttcagaattaacttgggattgaaaccagtttttcagaaaacaggtcctcttatcaattctcattgtaaaaattccacgcattaaaaaaatccttaaatttcaataagactaaaacatgggcagtcaattccctttttatacatttggaaattgattaagtagaccacattaaagacatcgaagacttatatagcattaattggtagaagattggtggactatgtaattacataataacaatggtaagtatggttccggtcgaatattaaattattcaagtaagttggtagtgttatttataccggctggtcaatattttactttggcttactttggcattgactttctcccctggattcattcagatataaaagtattttttccactagttttatttatttgaaattattttaggtttgtcctattacatattacatataacaggctagtcttcagatctattatgataaggaaaaaagtataatacttttcagcagtttcaatgaatatttccttatttaaatttagaatataaagctattgtagttaggggatgacattttatttttttccaaataattacatgaataaacactaattgctatctgtgttaaatgcttggccaacattgaagaaactcccaatatttactacatatatgtgtgtgtgtttgtatatatctatctatctatctgtatacatatatatatatttgagatggagtctcactctgtcgcccaggctagagtgcagtgcacaatcttgactcactgcaaccactacctcccaggttcaaatgattctcttgcctcagcctcctgagtagctgggactataggagcacaccaccatgcctggctaatttttatattttcagtagagacggggtttcaccatgttgggcaggctagtctcgaactcaacctcaggtgatctgcccacctcagcctcccaaagtgctgggattacaggcgtgagccactgcacctggcctatatctattattattacttttttaaccagcaataagatagacattgtagaacaccaagagacctagacactatatatagggctgttctgctgcccctttattctctatacaaaacagtattatacacctctgctttgttagattctaccctaggcttgtgagattaaattttaaaaatatatctgaatagaaccaaacctcaccccaatttatgggggatggaacagaaagagagtttcggccaaaccaaggcatggacttccaaggtgagtgggctattaactctgatataacttcttttagggcataagtaattggcagtgatgacttctggtgataatcctattgcctcaatttaggtgggttttattgccagcttcctttttgtttgtttgtaaccactttaaacaacaagctaacaagaattttggataaagatttctcgcaggaactttgccaagcacgcatattgtatttcttgtgataatgtgaaatgtatccttctaagaaacgtatattcggatcttggtgagatttattctagtataatagttgacaacagtcacaatttgtttttatcttttgaccaaaagtgaaggaaaaaatcattaaattaatggtgagtattaagggggcttcaggcccaagaaggggagcatggccaaaagtcttcaggaataataccaaaattctttggtagtatgactttttttttcataagaaaagtgaagaactaaggggaagtaatgttgtgtgtttaccatgtaccagatgcttatagatattatctcattttgtactctcaattaccttttgaagagttgatgttgttataaattttcaggtgagaaagcaaacttccagaggggttaagtaatttcctggatttcatatagctaggaagtgttagatctgactctcagatttttagtggccatgaatttagaattagaggtttctttatttttttctaaatttattttattgttgtaagaacacgtaacatgagatctactggcttaacatattttagaggtttctttaatattcctgtatcaacacctttagccattagtattcatatgtttgtagtttttgaaataatggaaaaattaagataattcttaatataaattaaggtaattcttagcatttgaacagattttcttcatttgcattgctacagaataaagaacttagtaaatatgagatgtagcaaatgaatgtacagttgtgctctggagaaatttttattctcaaatgagaaattactttgtgtgattataagaatttacatttatttcttcatttcctagtttgtaaaaccgtaagtgttttgacatataatgagttaaaataaaaaataatgttggattaatgaaactataataattagatagcctgttaggtaaaaacaattgatagttgttgaaagtagttgaaatctgaagacattatactctcatttttagatattctttttagtctataaagttagcaaggtgaaaagaaaataaacagatgatataagccctgccattggccttaaaatctaattaagataaatacataaaagataaaaaacagttgcataagcaaataccagtcaataatatataagccctatctggtggaaggagttagagtaattcagagtttagtgttagttagggttagtcagtggaagtatcatggagaaactaagcttttttttctctgttggaaatcactgttcacactcaggtgtgggcccagttaaaatgacttgcactctttatctgtgcaacaaacaaatgactttagttagttgcagctgttgtactttcttaaaaaaaaggggcctctcgcaaaaagcagagtagtgttaaacccttattgttcctagtgtggtcccaggactggcagcactaataattgcctaggagattattagaaatgcagaatctcaggccccaccctagacctactgaatctgaatttgcattttaacattggtaccatgtgatttctttgtgcattaaagtttgagaagcattgtgttagatcctgatcttgttatgtcctatttgaaatggaaaagtaatttcataagtgtttttgttctctagtggcatattttgtgtgtacacagttgaaagttgtcagaaatgacaatcaagtacctaagctgctttacctcaccactacaaatgagagtggagtgtttattactggtgagtaatttctttgtgtatattattagaaatatattttctcttccctagaatccttcagtacatattaacttttatataataacattcaactacaagatagctttattttgacttcctttattactataagagtgttttagcaaagaatttttggcctgtgaaatacgttgcttatggattacttacgaatgaggcaatgattttgtgactcagtggaaaattgcatttatatccttcagtcaactttaattcctgcttggcatagaatgtagataatcataaattgcttgatagattgaagacctggttaggcctggtatcataatatggattctgttaacaatattttaaaattctaaatgaaaacaaaactgagtgtcaaattttagccccaagatcttatgttttatttatataacaagagaggtctcattacttgtctgcaagtatattgtttttccctattccctccaataataggatcaaaacattaaagaaaaacgtttccaaatgagagagtgaggaagtagtgtggattgggtgtttaccagattgttaccatgttggtaattaagaaatttgttaaaagaagggtcctaggaaaggtgtaacatacatctttgtcaatgcatatcttattttataaatactatcagatgtgaatatggcacttttaagtatgctttaagaacataaatttaaatgctgagccatattcataggaagtttcattcatacatgatgccataatttcaggttaattcgtagtttaaaaatcggttatttcagaagatgtcaaccatttggatggttagaaaaattcaaattattagtttttcttcttcctgtgatttctagcatcttatagctagctacagtttagtccacttaaactctaatacacagtgtgtctgattttcttcttaggatttatttactgtctttggataattatacatagtgaataagtaaacttgactgtttttttcttggtgataaaagagggattgttttaatagtaaactgtttttacacaaaaatttgcatacagattgttacagtgacatttttatttctcattttttatgatttacccttcccgcgaggaggtcatagaggccagccgtatacgtatgatgccaaggtaaaaaactttattcaatggattagaacaaagtctgattccggggaacagaagaatatggttattggtggatattacccctatccaccagtgccagagacattttccaagtatagtagttctattaaaggtactaatgtaattgccagtccttctaaatatgtttatattttatatgtatggcttatgctatttcaattagtcatctttattcttttcttttatgggagtgatctaaagtttagcaacattcaccgataatagctttgtcttaatgcagatctaaaaatatatgtcacgtattttctatatagttttccctatatctcgcatggtgctctaaagattaatactttgatttttatcagactggaagaaaagagaaaacacagatgataaccaactggagatataggttgagtattcctaatccaaaaatccgaaatctgaaatgttccaaaacctgaaacttctttttttttttttgagacggagtctcgctctgtcgcccaggctggagtgcagtggcgggatctcggctcactgcaagctccgcctcccgggttcacgccattctcctgcctcagcctcccatgtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaacctgaaacttcttgagtactgaagtgacactcaaagaactactcattggagcagttcagattttggaattttgcattagggaagctgaactgataagtataatacaaatattccaaaataaagaaaatcagaaatctgaaatattctggtccaatgtatttcagagaagggatgttcaacctataaatatctttatttaatgtcattgagatcacatctgaccttggtgtagatctcaattgctatgatgttatacagaaagactaaagatatctaaaggagacactgggtaacttgatattcagagactgacaactgtattatgcgactcttgtggaatgatatatattgtgtttaacacaattgagtgctatctttaaatatgaaatgatgccaaaataaatgagatgctgaatttggaattgaagtactgatgagaagcctactattaatatactttttagtagaattaatatatgacagttgaaaagtttagcacaagcatgttcttttttaaaaagctatgagataattgcatggttttggaaaaaaagagaaactttaaaatgcggacctatcatcatctaaatattggcatcctcttatacatcataatgctagcaatatgtaatagtgtttgaaataattaaaatgtgtttttctatgcagtggctaggcaacactttatagtttgaaatataatatgtaaattgcatttaatatgcaaaatttattttgcaaatgaggggtacagagtggaagcctgtattcaaatttaactgataaaagtattttgcctatttcacaaaattatatagaaggatgccagatataaacacagtgtctcacagttaatgtagtaagtttataattttgtgttgtgaaattacattgcaaatctaattcttatttttatcatttcagttctttaaaacttacaattttcttggacttttttgcagttgagtcgctcttgacagctataagtgaagtcaggaaggagattgaagacttgcagtatagggaacaaaagcgcattgcaattcaggggataattactgctataaagtatatcccccatagcagtgcgactgaaagtgcctcagcatcagaaacacttcgggtatggtgccagagaattaatagtatttctctgaaagcactgtgattatgattgcaattggtaccttttacattttattcagaactcacgtgtattgactcttaataatgtaagcctaagagaaaacattaggttggtgcaaaaggcattgtggtttttgcctataaaagtaatggcaaaaaccgcaattccttttgcaccaacctaatatttttacttttttgtttgtttcctttttgtgtcatttatttgggggcagactaggccaataatgattatagcctcttgacatttcccaaggccctcaaaacttggtatcctgtttttgcattctgtgtaatttgaggctattgtgggtgttttaaatttctaggtggtatctatgactatattaatttcctaccttttgtccaggccagtactacaggaaagctttcataggaagttttctctatatctggcatagtagtcttacccaggttctataactcttctagaataaatagtttagtattatagaagatgccagttctggaatattggcacaatcaagacaagttaatttttcccatgagtttatctttttaaacactacgtccaggactactactatttatatggaaataagtgtttaatccagcttttcagatagtagtataagaaggacttttgtttgtcttccttttaaaaaatattttaatagcagatggattagattcaatcattttcataaaagcactgttatgattgaagttttgccagaactgttgattatgaaaaatgaatacactaaaattgtagtcttttatgagattaataattgtgaattagcctaaagtgttttctctaaattattggttttagaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccgtaagtcatttgtattaagtatatgtaaagtatattttttcttttgggttatctctaccctgtaaaataagcaattatcgtagaagctgtattaatttgttagggcccccataacaaaataccacaactgagtgacttaaacactgaaatttgttgtctcagagttctggaggatagagttcaagatcaaggtgtcaacagcattggttccctcagggctgcgagagagaatctgttcaatgcctctctcctagcctcttagggtgctggcaatctttggcattccttaacttgtagaagcatcaccccaatctctgccttcatattcacatggagttctctctgtgtaatgtctgtgtccaaatttcacctttttcataaggataccactcatattggattaggggaccaccctaatccagtatgacgtcatctttatcagtaacatctgctatgaccctatttccaaataaggtcatattcagaagtcctgagggttaggacttcatcatatgaattttgtggggacacaatttaacccataagtctgccctctggtcccacaaaattcctgtccttctcatatgcaaaataggttcacctcatcacaacatccccaaaagtcttatcccatagcaccatcaattctaatccaaaatctcatctaaatttcatatggatgtaattcatccatccatgatcatggtgatttatcctggggcaaaattcttctgcatctgtatacctataaaatcaaacaagttatctgtccagaatacagtgatgagataggtataggatagacactcccattctgaaagagagaaattggaaagaaaagggggatcatgggtcacaagcaactccaaaacctagcaaggcaaataaattgcattagattttaaggcttcagaattattctcttcgccacagtcttatgtcctctgggctcactggggtagcatccccacttctacaatcctgggtgatggccccacactctggaaccaaggaaatgaacccaccctctggaattgaaaagggagcacttgtcctctgaaaccaaggaggtagtctcactcccaaggtcattcttccattttcctgaacaacaagaacattatagcttacatttgcttaccagttgtttaagcatgggtctttactacaaaacattcatacattatgaattgtacatgattggaagttttggtttctttaaagtgtcaggaaagcccaaacactcataaagcagagtgcagaatcactttagattttaagattttaaaaattccaatcttttagagtgtgcccgggtgcacagcagtttttggttgtgaataagtaataggtaaaatttttaatttattttttaaaattgtttaacttttaatttttgtgggtacatttagtaggtatatatatatttatgggggtacatgagatgttttgatacaagcatacaatgtgaaataagaatgtcatggagaatggggtatccatcccatcaagcatttatcctttgtattacaatcaaattacactcttttagttacatttaaatgtacaattaagttattatggactatagtcactctgatgtgctatcaagtagtaggtcttattcattctttctagctatttatttgtacccgttaaacgtcttcacttccccgcacccccctgctacccttcccagcttctggtaaccgtccttctaaactctacctttatgagttcacttgtttgatttttagatcccacaaataggtgagaacatggaatgtttatctttctatgcttggcttatttcacttaacataatgatctccagttccatccatgttgttgcaaatcactggatctcatttttatggctaaatagtactccattgggtatatgtatcacattttctttatccactcatctgttgatggacatgtaggttgcttccaaatcttagctattataaacagtgctgcagcaacataggagtgcagatatctctttggtatactgatttcctttctcctgggtgtatacccagcagtggaattgctggatcacattgtatttcaattttcagtttctttgaggaacctccaaactgttctccatagtggttgtactaatttacattcccaccaacaacgtacagagttccttttctccacatcatcaccagcatttgttattgcctgtattttggatttaagccgttttaactgaggtaaaatggtatctatccacggctttttgagggtttttttcatgaagggatgttgaattttatcaaattttttttcagcatcaaatgaaacgattgtatggttttgatttgcatttctctgatgatcagtgatgttgagcaccttttcatgtgcctgtttgccatttgtataccttcttttgagaaacgtctattcaaatcttttgcccgctttttattgcattattagatttattcctataagttgtttgagctccttatacattctggttattaatcgcttgtcagatgggtagtttgcaagtatttcctcccattctgtgggttgtctcttcactttgttgattgtttcctttgctgtgcagaagcttttcaccttgatgtcaatctatttgtccatttttgctttggttgcctgttcttgtggggtattactcaagaaatttttgcccagacgaatgtcctgtagattttgcccaatgttttcctgtagtagtttcatatctcaatgtgttagatttaggtctttaatccattttgagttgatttttgtatatggcaagagataggggtatagtttcattcttctgaatatggatatccagttttcccagcaccatttattggaaagactgtctttaccccagtgtatgttcttggcacctttgttaaaaatgagttcactttaggtgtgtggatttgtgtgttgatcaattgaaatgatcgtatggttttgatcctttaatctgttgatatgatatatcacattgatttgcatatgttgattaggatagctttggctattctgggtcttttgtgggtccatctaaattttaggattgttttttctgtttctgtgaagaatgtcattggtattttggcagggattgcattgaatatgtagattgctttgggcagtatagacattgtaataaattgattcttccaatacatgatcatacagtatttttccatttttgaatgtcctcttcaatttctttcatcagtgttttatagctttcattatagacatctttcacttgtttggttatgttcattcctaggtatttaattttatgtgtggctgtcgtaaatgggattacttttttatttctttttcacatttttcacttttggcatagagaagtgcttctgatttttgtatgttgattttgtatcctgcaactttagtgagtttacgagttctaatagttttcttgtggagtctttaagtttttccaaatataaaatcatatcctctgcaaacaaggattatttgacttcttcctttccaagttggatgccctttatttctttctcttgtctgattgctttagataggacttccagtactatgctgaataacaggggtgaaagtgtgcatccttgttgtcttccagatctgaggaaaggctttcagtttttccccattaagtatgatactagttgtgggtctttcatatatggtttttattatgctgaagtacgttccttctatccacagctttttgagggtttttatcatgaagggatattgaattttatcaaatgttttttcaacatcaattgaaatgattgtatggttttgatccttttttctgttgatatggtatatcacattgatttgcatatgttgaaccatcttggcatcccagggataaatctcccttggtcatgatgagagatcattctaatatattgttgaatttggtttgctagtattttgttgaggatttttgtatcaaaattcttcagagatattgacctgtagttttcttttatggatgtgtctttgtctggttttgttataagggtaatactggccttgcagaatgggtttggaagtattccttcctcctccatttttttgaatagtttgagtaggattgatcttagctcttcttgaaatgtttggtagaattcatcagtgtagccattggatcccaggcttttctttactgggagactttttgttacaacttccatctcattacttgttattggtctgttcaggttttggatttcttcctggttcaatcttggtaggttgtatgtatctacgaatttgttcatttcttctaaattttccattttattgtcatatggttgtacatagtagccactaatgaacctttgaatttctgcagtatcagttgtaaaagctcctttttcatttctaatttaatttatttggatcctctctctttttttcatggtctggctaaatgtaagttttgttttacttttcaagaaagcagctttttgcttcattgatcttttgtattgattttctcatttcaattttatttatttatgctctgatcttgttttcttccactactttgggtttgttttgctcttgcctttctaattctttaagatgcatcattaggttgcttatttgaagtttttcttcttttttgttggaggcacttatagctgtaaacgtccctcttactactgcttttgctgtatcccttaggttttgttatgttttgtttctattttcatttgtttcgagcaatttttcaattttcttcttaatttcttcattgacacattggtaattgaagaatatgctgtttaatttctatgtatttgtatagtttccaaaatcattcttgttactaatttctagttttactccattgtggacagaaaaggtgctagatattatttgtttatttgaatgttttaagacttgttttgtgacctaacatatgatctatccttgagaatgatccatgtgctgaggaaaagaatgtgtattctgcagctgttggattacatgttctgtaaatatctattagatccatttgatctacagtgcagattaagtccaatatttctttgttgattttctgtctagaagatttgtccagtgctgaaagtggggtgttgaagtctctagctattattgtattgcggcctatctgtctctttagctctaataatatttggtttatatatctcgatgctccagtgttgggtgcatacatatttaaaattgttatattgtcttgctggattgactcctttatcattatatagtgatcttctttgtctcttcttattgtttttgtctcaaaatcgattttgtctgatataaagatagctactccttattatttttgtctcgaaatcgattttgtctgatataaagatagctactcctacggttttttggtttccattgacatggaataccttttaccatccttttattttcagtttacatgtatctttataggtaaagtatgtttctcataagcaacagatcaatggattttgctgctatgggataagacttttggggctgttgtgatggggtaaacctattttgcatatgagaaggacaggaattttgtgggaccagagggcagacttatgggttgaattgtgtccccacgaaattcatacaatgaagtcctaaccctcaggacttctgaatatgaccttatttggaaatagggtcatagcagatgtaactgataaagatgagttaatactttcatagagagctaagtcttgtggaagagacagacttttaaacctgtaatttcaatatgatatggtgaatgccatgatagaagtttattcacagtactgtaatagcatatacaaggggcagttagccttggcaagagatcaagggaagcttcttgtaggaaattatgctggagctaaatcctgaaggatgagtaagagttaaccaggcaaatgaaaggggacataggattgttccaggcagaaagaaaagcgtgaaggtttaaagcaccatgggactaataaaaaactatgaaatgaaattggaaaggcaggccagattgtttcccataatttttgaacaaagaaaatgtaaaaactaggccattgcacttatttcatttttacttatttatttttaatttttgtaagtatatgttaggtgcattcatgaaatgttttgatgcaggcatacaatgcataataatcacatcatggagaatggggtatccatcccctcaagcatttatccttcgtgttacaaacaattaaattacacagtcttttagttattttaaaatgtacagtgaagttattatggactatagtcaccctgttgtgctatcaaatagtaggtcttattcattctttctatatttttgtacccattaaccatccatacctctcccaaactcccctactccccttcccagcctctggtaaccattcttcttctactctctatctccatgtgttcagttgttttaatttttagctcccacaaataagtgagaacatgcaatgtttatcttttattgcctatcttatttccacttaacacaatgatctccagttctatccatgtcattgcaaatgacaggattttaatcattttatgcctgaatagtgctccattgtgtatatgtaccacattttctttatccattcatctgttgatggactcttaggttgcttccaaaccttagctattgtaaaagcttctgcaacaaacatggaagtgcagctatctctttgatatactgattttctttcttttgggtatataccaagcaggggggatgctcgattatatggtagctcaatttttaatttttgtagaaacctccaaactgtcttcatagtggatatactaatttacattcctaccaacattatacagagttttcccattctccacattcttgtcagcatttgttatttgcctgtcttttggatttaagccacttttactggggtgagatgatatctcattgtagttttgatttgggtttctctgatgatcagtgatgttgagcaccttttcatatacctgtttgccatttatatgtctttttttgagaaatgtctgttacagaaatgtcatttctcataaaaatgtcaaatcttttccccatttttcatcaaattattagcttttttcctttacagttttatttgagctccttgtgtattctggttattaatcccttgtcagatgagtagtttgcaaatattttctcccattctgtgggttgtctcttcactttgattatttcttttgctctgcatgcactaaattttaaatttctgtcataaagaataaaaatattatcttcagttaatatttaataaaattaatgctcccttttatggaataatctttaaaatttaaatctattgcagtatttgagttgttttatatatggatatttttcataattattagtgtatgttaatgtattattcaacaaacttaacctgtatattttctaaatttattgaattaaaataaattctgaatagaaccagttgatttgtttttcatttgagactctttttataaggattggttatactcttcttatcctttatagagttgctgtacctcaaccaggagcttctgtacaaacaaagggaattaaaccgggcatgccaagcatcttcaaccgtatgttactatttgttattattatttatgaaaactttatgaaacattattctatgaagattactatttaattactaagcacaagtaatacatgcttagaatgtatactttgcatatagtaatattagcttaggtcactgtcaaaagtgtactgatcaatttggtatcatcccaaaagtgaaagtaattttaaacaaacttatacttaccagtttgtttcattagtaatagtatatctcttcaaatgtactatttttaatagaagaataagtaggaagtttaatttttaattgacaacaaatatggatagctcttaaaagtaaattgtatcttctttctttgctattgggttggctgatttgaactttggcctcatttctgaagtgatttcgtaatacaattttttctggtggggtgtccgtagagtagtttggtttaagtcagatcttatcaggtatcatctctctggattagactttttagcactttatttccttgctttgcttttggtgttattttgttttcatcctccacctagacaaaagtgatactgtcattttattgaatactaccttgttaaatttgatgtctcaacgaacctttccaaagtatttaaatatgacttttgttgattgttacatgatataaaattggagcattgtgaacaagtccattctaaacattttaaatctttttagaaacatctgtccttacctattagatttatgtgggttagttaataatagatttttattcatttctcctgtcatattctagactgattattctctataaggctgaatactttgtccaaaagtttcaatgagcactttagatgatttcagtaaaaaatataatttgcggacttatggagaaaaagattatttttcccagctaagcataatttgaattaaaaaaatgttcctcaggcaatggatcttgcctggactctaaattctaaaaatgaaggagaaaaccataattgttcccaggttttgtgattctctgtttaatatccaagaaagcaattaaattctattcttcagcttgtcagcttggtgattaaacttcatacagatttctatattagcatctgctaagattatcccatctcttttacctacagaagataatatggtacttctcacaattatataatagtagtaccagccatttattgagcatttatgtgtcaggcactgtgctgagctttatggacacattttgtttatctcacaggaagtggttatttgaaattaatttcaacttttccttcctattccatgctgttttggagaaagctcttgttcagatgtaagttaatcattcacttgctaactaaaattgaaagatagaatggattgagtcttaggctgcagaaagaaataaatccaagaatagcctgacagaccagtagcaaaaggagggattgccttatggtaaatctggccgattgaaaacccacaaaagaaaaacattataatataagtatctaatcaagctctaaacaagaatgaaaaatcaccaggtgccagaaacaaaaaaggaatttaaatttactagtgagtaggaaccaaaactgaaagtgttcatggacatctcagaactagatagagaccttaattttcatgggctgagaggtataataaccacatgggaaggagagtccagaccacaggcctcctacttgtgaagaagtaaaactaatgtaaagttggaagtttgcagaagggcagaaaaattgtgaccatgaatgtggagagatatcaaagagcttcctgtatctcctgggcaatgggtaagaaaaagtcatctgagagaaagtggaatcccagacctgtgcagcatggaagtatggttgcagttcacatgattaaaatggtgaggctactgaactaaggagttagcactaatatctggtccaaaatcagtgaaatcaagaccctaaggtctagacaaaggcagttgtgaaacttcctaaaagggaggtttcttgtaacctagggtgcttgggattcccttggaaaacaatatctacagaaaatggattcatggtgaaaaattacaagcttccaaaggaaatgagctactactgaaaggcagtgtgatcagatgtaacacatggaagaatttataccccaggaactagaaatactaggccaatcagaaagaggctttgaaacgtatgtttattatttttataatttttttatagagatagtgtctcactatgtttcccaggttgatctcaaactcctggcctcacgtgatcctccagcctcagccttccaaagtgctacaggtgtgagccaccacatccagctctaaaataaacacgtttaaaaagttaaaggaataaataaaagtcagtaggttggaaacagatcaatatgaagaactgacatatgtgaaaaaggtatccacacacacacttatcggtagaggatgagtagaataatagataaatgcagatgaagaaataatttagtgtatttggagatactgatgaaatcacaccaaagagtggtaaagagtttagaaaggtaaaatacaagttgagagacatagtggataggatgagaaagtccaatttatatctaataaaggttcaggaggacagaacagagatagttaggaagaagcagtatttgaagagggtattttttcaaaattgtatatatataaaaatgaattattaaattgaaggatcacagtgaattctgagtagaataaaaataaactgtatctagacatatgatatgtgataaatcatacagaccatgatagtgaacctgcagagcatcaaagataaacatccttaaaactaccagagataaaaaaaagacagatttatcaacaaagaaaacaaaattagacggaaaaatttcccaaaaacaataatgctttagacagtgaaatatcttcaaagtgttgagataattcctaacctggaattttatgtctacctaaacaatcaagcaagagtgacggtgaaataaagatattttcagatagtcagagactaaaagagttattacttgtagagtctcaatgaaagaattactaaagaattctgagagatggaaaatcaaaccaaaaggaaatatcagaatgtaagaagcaatggtaagcaaagaagttagtaaaatattggtaaatataaataaatatatgcagtagaaattaataactatggtaacaaattatttcatgggatttgaaacaaagtagaatgaaaatactatttaaggtgaaatggatggaaagatgagaattaaagcattctaagatcattgtatctttatggaaaatagagatttatatactgcaggctttgtaaatttaaacatgtgagttaaaaatttaagatcaagctgaaagaataggatagaatgtgtaacttctgaagcagcacagaaaaaaaggggaggaattatgaaaaatttttcagggcagtaaaggtagaaaaaagggggaaaaagcaaagaaaaagcatgattaagataaaacatgggctgggcatggtggcttatgtctgtgattcctgcacttggggagtctgagacaggaagattacttgaggccaggagttcaagactagtctgggcaacataatgggactccatctctctcttttttttttaagataaaacacaaaatgatatagctgagataattctgaattatcaacaatttcaataaatgtaaacatattaaactttcgtattccaatcttaaaaattaatccagttacatgctacatataagagacacacttaagcctggtgcagtggcatgcacctatagtcctagctactcaggaagctgaggcaggaggatcacttgagcccaggagtttgagactgtagtgtgctatgattgtgtctgtgaatagccactgcacttcagcctgggcaacatagtgagaaccaatctcaaaagaaattttttttaagagagagacatacttaagcaaaattatataaaaagttgaaaataaaggaatggcaaaatatatacctgatatatactaaccaagagaaaagtggtatagcaatattcatatgaagtaaatagaatttaaggtaaaaactgtaagtaaagataaatagggacgatatagaatatataggatgataaatggacattccactaagaatacagtaacaatcatgaatgtgtataacatataatataatcttaaaaaggtaaataacctggtggattttaagagcagttggtgcacataacagtcatggtgcactcctcttaaaataatagaacaaggagacaaaaacatcattaaatgcacacacacacacacacacacacacacacgccactgaaaaccaggataaacgatatcttaaaagaagcaaaagagaaaagaaaaaaatacacataagtcacaaaggatcaaagacaagcatgacagcagatgtctcttaagaaatcatgtaatcacggagcatgcctgtattaccagtgacttgggaggctgaggcaggagaatcgcttgaattcaggaggcggaggttgcagtgagccaaaattgcaccactgcactctagcctgggtgacagagtgagattctgtcaaaaaaaaaaaaaaaaaacctgtaaacttagaattctatacacagtgactataacttttaaaaataaaggcaaaataaagacaaaagctgcaaaagctgcaaaagctgagagaattcatcaccacgagacctacacaatgaaaaatattaaaggaattcttcaggcagaaaatgtatagcacctgatagaaatttttatctaagtaaaggaagataaagcactagaattagtaaataggtgggtaaaataaaatatattttctcatttttcttttagatcagaaataataaaaatatattgtggagtttatagtttatatagaagtaaagtgttatgaaaaaatagcatgatgactggaggggatatggaaatgcactgttctaaaattcttacactacatgcatgaagatgcatagcatcatttgaaggtagattgtagtaaatgttgtatattgtagaccttggagaaaacactaaaaaaaagtgtagctaatcaatagcagggcttaatgggattatgttttattttattttattttattttattttattttattttattttattatacttttaagttctgggatatatttgcagaacgtgcaggtttgttacataggtatatacgtgccgtgatggtttgctgcacccatcaacccatcgtctacattaggtatttctcctaatactatccctcccctagcccccaacatgccgacaggccccaatgtgtgatgttctcctccctgtgtccatgtgttctcattgttcaactcccacttgttagtgagaacatgcagtgtttggttttctgttcttgtgttagtttactgagaatgatggtttccagcttcatccatgtccctgaaaaggacatgaactcatccttttttatggctgcatagtattccatggtgtatatgtgccacattttctttatccagtctatcattgttggacatttggaatggttccaagtctttgctattgtgaacagtgcctcaataaacataagtgtgcatgtgtctttatagtagaataatttataatcctttgagtatatacccagtaatgggattgctgggtcaaatggtatttctggttctagatccttgaggaatcaccaaactgtcttccacaatggttgaactaatttacactcccaccaacagtgtaaaagcattcctatttctccacatcctctccagcatctgttgtttcctgactataatgatcaccattctaactggcatgagatggtatctcattatggttttgatttgcatttctctaatgactagtgatgatgatttttttttcatatgtttgttggctgcataaatatcttcttttgagaagtgtctgttcatatccttcacccacttcttgatggggttgtttatttttttcttgtaaatttgtttaagtgaccagtggaacagaacagaggcctcagaaataacaccacacgtctacaaccatctgatctttgacaaacctgacaaaaacaagcaatggggaaaggattccctatttaataaatggtgttgggaaaactggctagccatgtgcagaaaacttaaactggaccccttccttacaccttatacaaaaattaactcaagatggattagacttaaacgtaagacctaaatccataaaaaccctagaaaaaaacctaggcaatatcactcaggacataggcatgggcaaagacttaggaataaaacaccaaaagcaatggcaacaaaagccaaaattgacaaatgggatctaattaaactaaagagcttctgcacagcaaaagaaactatcatcagagtgaacaggcaacctacagaatgggagaaaatttttgcaatgtatccatctgacaaaaggctaatatccagaatctataaagggattattttttaaaacattcaatccaagagaaggcaggaaaagagaaaattgatctaaggaatagatgagtcaaagagaaacaatagaaaagtagcaaatttaagtccttccatggttaattgcaggcgtacctcagagatattgtgggtttggtgccaaaccattagaataaagtgaaaattgcagtagagcaaatcacacaaatttttaggtttttcagtacatataaaagttatgtttacattctaataagtatgcaatatcattatatccaaaaatgtacatacctgaatttaaaaatactgtattgctaataaatgctaaccatcatctgagccttaagtgagtcgtagtctttttgctggcggagggtcttgccttatgctgatggctgtggcagtttctttttcttttttttttttaagttgttattagctttatttttttttcaggttttctttttttattatactttaagttctagggtacatgtgcacaatgtgcaggtttgttacatatgtatacatgtgccatgttagtgtgctgcacccattaactcgtcatttacattaggtatatctcctaatgctatccctccccccaccgcccaccccatgacaggccccagtgcttgatgttccctaccctgtgtccaagtgttctcattgttcaattcccacctatgagtgagaacatgcggtgtttggttttctgcccttgggatagtttgctcagaatgatggtttccagcttcatccatgtccttaaaaaggacatgaactcatccttttttatggctacatagtattccatggtgtatatgtgccacattttcttaatccagtctatcattgatggacatttgggttggttccaagtctttgctattgtgaatactgccacagtaaacatacgtgtgcatgtgtctttatagcagcatgatttataatcctttgggtatatacctagaaatgggatggctgggtcaaatgatatttctagttctagatccctgaggaatcggctttggcagtttcctaaaataagacagcaataaattttgccacatcagttgacttttcctttcaggaaagatttctctgtagcatgtgatgctgtttgacagcattttacccagagtagaacttctttcaaaattggagtcactcctttcaaaaattgacactactttatctattatgctaagcttatgtaatattctaaattctttattttcattttaacagtgttcacgacatcttcaccaggaatagattcaatctcaaaaaaaccacctttgttcatttgtaagaagcaactcttcgtccattcaagttttatgatgagattgcagcaatttagtaacatcttcagactccacttctaattctagttctcctgccatttccaccacttctgcagttacttcctaccctaaagtgttgaacacctcaaagtcatctatggggtttggaatcaatttcttctaaactcctgttcatgttgatattttggcctccttccataaatcacaaatactttaaatggcatctagaatggtgaatcctttccagaaggttttcaaatttccaggaggttttcagttttcacttttgcccagatccatcagaggaatcactatggtagctatagccttatgaaatgcatttcttaagaattaagacttgaaagtcagaattactccttgatccatgggcttctgaatggttttgtgtttgcaggcacgaaaacaacattgaactccttgatggaactccgtcagagctcctggtcatcagagctcctgagtgaccaggtgcattgtcaataagcagtaatattttgaggggaatctttttatctgagcagtagttctcaatagtgggcttaaaatattcagtaaaccatactataaacagatgtgctgtcattgaggctttgttccatttctagagcacaggcagagtagatttagcataattcttaagggccccaggacttttggaatggtaaatgagcattggtttcaacttaaagtcatcagctgcattagcccctaagaagagagtcagcctgcccgttgaagatttaaagccaggcattgacttttcctctctaactatgaaagtcttagatggcatcttcttccaatacaaagctattttatctccattgaaaatctgttgttcagtgtagccaccttcatcagttatcttagctggattttctgaataacttgcagcttctacatcagaacttgctgcctcaccttgcacttttatgttatggagatagcttctttcttaaacctcatgaaccaatctctgctagcttccaacttttcttctccagcttcctcacttatcttagccttcatagaattgaagagagttaggttagggccttgctaggaattaggctttggccttagggaatattgttgtggctagcatgatattctattcagaccaccaaaactttctttagatcagcaataaggctgtttcagtttgttatcattcatgtgttcactagaatagcacttttactttccttcaagaacttttacattgcactctcaacttggctaattgtttggctcagaaggccttagttttcagcctatcttgttttttaacatgccttcctcactaaactaaattgtttctagcttttgatttgaaatgagagatgtgtgactctcctttcacttgaacacttagaaaacattataaggttattcattggcctaatttcaatattattttgtcttagggagtagggagacttgaggaaaagaggatagacagggaaatggccagtaattggggcagttagaacacacacagtatttttcaattaagtttgctatctcacatgggtgtggtttgtggcgcctcaaaacaattacaatagtagcatcagagatcagtaatcacaggtcaccataatatatataataatttaaaagtttgaaatattgtgataattaccaaaacgtgacgcagagacacaaaatgaacatatgctgtttaaaaaatgtcaccaatagacttgctcaacacagggttcccacagaccttcaatttgcaaaaaaatgcaatatctgtgaagcacaataaagtgcattaaaacaaggtatgcctttatattaaaataaatagcataaataccccaagtaaaaagtggagattatcatattggatacaaaagtaagacccaaccatataccatctaaaagaaaaccaatttaaatgtaaagatatgatataaaaagatggaaaagcacataccatacaaaagaaaacttgagtgtctacacttatatcagaaaagtagatttctgatacaatcaactataactggatattgataaaaatttaaagtagagaaatgagaagagtcaaggatccctcaattacctactccttgtctctttttgacaaactcagtattccagctggagtaggcatttgtattagggagagactcatgcacctccccactttgttagaatagatatgctgcaaccaccatttgagaataatttgacaatacctaatttgttgggaatgtgttacactctgtgacctagaaattccatttatgtctttggccacataggaagacacattccaagattttcactggaaaattatttataatagggaaaattaaaagctaaatgttaattaacagatgattataaatatagcatattaatatactgtaatattatattgcagttttaatgaatgaattagatctatatgtgtcaacatggtcactaatgtattcccaggtagtttcatgataactttggctttttagatgcttgtaaattcaaaagtcattcattttgtgaatacacaattaatatgtttgtgtggtttgtttgtgcttatatctagtaactcagacatacacttgaaaagttaacagtaacacaaggcattacaggtagcctctgactttcactagtctttaaaaagtccgttatatacttgctagcaagaaggagaggcaaagaaagtagctcctttccctcccccatgcctccatacatcccattacattttttttttttttgagacagagtcttgctatgtcatccaggcaggagtgcaatggcacgatcatggctcactgcagcctcgacctcccaggctcaagcaatcctcccacctcagctaccaagtagatggaaccataggtgtgtgccataatgcctgcttattttattactattactattattattattattactttgtagagacagggtctccctatgttacctaagctggtcttgaactcccggcctcaagcagtcctcctgcctcaggctcctgaagtgctgggattacaggcgtgagcctgcctctatcaacctaccactcttatccacgtaatgaaatgcttggagtagatttaaaaaaaaaattcacgatgcctacgtacatacgtttgaactgcattctttttttaaccttacgacctaaatgtaaatgttcctcattaaaacattgaaccaatctcaccagaaataagagtaaaatagataattgaaataatagaatgaaaattataattgtaaaatataaaaatataattttgctaagtaattaacctatattttagctatgcattaagcttaaaatataacatgtttcatatagtaattttattaatattcaaaaaaaactagttcatgattttccatcttatttttagaaaaacctgagctctagatatattttgtctctttcctatttattgtctttgatttgttactattcacaaccaataactgccaatgtctcctgtattgatttcatactgatttgtattacttaattatgaagatacaattgaggtaggtaattgtagtccccagttactaaaataaaaaaataaagcatgtttctttagaggaatttttcatataaacatttgtaccttggcagtccttaatattaacactcaaataagaaaatatgcatagaaaatattctggctttttccaaacagatcaatcatataattgttttctataaggtagatgtaaatacttaatttttaaaaattagaatagcatatcactttttcttttgcatgctgtattctaaaataagtcaagcaggaatgtttaatatgggttagatcattgcaatagctactaattgttgttctgattatgtacttttattagtttgagaagagatttacttctagaagatacaaaagatgaagtcatttcccaatcatcaatttagtcctactaactctttttctcagctttgatttattccttttgatcttttcgtgtgtgactaagttttttatcccttttgttatcaatcattattataggaatttgtgtgttcatcaactgaatttttagtttaaaaaactcttttgtagtattgcaatattttaaattcctggtaagaagtatgtgttcaacttcttcatcttcccttacaactcaaactaatactttaccttgtaatacattttcaataagtctccagctaggcttaagaaaccaagcaagtactctgggaatatgtaataaagtctgataatcagaagtagtattttaaccatactgaaaccttgctattgcagccaccttctgcctcagcaaggttttttatgctaggataagaataccaggacataggcaagaaagaaagtcagcaactttggtaaactcttaagctgtcagcctatctcagctagcagaactgttgttccaaaatcaatttttttttctgattttacagtgtttccgattctaccatggtacattatttaatcaaagtattacttgtaccaaattccttaacacaatgtctggcacataataggtgttctgtaattgtttgttgaatggatgaacgaatgtcataatgtatacgtgtattagtctgttctcacactgctataaatgactgcctgagactgggtaatttacgaagaaaagaggtttaattggctcacagttccacatggctggggaggcctcaggaaacctacaatcatgccaggcacgtcttatatggtggcaggcaagagagacaatgtgtgcaggaagaaatgtcaaacacttataaaaccatcagatctcgtgggaactatctcattttcatgagaacagcatgggagaaccacccccatgatccaatcacctctcactaggtctctccctcaacacctggggactcaagataagttttgggtaggaatacaaagcctaaccatatcaataagggataaattatattctgcattagaaacttaatgtgttagattttaatcatacataaatgataatttgatttgatgatagagaacaacaaaaattgagggggtctttcatctcaatttcgttccctttttgttttccataaaggagtgtcatatataataaataaatggcccctttgtttttcgtttttgttttgtttttttttcttgttttttttttttggtttttttgttttgttttgttttttagtgacaggtctctctatgttaactaggctggtcttgaactcctggcttcaagtgatcctcctgcctcagcctccaaaaatgctgagattacaggcatgagccaccatgcccaacccctaaatggcccctctgaaggagagaagtaatgaagaaggagactgtatttgttcagtttacttttagcagagattaacaaaagtttattttaggctcaaatttccaccaagagtgagtgatctctaatcatgaatttaatttaatttgaatttgtcactgaatataaaaagaacatatgtttaagagcttttagaacatttagaaaaagtagaaagaacgtaattacaaatctacataattacaacaacagagaaaacaatgtcactttagtattttacggtaaaagtttattttgaaagtgaatttagttcctcactttaataagaattttcttttgtatattcattttatattttgtaggtagtggtttgatttttaatgttacttaaactcttcctcattaatgtgtggtttttttttgcagtgaatgacttgatttgattagtttatagatcaattgtgtctatctccttgtgtctttaacaggtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtaagttcactgttctttttgcatatcattaatttaacatattttaaatatacctactatttcgctttaaaaatttaagcccctcccacaaaaacattaagcccaagggaagtttttgtttggctccaacaaaaggaatggagcaccaattatggaataaatgaagctctaattgtgtgcttctaaacattggcaagtccttggaaggtatctggcgagagaagaatgggagaactaagggaattttcctcattcctgactatcagtcagcttctaaggcagcttctgttctcccttagccaccactttcttgcctatattctctgcttcttcattcatcggaaccactgaagggtaaagtgtaagttaaagaggagaaagaatactaatcaaaagaagcccctaccaaaaaaaaaaaaaaaggaagaaaaaaaggtctgtttagaccctcaagataataaaataatcaagtaactgaggttgactagaaataagttattgaaaaaactgcccttgtctgataagagaaaataagctgatttacccaggtttttcaaaattgagaggtagctatggaacttacagaaatttaaagaagtcaaaacattttaaaacttagttttttttttttgtttcggaaagatgaaaaatttacacacaaaaaaattctaaaacaaaatcttagttaaaatgactctcagagtcaagcaaaacaatgcatttgtatttcacaggaagatcttagtaccaggtcttattaccttaaaatgaaggaatgaggaaaaaattattagcaaattaacttaatgaccgaataatgtagttcatggatttttacatttgtagtactggacatcttggccggttagctcagttggtgagagcgtggtgctaacatttgcagtccttggatgaattgccttgacctttatcaagattctcttttcccttttattctctcccaatccctcttccctacctcctcacatataaatatgtacagacatgtgagtatgtatgtaatctatgaaaagtctgaattctcactgactccattagacaatcacagacctaagtttcaaatgctttttcactagaatgtattacttggtctcttcaagtagttcatcaactttagttttgtatctagggaacaaaaattatagcaaaatttcccatccatcaaaaaaataataatcatggataatagatacaaaaatttagaaataatgcgtaagacctacaattttgtagcagaataaggtgactatggtcaataataatttaattgtacattttaaaataactaaaagagtataattgcatcatttgtaactcaaaggataaatgcttgaggagatggataccccatttaccctgatgtgatttttacatattgcatgcctatatcaaaatatctcatgtaccccataaatatatacacttatatacccacaacattaaaaattaaaaaggtaaccatggaaatgatgagttcatctagaaacatagaacttgaatttttttcttacttttaacatgttagtgctctattaaaacagcttgactaagacttctcagctgtattacatgtaattataaatttgtgtagctttggctatgagtcagctaagagcaggaatcaaatgtgaagaaggaaatttcatcattcctcccactagctttaatccatgttagaagtatgctgtttctatataaattttatatcctacatttttccaagtatggtttacatagttaaaagacagtggaaaataagccatttatgaatgaaacaaaacagaacattttaaaggaagcgcaaaagtaggtattactaggtacttgcaaataaccaaatttctaccattggcaataattttctgtgctttctggcaggaagggagaagggttttttttttttcaattgttattgttttttttctgatgagatatttaattttaaaaccaaacaaaccttggatatcttctagtcttacccttggctaggtaaaagccaggccatgattataaatcagatctcctgattctctaaacgtatcatctgttgcagagaaaacaattacatagaggaaccctgctattttttctctcaaacaaaattcaagtccgaattaactgtatgaaacttcaactgtagtttttttaaaaagttatgtaaatgatcttcagatagttgcttcgtgcatcaacattttaatatacctaatcagtataatcattagtcataccttaataaagcatttctataaaggaatatattttcactttattattatataatccaagtacttcacgctctaatagtttaacttaatggagggataaaacctagagggctgggataaatggtactggatccagtgattctcatacagtctcggtgggagggggtagcttatcaaagtcatctacaagaggcctattcctacttcttagaattctgatacacactagagaagcagcccattcagtctactccattcataagagagacttattgccacagagataattccactgccaagaacacatcctgtccatcaggtgtaaaggagtagattaaaggttgaaaactctatgctttaagtagtacttgaagtatacattgtctatacttcaagtactatctgtattcatatcttcattcattcaggtactatctacatctatacttcaagtactacttagaatgagagctgaatatcggatgtgacagtgctgaatttgtcatatcttttagaaaagtatgaacccaagttgtattataagaccagacaaatggttcatatatattttaagcatggacatgagcaataaactcagaagagaggaataaatctcttattactgtgctatttgttgaaaggtagaatcccaaaactgaaagatgactttaagtgtatcttatacaaggtggcacacttggtcagtaaagggccaagtagtaaatgtttgaggttttacaggccatacaatttcttttgcaactactcagctctgctgtattaatgtgaaagcaaccattgacaatatgcaaatgaatgcacatggctgtttgaaaaaaactttatgtacactaaaatttgaatttcatattttcatgtatcataaaatattgttcttttgatttttttaactatttaaaaatgtgaaagctattcttagctcatggaatgtacaaaaccaggggcaggctgaatttccaccccctcccccaaccccccggtcatagtttaccctgttctagacccctgttcttagttgagactgcctaaaccaattcaggcagataaatctgtatgatgtttaaggttctccaagcatgaagattgtctaatttagtgatactatcttctagtggtttattatacctctgcaatatcttgcaagtctctagaagacctcgtaattttgaagtgccttattcctggagccaaaaatgttatttggaccacaactctgttacttggtcattacctctgactggaagggtgaattgttattgaaaacattgaatagaattattagtcttccttctttcccacagtcctaatggctctcagcaaccaccagcttggtaccatggcaatgtcagaaacctatcctagaagcactggttcttgcctttaaattcttgctgggccatctcacttgcctcaaatcaatagattataaccattaaaacctcagctcattgcctaccatgtaagatcacacactttaaatagaatatattgagatgaagtaacgaactagattttcagtgcccttagcccaagtacaaaatgtaaaatctgttggtcagtctttcccaattttaagaattatttttcacctgaaatataagaacacacctttcaaaagttttaattgaacttacagatcattaagatacacaatagtgtatcattggctctactaacactaatttggttacccatgaaatctgatgagtcaatcaaagtttaaaagtcatctcctcaattttcatttgacttagataattaggaacataatccagccagcctttccaagtctctgaaggctgcctatttgtcttttaaaagtcaaaagatataaaccccaataatagcattaattggtaagggaatcaacattgagggaacccagtgctactcagctaatctttcaaaaaggctttcagcaaggaaggtagcataccccagaagtagaaataattgatcctgagcccacaggctaataccaaggagggaaagaattatattggtctacttggctgctttaataaaagaaaatataaagatgagtaaagccttattatttcagcgtatctatagtatattaaattaccttgatatcacagttaatgttattaaaatttgaaattatcttttaaatgcattttacggtaaaggaaaagaacaaaccatatgacaaatttttccaaaaaatactttgacaaaaaaatctagaaaagattattttaacagctctccttacatcatagccatttttcttggggtttgtacaggatatttgtgttcatttcttggtaatgggaatatggatgaacttatatttgaatgctcttgcacaaatgtcttaaattctattattgaaaaattataggtaaaatgcacacatgtgtatttatttactcaatttaagaaatatttactgggcagctactgtgtgcctagcactcttctaagtgctgaagtcacattagtgaacacaacagataaaaaccctgccctatgagagcttgtagtagagtgagatggtgataagtgctaagaaaaacaggtgctggaaagtgttgtagtaggaaagggttaaattttaaatagcagaggtctcctggagaaaggaacatttcagaaacttgggggagatgtagttatctggggaaaaaccattctaggcacagaggcagcaagcacaaaagccctgaggcctattgacttaaacgtttgtactttgaactctagtggtttgtttgtttgtttgtttgtttgtttttgagacaggttaccactctgttgcccaggctggagtacagtgctacaatcttggctcactgcaacctccacctcccgggctcaagcaatcctcccacctctgcctcccaagtagctgggaccacaggcgcacaccaccacacccagttattatttttattattgtatttttggtagagacagggtttcaccatgttacccaggctggtctcgaactcctggactcaagcaatccacccacctcggcctcccaaagtgctggaattacaggcatgagccaccacacccgaccagaactctagttttaatcaaacagctcagtaaaaaattcactgataatgctgaagctctactcccaatattttataatgtagaaagcaactcaaaataatatcaataacacactaatatgtctactttcttgaaaatatcaggatttccaaattctgatagtttctcagttttaaggcatccttccttttttgtttgcaagttggaacggtcaatggtaaatttaatgcagtgttttctttttattaaaaaataaaattaatgatatatatctaagttaaatttagtcttagaatcaaggatataagataccagcatgtgcacattcatatgagtcttgcagcattgctaggagttgtgacgtggctatgcttcttataatactgaattagaattcttggaaaattctagataacatgattatttcaatttatggctaccaaattttagtaatccttagaaagcgctaagtggcctttagctgtatgttaagttaaatatatgagatttaatgtcatttccccataaaaagcaaagaacttgcatttctggattgatttgcagcttaacgagaaggatttggttacccatcattggcccatactcagtacttaggaatcactataagggatgaatcagagagatattaaggtcatagaatctagctgactaaatatctgggaaagaccgaaaaggaggagttaaggataactctcaggtttctgatttgggtcactaaatagaattcatagttttgaagctgtgctctgtgtgtttgtttacgcttactctagccaagatggtcttttactctggtctacacctttggcttgtgctattccctgccatgcctaaaatgccctcttctctgtttatttaaatgctattcatcctttagtacatagctagaattcttttcttcctctaggaagtcttttttatctaccccaactgacattgacccacataaaaagatgacagccaaaggtcaggattcactttagttcttccctcttagccctttttctagcacaaccttttatggccctgatggtgagtgtgcgaaccttgtcttgtatatttgaggacggatgagatctagctactatatcatccctgaccttgcattagtcagatatctttgagtccaaatggcaataagggaacgaatagtcatctccaaactcccctgccccggaatagcacctgtcctaaatgaccaaggaaacactctacatgtcatttgtgtgaccatgctgtcctttggatagtaagattccaatcttccatcagtaggggaaaccttttgaactgttatttccagcagtggtgaaaggttgcactggagtgtctactctttcaacaaataccatgtattcataaattgcaatactaggagtttagtctccagttttcaaacacaggttttttcagatctaaagctatctggaacatgttgggatcaaaccagcaaactcggcatcagcaccacatgctaacccactgaacttttaataatgtgtgaactttctttaacaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtaaaacaatctcagtgttcttttcactcagaaaaaaaaaaaattataaacagccctagccttaagattttattatgtaaacagttttagccttaaaatttagtgtagttttaattaaagggttatttggtaaatgttccccaagacttataaatgagaatatgtcttttaaataaattgaatagctgtttctactctaggctagcattaagaatattatcttataatacaatacaattccaagtataattatttcatcagacataagtggtatgcacatggaacagtacaaattctactcttttcttcctttttctcaggcgacacaatttgtcctttcaccttgtaattgcctgaaattacaataactctatagtataatacagtaaaattattctctcttataaatgtttagttattccagtgctatgcaataaatttcttgagaactgctaggagcatatgtattcccaatagtgaaactcttcaaccagctaattgtttaggttgctgcataatatactgaactctaaattgtctctatgtacctataaaattatctgtccaattataattaccccattcacgtttttctgttatttctaattcctaatcatgtggtaaagtttctagcagttttcattgagcttatcaggatattacatttaaaatggcttttaagaaaggccttattatcttgggattttgtggtgggtctttctaagctgatgaaactcttgagtgtatgttgtttttgaacaagtcttatgagctgtgcctgatgacaaagtaatttggggcagtaacagttgctgcaaattgaacttgggtacctaattttataagagatgattttttttttatttttcccacagtccattttagagatgatatacacttgccgtattactttctacattggagctccttagactttcagtaatttcacatttcttaattagtgccctaacatgcagcttaaatatttgtgcactcatgtatgctcatgtttcatataatatccacttatgttacatgtcttctgctgtatgtctacactactattgatataaaataccagttcagtgttctcagctaattgtttagtgctagtgccagtattcttccagtagtcactaacatggtcatatgaaatatacctggtacccttctgacaacgcaggtaatatttgaaatgtgaaggacaagaatcactagggaagacaaattaattggtaatcacaaacaaagtggttcattttgagaggaataccatgtttttcatgacatagcattaataataatatgtataatataataataataataataatagtgttcatttaactctgtaccaagcactgtgcctgggcattttatatggtacagctaatcctaataagaatctcacaaagtgaaccttattatcccctatttatagataactagactgaaaatcagagagattcactagcatgagtaagctagattttgaaacctgatccgattccaaactttttctttcctttcatgattctcaactgaaagataaaaatagttacaaaatgatataatgcagtgtctcatggtataatactagtgtcatctttcaaacattctttatagtttcttttttattacaaaagctatacacattaataatttaaaaattcaaatagtacacaaaggtaccaggtaaaaatgaaagctcccctccttgccttcccaggtccagccctttccaccaactcactcacctattctcaggagataaccagtattatttgaactctttaagaaatgatttttgcttatgaaagtatgtattctattgctctctctctttctcgaataaatacacaaaaatggaattagtaaacatatggttctatatccagctttttccctttgacagtatgtctttgacatatttcatattagtatatagaaagctacctcattctttttaataactacaaagtattccactgtgtggatgtgccaaaatttatttgaccagtctcctactggtagacatttagattgtttctaaatgtttttgctattaacaaacagtactgcatgaatatccattatgtgttgtgtgtgtgtcaataaaatctttacacttgtttcacttaagataatgacctccagttccacccatgttcctggaaaagacataatttcattctttttatggctaaatagtattccacagggcatacttatacaagagatatgtaactttggtagatactgtcaaatggttctctaaaatggtgatgctaatttacactagaaccaaaagcaagagtgccactttactcatgcccttgtaaaaactagatattattggtcttactaatctatggtggatagataagcaaaaatatatattattattttgatttgcatttatcaatttctgagctttaaaatcttaatacatttcttggccatttatatgttttttctttctatgctggttttacctttcatttgtctctattttttcttaataatttgtaagttctctttgcatattaaagaaattaaccttttatcatgtgttacaaagatttttacccagtttgacattgtttcaatgggatgtttgttttggttgtttaagtaattttactcatatgtactcaaatacactagactttttatcttgtagctgctggttttatgtcatactcaggcatcactcaggtcaagactacatttttttgaattcactgtctttttccagcacttttagagcttcacccatatatactgatatatttttattgcgataaaacatacaggtcaaaatttactattttaaccattttatatgtactattcaatgacactaagtacatttacaatgttgtgcaaccatcaccactattcatttccaaaacgttttcatcatcccaaacagaaactctgcacccattgaacagtaactccccattctcccctctcccaatccctgggtaacagctattccactttctgtctctagaaatttgcctgtttttcattcctttttgtggctatggctgagtgatggtcttggacaagatccaggagaattctctgaactaccaggaagaaactcttgttttcttcccttattttctcccaaagatactctctctctctctctctctctattctgagccacttgaagctgaggctggagtgacacaagctgccctgtagccaccactatgactgcactgggtcagacctgaagccagcaccactctgagtctggcccaaggcctgctgtaaccactccctggctaccacctatgttcgccttatgccctagggctctatagtcaggcggtggcaaagccagacaggcctgtgaccttcccttcagtgcagctagttcctccagtccacaagcaggtccagacgtgccatccaggagccagtgactagagtcaaaaatcttagacgtctacctggtattgtattgcactgtaggtgagctggctttcaaacaatacacagtccctccccctctttgcttccctttccaaaggcaggagggacctcatccatggctatcagcaccacaggcctatggggagcactgccagacctccaccaatgtttgcttaagacctatgggctcttcagtcagcttgcggtgaatgctgcctggcctggcactcacccttcagggcagtgggctcccctctggcccagggcaggtccagaaataccatctaagagccaagtcctggaatcgggaaccccaagtgcccacttgttgctctacctccctgtggctgcgctggtatctaacatgcaagacaaagtccccttttccctctgcttttcgcaagtaaatggagtctcaccccaaagccaccacagctgagaatgtgctgagtcttacctgaagccagccagtctcagagtctcacccaagatccttgacatagtacctgaggtatcactgcgggttattcagggcccaagggctcttcagttagcaggtgatgaatactgccaggattggatcctttccttcaaggcactgggttccctcctggcctagagtgtgtctagaaataacatctgggagctaaggcccgaaacgatgtcttcacgactgactggtgccctatcctgctatgccctatcttgctgtgtcttctttggagaaatatctattcaaatgctttgcccatttcttccctctcctctcctcaagcagaaggaaggggcctctttgggagccatgggctgtgcagcctggggttaagggaggggtgatgccagcacttccttagacacgctggctgatgtctcagtaggttgtgtctcccccccatccccccccacacacacacaccgcccctggtacactgtctctgagtccagttcagcactaggactctcctaggagctgcagtccttgtagcctagactgcctttccagtttatttaggacctcagagcactttagctcatggtggtgaggcttgtggactgctgggattagtgattcctttctagctagtgctggtttcaatgctccatccatgagcaggcatcagctgaatttggtccacttttgctttctgctgtaacaagggcagcactgagttcaatgcctcacaattgctggatctccctctccccagggcacagaaatgctctctgtaccctgccatggctgcaccggggtggggggtggtattggtgattcaggagtgttttttctacctcttcagtgcctctttcagtgttatgaagttaaaaccaggtactgtgagtgctcacccgacttttgattcacatgaaggtgttttgtgtgtgtgtgtgtgtgtagatagttgttaaattaatgtccttgccaggggaggggtgggagacgattggtggagccttctattccgccctcctgctctgcctccaatccctcaacttgatctcatttcctttggatacatacccagtagtggaattgctggattaaacggttattctatgtttcactttttgaggaactgccaagctttctcatagcagctgcactattttacattcccaccagcaatgcatgaggattccagtttctctacttcttcaccagcacttgttttctgttttgttttgttgttgttgttgttttaacaacagcgatcctaatggatgtgaagtggtatctcattgtggttttgatttgtttttccctgattacaaatgatgtgttaagcatcttttcatgtgcttgctgcccattcgtatgtcttctttggagaaatatctactcaaatgctttgcccatttctgaatttgatttgggtgatgttgatatggcttcatctttacaacttaaaattttaatccatttggaatttatttttgtgtaaagaatgagatagggatctttggccaggcgcggtggctcacgcctgtactcccagcactttgggaggccaaggcgggcggatcacgaggttaagagatcgagaccatcctggccaacatggtgaaaccccgtctctactaaaaatacaaaaattagccagacgtggtggtgcacgcctgtagtcccagctactcaggaggctgagggaggagaattgcttgaacccgggaggtggaggttgcagtgagccgagatctcaccactgcactccagcctggcaacagagcgagactccatctcaaaaaaaaaaaaaagagtgagatagagatccagcttcatatttttttccaaatagccatttatcccaagtcatttattgaatactgattactgatatgatatcctacttggtgtcatctttaactttgaagtccaaggatatcattttggaagtacagcatggtatggaaatgttttaacacatctaagaaaacaattttattattctctaggtaatcaaggtttcccttattagtttcagagacaggaataccacactgtattacaatatctataggactatgctcaattacaaagcaactctaaagtcacagacactttaactcaagaagtttatttcttgctcaagtctgatgcaatcagtcatcagctctcttcccaacagcaattcacgaatccagtctgcttccatcttgttgctgcctaagcaggaaaaaatggcttctagggtcgtcaaggcagaggaagaaagatgaaggagatgctggcttttaattatgctggaccagaattgacacattacttctacttgcattctcatttgcaagaactaagttacatgatcccagcctagctacaagggaagccaggacactgttttttcctgtgaccaaagagaggaaatggagtggagaacacatagtgttgcctttgtcacacttaacttatgcatttgtaagcttcctaaaaatgtataatttttgtaattctagcaatttaaaatgaaccgaagagtagctcgttttattaggtaaaatctatagtcctttttaaagaatttttatgatataaatactatcctaatttcataataggtttccttaagtaaagattatcactgctaatatttaatgagtgtttgctgtgtgtcaactaccattctaaatgctttatgtgtattcaatcctcaaaataccctatgatgtaggtactagataagcaaattgaggcatagagaagttgtcatttgttcaaagcattacacaactaggcagaattacctgaacagctgaacagaagacttatttatattttatgttgtggatagaagtaagtcattgttcataaaagtcaaaatacgataacaattagaattatctgttatcatcagatctcaagatcttgaaatctttccaaagcatctggattaaagtccaccccactcaaggcaaaagaaaattatatagtactaccagttgtaatcattatgatttagtgaacttatacaattttaaatcattaattagatcttttgataagtctagcagagatggatttactgtgacgctaatgtagcctaaatttgcacaaatcccttctaaaacccatttggcattcttacgtattttgtattttttcattaaaaagtgcccccaaatagtatacccttggggtcccacaaaacctggatctactactatattttagcacagttttgtagagatgtagctctagcataaaagattaaaagcatatgccttcatgccagcttgtctggataagaatcaccatgtgactttgcttgttacttaacctctaattgttttcattttcttatattgaaaataaagtatttttatgcgtagccactaaagtctgtgatgcattatcttagcagtagtcagctagtgttttgacagtttccttaaacacctggagcccagaaatgaaaaagaaaaaatatattctcccagtttttgtaaattgacctggagtggtggcactccttcgacacttagccaggccatttacaattctgccttagccttcacttcctgcttgctcagagcatgaaggtcagccacagatgagtgattagagtcttctcagcctttttctgaccatatgtctgccctgggtatgcatgtggccttcttgattccccgttgtacaaaggagtttttaaagcccactttacaccacatatatcttttctcagcttcttcctgcccaggattttttggtttgcttcttgcttgtcccaactttataacctgcccagctgcactggctactatttttgtctttaaatgcgttcagcaatgccaccaccagaaaagccatcccagctgtgggaatgctccaaactgggtaaaacaaaagtaaacccttgcatcttccttgagggagctactgtaaagatgagaacacacaaccacatctttgagaataaggtctgcattgctccctttggtactagcaacctgcaccagaagtgcaagcagccatcttcatgactgccccttatctgcggagtgaggagtgataggcaggcaatttaaaataccacagcacactctacccaccgtgtagcagtttatttctttattaatttttccctagttgctctaagtttttgtctagattctagagttctgcaaaagttgattctaagagtttttgtcagcttataagatgctttatagaaggacagggccctggaactcgttactctgccatgtcactcacctgatccattttttttttttttttctgagaagcgaattgtcttactggagacctgatacatttttcacagagtttctcaagagtatccaaagataagttttaattaataaagccactttaaaggaaatacactttaaaagatgcatcagttacacatatacacatatgtatacatatatttatgcggtaaaatatataaggcaaatacagttttgctttatggcttatagttttacaaaaatattgataattgaatttcaaaatagaaaactttatctttgcattcctttgaagtataccaataagctatttatttggaaccttacaaatgaccttgaagatatctggatttattttgctccaccaagaacaaaacaaaaacccgaaaactaaatgtggcttttgaataccagttcatgccatggcagttttggtgtatctgtttgatatgttcacctttatctgcagaagttgccatataattttggtaaatgcatgtaataaattggagggaagagggagaggatggggcacagtgttaatattataagaaaaaaattaacagcttatgtgatactaaagtcaagtaaatatttaactattttacagtacttaccatctgctttttacttttaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgcaataac

SEQ ID NO: 1617 - DNA, 67515 bp, Homo sapiens; identical to SEQ ID NO: 1616

SEQ ID NO: 1618 - DNA, 107367 bp, Homo sapiens
tacgctgcaaacattttaatgattattgttgagcatacattttggaaattttttacttcaaacggcaacaagttaaataaatgtttataatatacaaagaaaatacaaccgaaagtaaaactcgctgtaagtgtgccttgcacttagaccaggttttccccccttaatacatctttatttttgagctgcaaacacacttaagactttgatcttcatagtatggcatttaggaaataaaaatatactcccaccttaaagaaataaaaagtttggtgcatgattatatgccaaacaaagagagaacactagaatactcttgatagtgcaggcatcattaaaaaggaaaagaaaaagcttgagatgctcattaattctctatgttttaaggaagcaggatttttgaccaagtagcttaaaagccagcaaaacagggatcagtgacagcaactgtagtgtatggagtatgaaatgacaaactttacacaaatacactgttagaaatttaccagtgaacactgaagatctgagaagctgctctttggaacagtcaagtgggaccaccttattccagtcacataagcccttgtaaagtaacacagtgttctgtgctatatacttgctggctgggtagttacaggatttgttttgtcattagcagctaaaaaacttattccacatgttcttaaagccttaatggtggaaaaaaaggcaagtgtcattagcatggtggatcatatacttctctgcacacaaacacaagaggcttcactagtatttttaaagtctctgatgtctcccattgcacttcaaagctcaattgagatgaaagcctttctccattgtagcagctagcaggcgctctctcatgatctcctcggaagaatattcaggcaacttaaggtaatgcacacatgtattgactgatggatagcttgcatcagtagcatcaacctacaacaagaaagcaaacacaacagaagaccatgagtttaaatacttctttctttcaaaagtaaagtaactaaatttcatttggattccccattagccagagagcttgtaccttgcgtacaaccgtgagcctgggatgcaggttagccagtccacctgggggtagagttgaacaaccagtggtaaactgcaagaatgctttcctttcatcagaagacatgccacataaaaccctcacaaacctcaggaaaccagggctaaaagaacaaaaatatagttatattgagttgactgcagatttaaatgaaaatcactaccactattttctaaggcagcaacaagccccctaaaaaacaatatcctcacaccagaacaacaacacatctagagactcttggttaagtatgaaatgggctaatataagctactttaaaaatatcccgggccaggtgtggtggctcatacctgtaatcccagcaccttgggaggctgaggcgggtggatcatctgaggtcaagagttcaacagcagcctgacaaacatggtgaaaccccatctctactaaaaatacaaaattagctgggcgtggtggcgcacgcctgtaatcccagctacttgggaggctaaggcaggagaatcgcttgaacctgggagatagaggtttcagtgagctgagattgtgccattgcattccagcctggacaataagagcgaaactccatctcaaaaataaaaataaaaatccctcaaagactgtcttgaacttacaaattgtaagaactaaaaaatactgacagtgtatggggtccatctattctgcaacaaagtcagcaaatcataaaaacacaggatgcacttgcaaaatcatttcaaatatggataaatataccaaaggggatctgaaataatttttattccagcaaaataattatcttgtgataaatttatgtaatgaaatagtaaatgaacgacatgccacaacatggataaatttcataatcataatattactcaaaccagaccacaaagaaaacagactacatgatttcatatattaaaagttcaaaagcaagcaaaactgatcaacatatggtgattagattaatagaaaagaatatggtgggaagggggatttttgaagttgtttcatattctggataccaattatacaggtgtgttcattttgacaaaatcctctaaactgtatatatgatgtgtgtacttatctgttatattcaataaaaagtttaatataaacgtagtatatagcccaacagcttacaatttaccaaattttaaaaatgaacaattaaaacacaatgaggaaaggaatcaacatcagccatgatgtcagttgtcttttttttttttttttttttgagacagagtttcactcttgttgcccaggctggagtgcaatggcatgatcttggctcactgcaacctccacctcttgggttcaagtgattctcctgtctcagcctcccaagtagctgggattacaggcgtctgccaccacgcccaggtaatttttgtatttttagtagaaacgaggtttcaccgtgttggccaggctggtctcaaactcctgacctcaagtgatccgcccgccttagcctcccaaagtgctgggattacaggtgtgagccaccgcgcccggcctgctgtcagttgtctttttgtatcctcccagccttatcagtggatatgcattctggtaactgtgagacaccactgctttctcacttactttatgatactcactgaattaaagttctttagagaatctgtcatttgatttggggaatataaataattttgttgatcttggaaaatagtatcacatacctgtcacgtgtataacccagcttaggttcagtgtaattgataatatcctctgctgcccaggatggtgactggtttccacaaagaatcatttggacttcttcatggctgaaggaacttaatttctccattggaaaaactttattaaacccatctacatcgtacatgtaacggaaacacaaaaaacaaacatacaactcagtttccaagttacgattccaaaataccaaatttcaaaccaaaatacccattatcagaatcaatctaagtatctatcaagggatgaatgtgtaaagaaaatgtggtatatgtacacaatggaatactatgcaaccataaaaaagaatgggctgggcacggtggctcacgcctgtaatcccagcactttgggaggccgaggcaggcagatcatgaggtcaggagattgagaccatcctggctaacacagtgaaaccccgtctctactaaatatacaaaaaattagccgggcgtggtggcggctgcctgtagtcccagctactcgggaggctgaggcaggagaatggcgtgaatccaggaggcggagcttgcagtgagccgagatggcaccactgcactccagcctgggactccagcctgagactccgtctcaaaaaaaaaaaagaatgaaatcttttcatttgtaggaacatgggtggaactggaggtcattatattaagtgaaaaaagccaagcacagaaagacaagtatcacatgttcccactcatatgtgggaacttaaaaagttgatcttggccggacaaggtggctcacacctgtaatctcagcactttgggaggccgaggtgggcagatcacctgagggtgggagttcgagaccagcctgaccaacatggggaaaccccatctccattaaaaatacaaaattagccgggtgtggtggtgcatgcctataatcccagctactcgggaggctgaagcaggaaaatcgcctgaacccaggaggtggaggttgcagtgagccgagttcgtgccatcacactccagcctgggaaacaagagcaaaaactccgtctcaaaaaaacaaaaacaacaaagttgatctcataaaggtaaagaaaagaatggtatcagaggctgggaatgttgcatgtgggggtggatgaagagaggtagtttaatgggtacaaacttacaattaaataaaaggagtaagttctaatgttttctagcatagtagggtgactatagttaacaataatatatatttcaaagaagctagaagagaataatttgaatgttcccaacacatagaaatgataaatgtccaagatgatggatgtcctaaagactgattttatcattacacattctgtgtatcaaaatgccccataaacatgtacatatattatgcaacaataaaaaaatacccattaccgatgaaatggacagaagatgaatattcaacattcataaatgtttgaataaacaagcataaattaagacagcttgaaattaaaactgtattttaaattagaaatccctgcttaacatcacaaacgtgaacagagagagaacattcagttgctatggtcagtatgcaaattcttattactactcagtctggagttcaccagctctttctgtcatacaagtcaggcaaaactgtgttctcattttcaaaagtaatttaccttgtaatatactttgttcccatcatgattctttcatgttaattcatcctgatcaagtaatctagaatgtatgcaacctatgtccactttctttctttctttgttgaggcaaggtctccctctgttgcccaggctggagtgcagtggcacaaacatggctcactgcagcctcagcctcccaggctcaaactattctcccacttcagccttgcaggtagctgggaccacaggcacgtgccaccacatctagctaattttttaaaaaatgttttgtagagatggggtcttgccatgttgcccaggctggtcttggaactcctgggctcaagcgatcctcctgcttcagcctcccaaagtgctgagattacaagtgtgagccaccaccacacccgcacacccgaccaccatcaattcttttttttttttttttttttgtgcagcggagttttgctcatcgcccaggctggagtgcaatggtgtgatctcggctcaccgcaacctcacctcccgggttcaagcaattcccctgcctcagtctccccagtagctgggattacaggtatgcgccaccatgcccagctaattttgcatttttagtagagacagggtttctctatgttggtcaggctggtctcgaactcccaacctcaggtgatcctcccgcctcagcctcccaaagtgctgggattacaggtgtgagccaccgtgcccagccgaccaccagcaattcttgaccataatttcaactgtctcaaagtgaaaggagagcaattatgctaaaaatcctttaaaattacctctaaaggcttccatttgtttctgaatacccgtatgcatacaaaagtcaaacatcaaatccacatattcttctgcattatccattgttatcatctgcaaaagaaaatttgtcagtatctaggaatatttcaggagtgtctagtacaactggccttgctaagaggatatgtcagaacttacaactatattaaaagcaaactttttacctcatcttcaccacttggcttgagatccacagctgtaaaaccatatattcttgaggaagggcaaaactggaaatttaaactgggaggacaaaaaagattaaattaactgacatgcagctactactaatggtgtttaatttttataacattactatcatctgccatcagtgggtacaagagaaaaaattaaataaaataacatggctatcaaaaccataaatcccacccctctcctcctccaacaaaatcagtacaccagcttagaagtaagttgaggactttttaaatgcaatattctatggacaaaatctactaggccaactgttatcaaatctgtctggctttgcaaagattgcatgaaaccacctttctatattttacttctaacttatggcacaaaattaatgaactaaaaattttgcaatgaattatgacagcaacatgtttgtaagacttttaggaagaaactgttgctttactgaagtcaatcacgctgtgtacaaaaatatatattaaaaaaaaccttgaatatataaccatttatcaaacacagtttaccaacattatcagcaaacattaaaaaaaaaaggccttgcagttaacctaaaatcacagctgaagatatgataattacctgtacataaagtaacagagttttatcaaaagttctgcagcatctcaactgctacagcctttggtgataaagctgacataccaaccaatttttgagctttgcaaagtgaatcatatattagcagatgaatttgtcaaaatattgttggctctggacattttacacaggcatataaattcacattggctaagtcaggtaatcttctaaaggtttgatgattaataaactaatattctagtattctgagtgttgtctttataatattaaatcaaaggttcaagtcgatcatcaatatttcctacagcatattactgtttttgacagactatttactcatatattgcaaatcagtgacgacaaagaaacaaaagctttaaaacttattcatgcattggattgaagaatgtacatataatgcttaccctaaatcctctatgctaagtggaggcccagaacctgatggattcttcagcactagttcctgtaattttgtgttcttctcatcttcagaaagacctttgttgcttaaaatttggcgcctcttgatagcaaggtctttaatttcttttaaaaatctggctctgtgtgggtttactaattcaaagtcttcccaagtcaaaattccattaaaccaagctgggggttttggtttagggggatcaagaataaattctgattttgaatcctcttcaaagcttcctaccgagagtgaatcatgaccttcttctgtagaagcttcagactgactttcagtacagtgtaagtctctatcacctcgtgactcataaatcagtttactcatattgcttttaatgtcacccatacacataagtttaaaaaaaggtttagaaataggtaagtccacaagtctattgtcttgaatgcatttggccaagaaaattccaaggaaatgaaacagtttcgtgatcctttcaagctcatcactatcctgtggaaatggtgctgtgaacagtccacatgacctctgcacataatatccaggaggtttcaatccacctccaagatcaacctaattttttagagggtgaaatgcaaataaaattaaacaaaagttaatagaaactaagcctatcatcatctaagaaaaaaatccataaacattaaacatcttcatgaatttggctatctaaaagtatataattttattaaatagcttttggtgactaaattttatcgctttagaactattttaattgcatcaagattattcaataataaaagtagagtcagaaacctggcttatgctctgaacacataacctatttttaacacttttgaaagcagagtcacaactcaagtcacaaaatgagaaatattcttacgtgacgagattcatcatctggaaaattatcatcacaaagccaagctcccaagtcagttctctggaattctgctgccaccagagcataaaactctaatgtgggtcccaagccagttccttcttctcctaaaaattcaacctaaaatatgaacaaataaattgtgggttaaacgtaaagtttggggtgtttttaaaaataatctaattcttgtcaaaatttatcatatctgatccagtaatgtaccttttttcaaaatagcagtgtatatatataataaacagcacagaagtgttattttaattttcctaaagagtccacttgttgtacactattacatgcttaagcactgtgccaagcatcattcatacatttacttctcacaacaaccctgcaaaataattatttcctttttacaccaaaggaaaccaaatctcagataaggaggttaaatcatttgcttgaagaaatgatggtgaacagacttttgtgtgtctctgtgtgacaccaaagcctagactcttccactttttaatttttattttttgagacagtttcactcttgtcgcccaggatggagtgcagtggcacgatctcagctcactgcaacctctgcctcccgggttcaggcgattttcctgcctcggcctcccaagtaggtgggattacggcatgcaccaccatgcctggctaattctgtattttcagtagagacagggttttactatgttggtccggctggtctcaaactcttgacctcaggtgatccacccacctcagcctcccaaagtgctgggattacaggcatgagccactgcgcctcgcctcttctgcttatttctgagttaaagacactttaaatcatttttgcaacaggaagagtatggacaaaaacccttaaagtgattgcataaagtataataaaaactacagcatatggttaaaaaaaaagattatctatattagaagaatgtaaacaactgggcatggtggctcaagcctgtaatcccagcactttgggaggccgaaacgggtggatcacttgagcccaggagtttgagaccagcctgggaaacatagtgagaacttgtctctattaaaaaaaaaaaaaaagaagaagaagaacataagggtaggaggaatacaatgaaagtctgtatataaagtgaaagatgtaaagccttggacatcttctagagatgtatcatatttcttgcaattagtttatgatccaaaagttaaaaacaaaccagttggattcacccctgtgacaggagacgtatttccactcttcctcatatagggaatactgtgtatatgaaataaaaccaacaatgtccacagtaacatttctaaactaaatatattaaatgtcatactaccatttgctataacatgtctcaacacagaccagtgatataataccaagcacaattcaagtgaaacaatattacaaaaccaggtgctcccaaaatatcaaacagcacagtttaatgtaaaagtaaaaaagaatcccttgtgagtactactattttagtccaactttgttatgaaatgggtagaagccctcaagcagaacaagcactttgccacctcaagagtggagatcttctttgttgctcattaatggcacaagacctaacccctaaggaggtggactgacatcctcttatgaaaaagatgctctgccagaggagaaggcttctgcctacagaacaggaaaacccctcttcatgtttacctaccacagtttttaatgcagtgaagatacacattgggctggttccctaagtgtcattcctgttccctaaatctaattttatatgagattacctcaagaactgatttccgatctgcatgtatttgcatgacattctcagcccattccatcagtgactcgccacgtggaacttttactctttcatgcttgagacgaccaactcgaaactctccagggtcatctcgcctaacactgcttgtggttctcgttcgctccacagtggcttcacgtcggttctgtaaccatactattgctctgaaatagaaaaatatctatgagctgcagcatacgttaacagctgaatgtactactaaaccagcaacagaattcaaagatttaagaaattaaaaaatagtattttatcaggtgatttttaaaacacagtaatctttttttgttacataaactgcttcctgtcacaagtaaaaatatatgaaactccttttattataatctgccttaagcaaactgagaaagtactgggtctatattttgcctccttattttagcagttcaataaaaataataatctgttgtccaagccccaacatcattcaaaaaaaggaaaaatgtttcctatcagagaaatttagaaatgattaagctatctttcaaactgaaagccgccatcaaaacggtaattataattttaaaacaatttttcttttttttttttgagatggagtcttgttctgtcacccaggctggagtacagtggcattatctcggcccactgcaacctccctatcccgggttcaagtgattctcctgcctcagcctccccagtagctgggattacaggtgtgtgccaccacgcccagctaatttttgtatttttagtagagatgggggttctgccatgttgcccaggctggtcttgaatttctggccttaactgatccacccgcctcagcctcccaaagtgctatgattacaggcatgagccgccacacccggccacattttcttttttttaataacaatccatttatggtgggaggaagaaccgacaattaggaataagaagctgaaggttctactctcatgtgtgctactattttctcatgatcttaggcaaatcagctaagtacgtgcagaatcaatttcctcatttataaaacaaattataatcaatgccagttatcacaacatgcctatagttctatgtatataaatgctttgtaaatggcattaaatggtacaaaaatgtaactatcagggaagaaaacaaacagtttaaattataactttttttttacaactattttggaagagtacttaaggtaaacaatcattcaacaaaatatttattgagcacctacaatgagtcttgctctgttgcccaggctggagtgcagtggtgcaatctcagctcactgcaacctctgcctcccgggttcaagcaaattcttatgcctcagcctcctaaaaagctggaattacgcccagctaatttttgtgtttttttgtagagatggggttttgccacattggccaggctggtctcgaactcctggcctcgagtgatgtgtctgccttggcctcccaaagtgctggaattataggcatgggccaccgtgcccagcctgaaaacagaaactttttaaatgcttttttttttttggtaaattacttcttccatgattagagggactatcttcaaagtagtacaaatatttcgtaaataatatctgaccattttctaaccaattgagtaatttgttgcacaataagccatctcacatctttcagcaagaaatacattaaatttgaatagtaaagacattacacaattaggcttaggacaaaattaaaatttgcctgaagtatttctttgggggagaggacaccacacttctactcaaggaagagaaacatttttacagtccagaggtcttttatttttatctttattttttatttttttgagatggagtctcgctctgtcgcccaggctggagtgcagtggcacaatctctactcactgcaagctccacttcccaggttcacgccattctcctgcctcagcctcccaagtagctgagactacaggtgcccaccaccacacacagctaactttttgtatttttagtagagatggggtttcaccacgttagccaggatggtctcgatctcctaacctcatgatctgcccgcctcggcctcccaaagtgctgggattacaggtgtgagccaccgcgcctggctattttttttaaacactattatgcatgaattcacagagaagaggttccagcagctcagacttctttcccttggttttcacacagcgcgcttctctgggtggaacaggctggcacttcagctaaatgcaggtacctttctctttggcttccttctttttctgatcattttccttcatgtgtttcaggaagctatctcggctcttagagtgcttaatgtgctcaatatgcacattaattctcttggtaagaatcttgcccttgtttgtttacaacaatgccattagccacgcgtggtggcgtgcacctgtaatcccagccactcagtggggctgaggcaggagaatcgcttgaacctgggaggcggaggttgcagtgagccgagatcacaccactgcactcctgcctgggcgacagagcgagactctgtctcaaaaaaacaaaaacaaaaacaaaaacaaaaaaacagcaatgccaacagcctgctgggtaacactgtagactcttccagtttagccacggtaacacttgtggggcattcctttttgaacagtacccattcccttaatgtctacagtatcacctctcttttagatttgcatatacgtggccaaaggaacaactccatgttttctaaaagacctagaaaacatctatcgggtatctctcctcctttcctttggattagtcattttggcgaattactagaagattggtagttcaggccaaaaggcaatgctgactattctttataagaatacaagataatatattccctctatcagtcttgacagtatagttgtacattttcaacttacataacataaaagcatacttattctaaaaacataaaaaaaaggcttcttaccttgaggcgccaaatgctgtacatgtgaaataaagctgtctagtttcaaatggtattagaaaaggacatttgctggttaattgttcacaccagtctggcagagccccacttgccagtgccaatggttcctgcgaattaacaaataataatgtcttagtgctataaggcattcatgcatgcatgcattcattcattcgttcatttttttttttgagacagagtctcactctgttgcccaggctggtgtgcagtggtacgatctcggctcactgcagcctctgcctcctgggttcaagcgattctcctgccctagccacccaagtagctgggattataggcatgtgccaccgtgcccagctaatttttgtatttttagtagagactgggtttcgccatattggccaggctggtctcgaactcctagcctctaacgatacacccaccttggcccccaaaatgctggaattacaggcatgagccaccacacctgaccctataaggcaattattaaaaattaccaagtcaattataaacctgtaattaggaaataaatgcaaaggaccatatagctcaaattaccaatcagagggaagggaaagatggtgagaggtagaaaagaaagtaaagggaatattaggaaaagtccaacagtaatagaatgaagagttcagctgtctgattttattacctcaatctgctgtaatatttttgttgtaatttttttgctagtgaattcatctggtggaaaagtaaactgaagctgttcatcaccatctataaaattaattaataaaattaataaaaatataaactgacttgctttaaaactgctatagaaatgaaacaaggcttcttacagaccttcctgggatattcttgaataagggtcacttgcaactatatatagaatacgcagaagctgaaggacatcttctactccacaagagttctgtccattgcctgctttggcctgaggttgttcttttgttaaattaagaatatcactactttgaagagtagaaatggccccctggtttaacccagactttgttccatgctcacaaaaatcctatagaaacaattagaaaaactggccattaatcacattttcaagaaaaacagtgtatcattgtatcaataccactatgaaagggttggaattttttaaagtgccttctttttaaataaaaacataacacaagacataaatcaaggcattctaaaccattaaaattcccaaataaaatataaccactctaagccatggtcaaagtctgcattcagatccaatgctaccagccatatttgaaattttagaatttgtgcattaacagtgttaattcaacctcatttttaaaattatgtctcaatgaactgctgttccttaagaagcttccaaagctgcaaaacaaagcacgaagccatttgcaatcaaaatagtgttttgatgccaatatataccttatatgcagctatgagctgagaacaatttctgtttttcctaatacttttattagtgccagttaatttccagtggcgcaggaaagcagcgtctgcattcttctgcaggtaggttatcaagtcattctttggtaattcatcagtgccaaggtactgctccacatgctctatagaccagcaaccctacaacaggaaaaaccaaatgttggcctttcccaattataaagtctatgatatttcacatgcattacatgaggtagctttaagatcatgcacttggtctaatctaaagaattccatgttagtcattattcccttcaacgttcaactgcaatactgtgttagttttactatctttcttcttttaactaaatagccaagagtaaaccaatgttctaaaataacttaccatttttccattttccttttctttatcagaatccttcatttctctgtacatgattctaaacatgaagatattcaagttaattcatatataatttgtgattatttccaataaggcttcaattctttaaaaaaaaaagtgaatgtcattcactagacatatgcctgcactgaacactgaactcaaggaggattctttttttctatattttttgtagagataaggttttgctatgttgtccaggctagtttcaaactcctggtttcaagcgatgctcctgccttggcctcccaaagtgctgggattaaggtgtgtcacgacacccagcctcaaggagtatttttaagaaaaaatgttaatttgttaaacataaggcaaagtagcagaaaccatattcctgaattatgatttataaatttatcattattacaaagaaagcatgtatcaaatctagaacttttaaagatatgactgtatcaagtgttatgcagcattaggtgatctggtggttgtgaaacatcactgagtacattacacaaaacaaaatggtatagcctactatctacgtaggctatgtgttatagcctatttttcctaggccacgaaccttaacagcatatcactgtactgaataggcaactgtaacacaatggtatttgtgtatctaaacataaaaaaggtacagtaaaaatgtggttttataatcttatgggacccctgtcatacatggtccatcactgactgaaaagttgttacatagcacatggctataactgttgtaaaaatacaatgggataagaaacaggttctctgtgtctagatggaaagaaggatagaaataacaatgatcaggagtgcttatgttcaaataaggcagttgagatcaatttttaaactgtaataaaaattgaagggaggttttcctagctcttgggaacttggggaaaaaaaactgaagggcgggagaataccgttatgattttctgttctatttcaaaaggacctacattacttttattggccattacataagattatcagtgatgttaagagaacatcagaaaacatactaatagaagtgaagttacagtaagaatgatgatataatttattattattaaataacaattactttatagataacatttactgagcacttaatatatcctagggggtattgaaaacactttgcaggccaagcacagaggctcaacacctgtaatcccagcactttgggaggctgaggtggacggatcacttgagctcagaagttcgacaccagcatgggcaacatggtaaaaaccccatccctacaaaaaatacaaaaattagctaggcctcgtggtgcacacctgtagtcccagctactcaggggactgaggtgggaaaatcacctgagcctgtggagtttgaggctgcagtgagccatgatcgcaccactgcactccactgcactccatcctgggcaacagagagagaccttgtctcagaaaaaaagaaaagtaaagaaaacactttatacatgttaattcattaattccttaaaaccactctcattttatagattaggaatgtgaggcacaaaaatgttaaataaatttaccctaagtcattgatgattatttgtacaaagaaaggcaggtgttaacccacacacccccaaaatcaagaacagaaagaagatagttagtactcatacacgatcttagacaaagaattcaaatgacgctcttttcaacaattacgtaagaagctagtatagactgtaaatgtccttctacttctaaaacttaatcattctacaccaagagtcccaaacactattatctgttcctgtaagccaacagaataaaaacaaaatcttttctgttcctataatccaaaataaatgcaatgcttcttggctctacactaggacattatctaccaaaacattaagttaaaatttcttacgtgtatgtgggctcccaaatacgcctaagtttatctgatttcacattgccattacaggacaattgaagcaatttttgtacatagtaaaagatggttgatctgaaattggtgagtggtaattcaacttcacgagtcgttccaagacctgttactttcaaagtgagagctaatcgaggtgacggagtacattcgacttcttccaagagctctgaatgaggggtccctaaaaatttggaagatgggtgaaaaacaattatactaaaacaagcagtccaagaaaggccactacactaggaaacaaggctacatgaaatccaaacctctctgccatatattagctaaaggatgtcagctacttaagactctctaggcgtcgacatttttgctttctgtttctttttttttctttttttgagatggagtcttgctctgttgcccaggctggagtgcagtggcgtgatctcagctcactgcaacctccgcctcccaggttcaagcaattctccttcgtcagcctcccgagtagctgggattataggtgcccaacaccacatctggataatttttgtatttttagtagagacggcaggtttcaccatgttggctaggctggtctcaaactcctgatctcaagtgatctgcccgtctcagactcctgaagtgctgggattactacaggcatgagccactgcacccagcctgttttctgtttcttttgtaatggaaataattacacctacgttactgaaagagtgctagaacagaatacatgtgtatgatagagagctctctcatttttacatgaaaataatactaactgtatgaatacttcggaaacattttaattttataaatgaggccaggagcagtggctcatgtctgtaatcccaacactttgggaggccgaggcgggtagatcacttgaggtcaggagttgagaccagcctgggtaacacagtgaaccccgtctctaccaaaaatgcaaaaattagctggacatgatgatgcccgcctgtagtcccagctactcaggaggttgaggcaggagaatcacttgaacctgggagtggaggttgcagtgagccgagatcacaccactgcactccagcctgggtgacagaacgagactccatctcaaaaaaaaattttttttataaatgagaaaactaaaagtatccatactcagagaaaaccacatattctgggccaatgacgtgtcaaccttttatcacactgaataactgcatcatgaggtaaacacatatacacacacacatataattagtttcataatgtatttggagaatgctctcattttttattagctcatgaatgttttcttcattatcatgatcgtcttctaaaatattatttctttcactgcacaatatcccactgtacctaaacagaggcatatcccagttactggacataattaaggtcatttccaattttttgaaaatataaatacttctacagtcacctatgtgtacaaaacggggtacagagctaatatttaaaattaccaatggcaacaacactttgtcagaagatacaaaatatactggcagagagctctacaaaaagtttgtgcctatttatactctctagaatgtgttttccttttttataattcattttttttctctgagatccaaagaaacaagattttcctttttgaagggaccttagaacaccttgattcagtctatctatcctccccaaagaacatttatacaaccgagtatacttactttcatatttaatacaggtgtctttttttgttcgagacagagtctcactctgtcacctaggctggagtgcagtggtgtgatcttggctcactgcaacctctgcctcccgggttcaagcaatttctcctgcctcagcctcctgagtagctgggattacaggcgcgcaccaccaagcctggctaatttttgtatttttaagtagagacgggatttcaccatgtcggtcaggctggtcttgaactcctgaccttgtgatccactcgcctcagcctcccaaagtgctgggattacaggcgtgagccaccgtgcccagcctaatactatcaggctaaaaaatacactcctcacttaatcaacaatttaaatctttgttaaggataatttactgattataatagctgacatttattgagacacacatcaggcagcatgctaagcacttcacataccttacttcatttaagctttttaactaccttgtcaaacagggacctttattctctcatgtaagagatgaagaaattcaagcttggatagttttggtgacttgcccaatatatcagtttcctactgctgctataaaatattaccacaaattgggtggtttaaaataacacaaacttgccaggcacggtggctcacgcctgtaatcccagcactttgggaggccaaggtgggtagatcacttgaggtcaggagttcgagaccagcctggccaatgtggtgaaaccccgtctctactaaaaatacaaaaatgagctgggcatggtggtgcatgcctgtaatctcagctactcaggaggcggaggcaggagaattgtttgaacctgggaggcggagggtgcagtgagccgaggctgtgccactgcactccagcctgggtgacaaaacaagactccatctcaagggaaaaaaaaaaaaaaaaaaaaaaaaaaaactaccacaaatttattatctcatagttctagaggtcgaatgcctaaaatggatttgcagggcttcattctttctagaggctctagagaagaatctgtttccttgccttttctagcatctaggagctgcccacattccttggctcactgctcgtcgtcactctgactcctgtttccttagtcacatgttcttctctgtctcctgcctcttgtgattacactgtgtccacttggatgatccaggattatctccccttctcaagatccctaattacatctccaaagtctctttggtctgctttgataatatatcataagttccagaggttagaacctgattttggggagaaattagtatgcctaccacaatctaaaatagagttttgtaagggataaggttgtcacccaggccaactgactctagagggcatgactgtaaccactggatagcctttcaaaactgagaggaataaatccttagaaattttgatccagtagaaaatacagtaaaaatttcccacctttaaatgggactttgccttaaaaattgcacaaatacaaaacacatgttggtttttaaaatttgaaataatttgtaatttgctcctttaaaaaaacctttactttttaaagaatttgtggctgactaaaaaaattttttataacctgcatacacaaaactaaaaaaaaatttttaataacgtgcatacaaaagcaacaccctacttttcatatctgatttagtatgtattaaaattaaatcacaaaaccaaaacattctgtacctgggggtggtatttctagatcagttgtctgctggacattagtacgaccaggtctaggatcaaaagcaggaaccaatgcagaaaactgtctctttagcacataatcatcatcccatgttctccggcgtcctcctttagtttcgtactcttcttcttcctatcaaaataaaatttcacacacaaacataataagatgcaaaatttcattgttgcaaaagcaatgtgttatttagaactactgcatttccttagccatatttcttaaacccaaaatgagctaacctaaacatgtatagatacatacatttcttcatcatttcagtttacccaaagtaagttgcatcagtgatggttatacaaatctacacatttcaccaaatgataaccattcatggccagacatggtggctgaagcctgtaatcccagcactttgggaggctgaggcaggcgaatcacaaggtcaggagttcgagaccagcctggccaacatggtgaaaccccatctctactaaaaatacaaaaaattagctgggcatagtggcaggcgcctgtaatcccagctactcgggaggctgaggcaggagaatcgcttgaacctgggaggcggaggttgcagtgagccgagatcgtgccactacactctgtactccaccccgggagacagagtgaggctctgtctcaaaaaaaataaaaagataaccattcacaaacatcctcaatttcctggctttgttactatactaaaattaggtaatatgaaactagccaatggcaaaaattaggtaaagggcacataagacctctctggagtattttcgcaacctcctatgaacctataattattttaaaataagttggtttttaaaacgtaaattacattttgtactgaattacttatataccaaataaaatgctggggagttgctttaaattactatgaggcagacagcatgtaagtacacacgtgcacatccacagtttggtttaaacacttaactgaaacaaactgacatttgacagctctggtttcagaatgtttgggtttgcatcctggaaccaaaactactattacatgtatgacttttagcaattacttcatctgaaaattagggctaacaataaccctaaaaaggttgttttgttggaaagaattagttaatatacataaagtattaagaactatgctggcaaggcacagtggctcatgccaaggcaggcagattgcttgagcccaagagttcaagaacagcctgggcaatgaagcgaaatcctgtctcaaaaacaaaaacaactctagcacttagttagtgatcattaagcgttagctattaataaactactactgctgcatctactaccacttctactactactaaaactacaaatcttagataccatatattaaccattttaatgtatgtttactattacccaaagcaacgtaaaggggtttcaagcattaaactcctgcatgcattatgtcacagcaatcatggattctatatagaatatgaaacccaaccagtaggggaagtttctttgtgtaactgtttggtagctccctcctctcaccccttccacactgcacatttttgtaggcatttaggttggtgctttactataaaagggaaaaatatacatatggtagggaagataaacatgaagatattacctgctccccaataggtcggctccctgctccagcaggtacctgtggtagctgcgaggtaacagcatgatgcgttacatcagagcgggagccagctcgacgttgcagggatgggcgtctcagaatctaaaataaaacaatcccaagagatacatgtctaattatttgacccatatatgccccctttcagccatgacctgaatatattaacccctattaacaaaagtgtcactgaaaactttttcattagccaacttcagaaaagttatgagttcaatgttttaaattcatcatgcattttatactaacctccttcataagaagtattgtgttttcttagcaaccatatactaaaagcattttttaaatttctttactccattaaaactcaacttatcaatttttttgaaatctagtaacattttataaagagaaattttaaatttacagttagttacaataaagggtattttttaggcacaattttcagttagaagacaatcctagtggttaaatattgagagttctggatcacattgcctatgcttgggtcctcactcttccacttaactctgatgataagggcaaattttttttttttatgcctctacttcattccttcatgtgacaactaatgaaaaaacagatggaccctgcttgcaaaaccataggtactaaaaaacaaactccagggccacttcagcctcttgagtagctgggattacaagcacaagccactgcactgggtaagttcatacactgtgtgtgtgcttgggtgtgtgtgtgtcagggtctcattctgtggctcaggctggaaagcagtgatgcaattatagctaactgcagcacgagccactgcactggctaagttcatacacacacacgtgtgtgtgtgtgtgtgtgtgtgagattctgtggctcaggctggagtgcagtgacacaattatagctcactgcagcatgagccactgcactggctaagttcgtgtgtgtgcgcgcatgtgtgtgtgtgtgtgtgtgtcattctgtggctcaggttggagtgcagtgatgcaattatagctcatggcagcacgagccactgcactaagttcatacacgtgtgtacgtgtgtgtgtgtttgtgtcattctgtggctcaggctggagtgcagtgatgcaattatagctcactgcagcctgcaactcctggacccaagtgattttttacctcagcctcccaagtagccaggactacaaatgtcaaagtgtgggactacagggcatgagccctatacccagcctaatttcacacccttttaagcctgttaaaacatcatgtgacattctaaaatttttcaaatataagcaacttattttctttaagtggagaatcataaatgctcagattaaaactgcttttcttaattaactacattttttatactggtgccacatttccttgcttcaaagtttgattatgacttagcttttcctttcttcatttcaattattaacatcctatctttgtaaagagaatggggtactctctctaccataacctcctcgtattcttggtcctcctgattgtcatcttcattctcatcatcttcttcatctggctcaggtaagtcctcatcatcatcgagctcagccaatagagtactggcacggcagctatcaaggaaatcttgaaaacaaaacccacaaccttatgtcaacacaattaagaaagcataacaaaggaactttgcattttaggtttttacaaaacaaaagtaaaattcaaaagggacaactgttgcgttctgccaccacatacaagatgagcacagacacaagcatgacaaaaacaagtgataaaggacaaccataaactaaacctgaattacaaaatcataatataaatggataaccatgtggggctatttaaaaaacaataaccaaaaaaacaaacctttacaacatgtaaaagatcttacgaggaaaaacagaattaagtcaatcagtgaaaaacggggcttagatatgtgacctggtaggttacttaaaaacaatgactacttaagataatgcctatttactacggaataatgtatgtggcatctttcatgttatccatattatctagcacataaggaagttcaaaacaacttgcatcatttttatctccttccttcttataatctcttgccttcgatggagactgggtcaaattacattgtcctgcataaatgaagatgctgacaaactgttcttcataaaaactgaaaaaaagaggactaaagggattataacagaagtttttactggatctggaaaaaatagtaaaatataatatcagaattgcacaaaggatagaaaacaaaatactttatattcctgaagaacatccagaagacaatttataattgctcagaaacttacacctgcagaccactgaaccaaatggtttttagtccaataattacacaggactaaatattcagtgccttttactggatggccagtagaagaggcctgccattatatttcattagtttctaagggtccacatttttttgctgttatcaactttctcaggttgaaaggtctacatttttaaaacattgtaatgctttgaaatcggaatgtatcttacaaacaatggcaagtcagaattaaattgcaacatttttaaccttagtaacagaaaaaaaatggtgtgtcttaacactcaacagcatcttaaatttgataaaatatgttaccctttaacacttgtaaggagccacctgcaatttaggaactggttgtgattaacatgatgtggtggtacacaaaataaaccagttccactttgatttgtcttttaaagaacataatctaacttcatatattgaaattctatctccggtatgttacaactgactgatgtccctttttttttctcatcttcccttttttaccagcattaaaaagctctgtatttcacagatttgaccacatcatagaataaaatgtctcttcaaaacacaacatggtatagtattcgtgcctgcggtaagagaaaaaccacaaaacacagtaaaagcttgcacagcatacacaaatggtataaactgatgttactctgatccttcaccccagcagtcttaaagtatctaccagctttaagaatataaaaaagaaaatcttctatcatatgttctcacttataagtaggagctaaaccttgggtacacatggacatcaagatgggaacagtagacactagcgactccaaaaggagtgcaagagtgggcaagggctgaaaacttcctattgggtactatgttcaccatttgagtgataagatcaatagaagtccaaatctcagcatcacacaatatacccctgtgacaaacctgcacatatatcccctgaatctaaaataaaaattatattaatttttttcatcatctaacaataaattttttttttttttttgagatggagtctcgctctgtcacccaggctggagtgcaatggcacaatcttggctcactgtaacctacacctcccgggttaaagagattctcctgcctcagcctcctgagaagctgggactacagggatccgccaccacacccggttagtttttgtattttttagtagagacaggtttcgccatattggccaggctagtctcgaactcctgaccttgtgatctgcccaccttggcctcccaaaatgctgggattataggcgtgagccactgtgcccggccaacaataaatttttttaaggctagtcaaacctaacaacaaaatttaaaagtcaatcagtagttctaacttttttttttttttttttgagacagagtcttgccctgttgcccaggctagaatgcaaatggcacaatcgtggctcaatgcaacctccgcctcccaggttcaaaagattctggtgccttagcctcctatgcagttaggactgcaggagtgggccaccacacctggctaattttttgtactttagtaaagagggttttaccatgttgcccaggctggtctcacactcctgacctcaggcaatctgcccgcttcagcctctcaaagagctaggattacaggcgtgagccacagcgcccggccagttcactctttcctacccacaatcatcttcaacttcccatgaccaagaactaatgcttgaagttaacataataacaaatcagtagagaggggcacagggccaccatgagaaataataaatcagaaaacaccttatgcaatgaatttataacactttggtgtaatcatcatcattttgctacacacacgtttaataagcagaaacagaaatataatgactctcttaaaactatggaacatcatatcaaattcttgctatgaattaggagaggctatattctcacaaaaaggaagaaaacatgaaaatgggctatacacaaaatagcaccttaaaaatgtatcttcacataaactttgtctttaaaattactcccaattttttttttttaaagaaaaacaggcagtatgatcaaggatatatggtaaagggtattccaaaacaattgggatggagtgcaatgtttttggaaagcaattcaataattattactttaagcatttatcctaaggaagtatattaaaatacagttcaagaaagctcattcataatgatgtttatggtaatggaaaagttctaacttaaatatacaaaattgataataatattaaatgatgatcatacagtgaaatatttggcagtcatttcaaatgttatagaaacccatgcaacatatgtgaaaatattttcacaatgtattgagtgaaaacagctggcggaaaaggatataatccttttatgttaaaaaaacaaaaacatacatcaaatgatgtacatcaaagctggttgtctggtaggtggggactagatgattttaattttcttctagtttctatacagagcattacttttctaataagatgaaataaaagaaatagaaacacagattctatcttaactgaatcaaatacatccctttgattatagcatggaagccataaggctgttactgaactttccaaataaaatttaatttgcaagaatcatgcattacctaactaaggaattacttccaaaagactgtgataacagcatacaaggaatatcattttacaaagcttatgaatctattacacttcttctcttagtgataagagtgtcaaatagctttatggttcttccattaaaacttcttttgtgacaaaatacaaaaaaaaatgacatataaagttcctagatctacttcatgtataatcagataattgcaatttaaaaaaaaatattttttcagagatagggtctagccctgtcactgaggttggagtgcagtggcatgatcacagctcactggggccttgaacttcagggctcaagtaaccctctcacctcagccttctcagtagcatgacatcacacctggctaattttggggatgtaggggtggtaaagatgggggtctatgttgcccagactggtcttgagttcctgagcctcaggtgatcctcccaccttggcgtcccaaagtgctgggattataggcgcaagccaccacttctgaccagattttttttttttttttgagacggagtcttgctttgtcgcccaggctgaagtgcagtggtgcgacctcagctcactgcaacccccacctcccgggttcaagcgattctcctgcctcagccttcccagtagctgggattacaggcaaccgccaccacgcccagctaattttttttatatttttagtagggacagggtttcaccatgttggccaggctggtttcgaactcctgacctcaagtggtccgcccgccttggcctcccaaagtgctaggattataggtgtgaaccaccgcacctggccccagataattttttaatagtctctcgtattactgagttttttcatattatatataaagattctgtatttgtttgttgttttctgttttttttttgagaaggagtttcgctcttgttgcccaggctggagtgcaatggcgcgatctctgctcactgtaacctccgcctcctgggctcaagcaattcttctgcctcagcctcctgagtagctgggattacaggcgtgtgccaccactcccggataattttcttttgtatttttagtagaaatggggttttaccatgttggtcaggctggtctcgaactcctgacctcaactgatccacctgcctcggcctcccaaagtgctgggattacaggtgtgagctactgtgcctggcccgaagatttcatatttataagaagagagaataattctctttaaacaaaagtttaaaatatcaggagaaaacataataaaagcatcattatgaaagtatctaaatactttcattttaaattacaacttaccatataaggaatattctgcttcctgacctgtgtcactctcactggaagttgatgtgaggctggtggttaaagtgttacttaaagattgaccaactgataaaactgttgttgctgtagctacattgctgctgctagtaacactggatgttgacatagtcactgttgatgtagtaccaggtgtggtcaaattagggaaactctgagcacccataagaggagaagctaaagacaaaaatgaagcaaatcagtacaaataggtgagattgtagaaacctcagaaaaaccaagttttttattttttaaagagtgaggtcataaaacacactaataataaaatggttcctgaaaagcaacaactttgggaacccaactgaaatccaactaaaaattctttttatagcactattatataattactttgacctgttagcagcttaaattggaatttaactttcagaagctaagatcaatgtagagtctaaacaaaagctatacttatatgatgctttggtttcactgcactatgataatatttaatagtcatctatttcctcatgcaactttgcttaatgatgtatcataaaggagtgaaaatcagaagtactgttttatgcttctaaaataagaggttctttatcacacctagtctgaattctgcaaatattatgattctagagaacttcatattcctgaactgctaaatttgatgtagctttatctaacatggttaatgatctagttaaaaactgcagccagaacaagagaccctattttgcatccctccaagtggaaaaagcatcggattccagaaggaaaagctcacttacttgctgtgctcatcacattcctccccaaagtattagtgttgttatcactgctgcttcggcttagattcatgttgttcgtggcattagtccgtgctatgtttgccactctccttacaaaactctccaagctagatgtttctcttgaggacaggttaggtacacttgcactagagctcataggggccccagcagccaacaaagaactcactgacagtctgttacttgctgaagagctaagaggtcgttgtgaagctgcttctttattagttaattcagatactgaactaacatcaggagaactaacactgacaattcccatggatattgcactagactccccaggagtacgaacagaactatcagggcctaacttcctttcagcattttcacttcccgtttccgctgttaaggtgctggtgcttgcactggaagatgaccctacttctgtttgagggacgttttcagcagatgaaagaacaacaattggttcatggacatcagctcctgaaactatactgtgttccattacaatttctgatctccgttccgttttggtcgaacccaagctgatgtcgctgctactggccacgctacacacagaactgctgcttccttttctacttgaggagcctgcagcagcagatgtcttgtctggacagttgtttttcaccaagctgctccatgattgcgttgtgcctgaaacagtggatgaaacaggtttgggtgatgccactgtatcagggtcgtaccctggtgcaagcttgaggtcaaattttccttctgcgcccatacggtaagagtttgagccaccagcatcccaggtgacatcaatccagcctggaaagggacaggagtttgtgagacccagcagaaagcagataggagcgtgtcagacagtagctccacaatatgggatcagcttttcatcagtgctgtccttttctgaatttctatagtcaatcaaggtctgcccactaaaatatatgtaaatttttggactcaattatttgacgatatgactagctatctgaaagtctatattatttaactctcatgatacaaatattttaaggacaagaaatatgtactctatacaaggtttccaggaaatgtttaaaattcttccttttatttcccttatttctgaactattcagtctatgacatttaaaagcaatgtaagggtcatgtttaaatctactgggttatatttcatttttaaaattatttgatttttagagatgaggtcttgcgttgcccatgctaatcttgaactcctgggcttaaacgatcctcccacctcagcctctggagtagctgggattatagatgtgagccactgcacctggcttggttacttcttaaatggaagaactgtttaagaaattttaaaagattgatatacatggtaaaatactgccacttcagcaagtaaacagaatctaggtaaaagttttaaaactgctaaatataattatgtgtagtcaaattttttttctacaaaaacatgccagcttaccattaatttcttacaatttgggctaacctctcaaaatattcatatattgccatagaaattttagtcactagttcaaataaaacactaaagttagcatttcggttgtgttctcaaagttcagtggttccttggttctcttatattaaataattaagttcaataaatttgaataaacacagaaaattctaaaaaaaaatttaaagagcatactgaactcttttattagaactatctgctaaagctaataacatgtacagaattaacgagcataatgatattcaatctatatatttacttgtagtagaaaaatgatattctttttttaaaaaggtaattaacttccaaaagcaaaaaaaaaattgtctattaaaagcaaattaatagaaattttacaatcttattttagtgttataagctaactatttcagggaaaaacataagacataaaaaacatttttttagaagtataacaagcctttataaagttcttacccatacataaaaggggcccaagatcacatacacacccatccacacacccagatgctcacccacacttacaccaagttcatatgtttatgatagcactcagagggaaataatattgaattacctgtggggattatctgcatatgtgttctttgaaaggaaaagtgactgccccaaatctacataagtagcttagatgagatttttcaattgcctctatttttttctgtatgctgaaataatctctgaagaaccaacatttaactatctcttctgctacacagaaatgtgtgagaaaaggaaaagtttcaaaaacatagcccaatctcaaataaaagtaacttttgtattatattaattggcccaaaaaacatactctctcaactccttctacacccaaaagataaaccaaaaaaaaaaaaaaatagagtcagtaatgactatccatcattagaaatggttggtttaagtatttgaaagctaagaaccctctctgacatagagactcaaaggcataacttgatgggaatggccatgttgattaggcaaaactaaatttctacatttgtcagattagcaaaaataggcctttcttgaacgctaaactctgagatttctaggctaggtgatttttttttttcccatctgtggcagctaaaacgaacaaacaaacaaaaaacactcaaaatattcagatgtacatgttagcactctctcatagggaggtgccatacctcacggttcaaatatattttatagatcagtaacattattatactgacatgtaattgcaacttactatgcagcaaaaatgaatcgagaagaaaaataacccacagtgtctatttacctttgtataggcaattgcttaagttactctgcttttaacatttgtacttcaataaaatgcttatgtatgtataggaatgtcacagtgcaagatgctgctagtacaggcacaaagtattaaaattattttttgaagactggtggttgtattaaaactgttgtgccattgtatcttgggaaaaaaaaaaagattctaatttccctatgcaattgcttcagttgactccatcctgagaaaaaagaactgcattcacacatctctaactagcctcttcttatcaagtcacatacatcaaggccaaaacaattacaggaaatagaataacaactttttaataagtatcatcaagatgcctaaaaagaaaacttgaaattttctgagttgaatggcactactattcaactcagtataacaataatagttgatatctcaactattactggtatttatgaattttaggtcgctgtaaacctgttttgattacaatgatttgcaattagggcatgatactacataaatacatttggcagtaaaataattcaaggaatagaatcttaaaagcaatatagtcaaagggtttatttgaataaataaatgtctttaccacataaaacatgaaattaaatgtcagtcattctcgtaagtaccgtcacatttattctagctctttaaatatgtggtgtaagttgccgcgtgcggtggctcacgcctgtaatcccagctctttgggaggccgaggtgggtggatcacctgaggtcgggagttcaagaccagcctgaccaacatggagaaaccccgtctctactaaaaatacaaaattagccaggcatggtggcccatgcctataatcctagctagtcaggaggctgagacagtagaatcgcttgaacctgggaagcagaggttgcagtgagctgatattgcgccattgcactccagcctgggcaacaagagcgagactctgtctcaaaaaaaaaaaaaaaaatacatatatatacacacacatatatgtggatatatatatgtggtgtaagttgagaatataaacatttttactttttttaatgccaaaaactgatacaaaattgatgaaaacaaacccactgccatttaggcaaattatctgctaataagtcagccttatagtttgaagaaaataattagccactataattgctttaaagttaatagcaatttattaagtggatgactttgctaaactgtgcagcatcaaagaaacttgattcacatagcaatatttagaaaacatgataaactcctccccaaaaagcaggtaggctaagaaacactttgaaataataataatctactaacagataaagagacaatgtttcttgttccatgcattattaaaaaacagtaaaaatgttaatcctttttcttctatatgatttatgataccataaaaattatggtgtgagactaacaagataaagaaaaacataagaaattaaaataaaactcacagtaagcttgaaaataaactaggggaaaaaaccggaagtgtgtcttgaagatactcaacttacactaggcttgatcacttccaaaatactaccagtaagtttctagtcaaaacccaagaacttaaaattttcccttattttctttaccttttttccatttgtaatgtggtatcaacagttcttctaaacagtgctcatacatttatgcaatttataaattatcttaaaagaaaaaatttaactacccattttctacacaaaagtgctgagcacctactcaccattgtgtagttctcctgtgacagtgccttctccctgtgggctgccatcctgatctcgccatttccaatccaggcctctgataacacgagctcctggaaccatgtatttcagaacctgggaacgtactagacgtctctgccgtctaagattagcttctgcttctttagctgctttccctgtcaggtagaaattggagaaataaaaaccaaatcactttttacaaaagtaattgttttagtaagttagaaaagcctcgtatcatctctttacctagctgatcttcacatactccatttacagtgccataaagttcgaatccagataatgagaggtagtgtgtttgtccactggcatttttccccatctgtttaattctcacatgtctccacccttgtttctcatcctttggtggatcaagaggccaagttgcagttgacctgttaatatgttagagaaaaaattatgtaatattttaaaagatgaaaaagaaattcaagatgggaaagattttttatataacagagacctgtagaaaaaataaactaactttcatattaactcaacagttcattacaagaatcaagaaatcaaaggaaaaaaagtagtcaagagaacaagttaaaaacgaaacatttaaatgtacgctattgatttgactcataacattaatgatttatgattaatataattcaaagataaaagacaaaatgctgggtgcagtggtgtttgggtggctgaggtgaggggaatcacttgagcccagaagttagaaagcagccaacataacaagaccccattctccttaaaaaaaaaaaaaggatggtttacaaagagtaggagaaattctcttatgatggaaaaacggacttaaaaacatttttgcaaacttttaaataacgtattaatattttgtctttaaagcatgaaaggggtgaaaacatcacctattaatcctaatgttaagaagctcctctcataccatatcaaatgccaaaagcaatttgggtacataatctaccccctgatatgtgccaaaatgcataaataaaatttagtagaactaattttttagaagttactgacttgtcttttaaaaacttattcaatacataaaatttaaggataaaaataaaaacattttaagtcagccttaattctataacgagcaatagccactgctaatatgttgaacattcctaagtattatgtgattatatggagagtttatggaaagtttatttcacttgtttccattagtgggctgtgtgtgtatgcataaatgtgtgtgtgtgtgtgtgtgtgtgtgtgtgtgtgtgtgtgtgtgtgtgtgcgcgcgtatgtatatacagctatataccaatttttaaaataaatattcacagcatctcagccttttggctaagatacagtgtaaaatagctcggctttctattatttaaactaaaccttttgacaaagttttagtaaagtcagtgtttcaaagttttaatgcctaaagtatcaagtgatttgtttttagaaagaaaattttgcttcaatatttcacaaggaagagagctctagagtataaaattataaaaataaacaaagctctttagtgagttttccaatttgcaaagactcctcaactaaccctggttcattgagactgcagtcatcaacatgggtatacaaagaagtccagttctgtccatctttggatacctggaaaacccaatttctcagtgcagaccttccataaccacgagcatgacgaagtgtatatgctgatggtatcacccagagacccagatctatggcaaaccaggcattcttatcatcattgctatgacaatttaaagctgaattatcacgacttagtatgtcttctaagcggccataaggtagatttcttccttctgatgacgttactactacaagtccataggcagctggatttacccattcataagcagttctatacaaaaataaagaaaaattagcaaataacaacgttaagataattgcatttgcacaaggttttaaatacagaattatattaagtacaattctagaattagcaatttagacattttttcctcataaaaagtaatttggataatcttaacttctacctacaagtcaaaattccttaaaccacagaatattcagagtgctaacaattttattctacttcctagaattcttttaccaagtgaatatggtcactccagcttaaagtaaaatgactgacttactttgcatttgttccaatccagtaaatgattccattttcatcaaaatcatgctggtgccgaaatataaaattttgtccttctcttaattttcgaacaaaaacaaatgaagatcggtcaaaatcataccactgttttgctacctaaaccaaagaaaatatgaaagacagtcaccttaataatgctgttttcaagcacgttacctacttttttcctatctctttaatgtgaattgttttcttttattataacaaatgctcatttaggccgggtgcggtggttcacgcctgtaatcccagcactttgggaggcggaggtgggtggatcatgaggtcaagagatggagaccaccctggccaacatggtgaaaccccgtttctactaaaaatacaaaaattagccaggcgtggtggcaggtgcctatagtcccagctacttgggaggctgaggcaggagaatcacttgaacctgggaggcggaggttgcagtgagccgagattgtgccactgcactccagcctggcaacagagcaagactctgtctcaaaacaaaacaacaacaacaacaaaaacaaaaaacaaatgctcatttaaaaatataaagaaaaataaaaagtcccacaaccaaagcacctcactattaataatcacagagtatttctttagtttattatttcaatggataggataaaacaaattcttgatcatactgtacaaaaacatttttctgttatcattagtctttatacatttttatggctatatgatactcaaattaatagaaataattatcacacacatttgtcaattaaatttaaatttttaatatgaattatctatttaacattaatttattgattggaattaaggtttttgtttactatttcaatattacaaaattataataaacatcttcatgtagaaatcagttctaaaatggaattactgggccaaactgtattaccataactctggatatatacttcccaaattattgtcctaaaaggctaaaccacagctcagaatgcttatttcaccgtgcccttgccagaaactcaccattttcaaaaggtactgttccagagattcaactgtagccaaaggttccatcttcaacattctgccagtcctgtcaatcaatgcagtttcaccaggtgcacgttccaaccgaaatcgtaatctccttgtaagtatctacacaaaaacgatcaaaatactctggaaaacgtcttggtttctgtctcagaattgtaaaaaatgatataccctaaaacaactgagatttggatttattaactataaacataatagaactatgaacaaatgtctgttttctatcaaagattctttttttttttctttttttctgagacggagtctcactctgttgcccaggctggagtgcagtggcgcgatctcggttcactgcaagcttcacctcccgggttcatgccattctcctgcctcagcctcctgagtagctgggactacaggcgcccaccaccacgcccggctaattttttgtattttttagtagagacggggtttcaccttgttagccaggatggtcttgatctcctgacctcgtgatccacccttcttggcctctcaaagtgctgggattacaggcgtgagccaccacacccggcctttttttttttttttttttttttttgagatgggagtcttgttcctgttgcccaggctagagtgcagtggagtgatctcggtttactgcaacctctgcctcccggcttcaagcaattctcctacctcagcctcctgagtagttgggattacaggtgcgtgccaccacgcccggctactttttgtatttttagtagagatgggtttcactatgttggccaggctggtctcaaactcctgacctcaggtgacccgcctaccttggtctcccaaactgctgggattacaggcgtgagacaccacgcccagcctattaaacattctttaggccaggcacagtgactcagacctgtaatcctagcacttcaggagtctgaggcaagaggatcaattgcttgtgcctaggagttcaagaccggcctgggcaacacagtgagacctcatctctacatattaaaacaaacaaaccaacaaaaaattagccaggcatgcatgcctgtagtcccaggtattggagaggctaaggcgggaggatcagctgagcctgggacacggagagtgcagcgagctgagatcacgacactgcactccagcctgtgcaacagagctagacccagtcttgaaaagaaaaaaagaaaaaaaagaaaacaatccaacaggaaagattcttttataaaagggacactaagtaagttacagtggctatcaagtaaaagacaaacttaacttcctagaatttctaaacaacttctaaatatacacagtttaaataaacttacaaaacttcttaacttctaaatatacacagtttaaataaacttataaaacttcttaatcaaagtgacttataactcacaattttccaggtaagtttttgaaaagtagctaattagcttactccgctagaatatattctacaggataagcatccctaatctacaaatctggaatcttgaaatgctccaaaatctgaaactttctgagcactgacatgatgctcaaatgctcactggagcatttcagattttggactaggaatgctgaatcggtaacaaatattataaaatccaaaacacttctggttccaagcattttggataaggaatactcaacctgtataatcaaaggctaataaactttaaaagatgcaaaatagtttttaatccaatacattttagtaagcaacaagcacaggactagcaattttaggtagattcatttctgtataaatcttaactaattcctataaaaacaattaaagatttatatgtgcatttcggtagttttagacagcaaaattaccagagagcacattcctggccttcctctctttggatcttgcacaatctcctgaagtgaaaaatgcataataaaaggcatcggtgcactgtctttgagacttatctccaactcatccacttaccaggaataaagcttaaaaacaatggaccaaacagtccccattactcctgttattctgtctgaaacaaaacacaaagtagccctccacatcttttacatatagaatatcaggtgcaactactgcactgtaaaactccctaaataagtactctagtttgggagtctagtggcactgataacagtattgggttctcagaggtatggcaagttttgttagctttgcattgctttggcatatatagatcctcaatcactcattaaaggctattattcaaaagaaactattccatgcagtagaatgcagaacagtttagataaaggcaaaattcaaagcagaaggccttgctaggaaacactaaaaaacccacaaaaaaagtgataaagttctgggctaggacattagtaaaatgtattgtttgtttgcatctagatcccagctactaaagaaaagaataattgaatgaatgagaatgtaaataggaagttacatattatatacagatatatatatatatatatctgtatggggaggaggagggaaggaaaagaggctatgaaaccatgtgattgataggaatagtgaagacttgggcaatctgactctaaccactgacataaagacccgaaaaaaattgtgcttaaaatatcttgactttttttcttatgtttacaatatagtgataaggaagggacttgccatggtctgaatgtttgtgtccccgcaaaattcatgtgttaaaacttaatccccagtgcagtggtgttggatggtggaacttctgggggggctctgccctcatgaatgggattagtgtccttataaaagaggcctgagagatcttgttcatcccttctacaatgtgagaacacagttagaaggttccatctaagaggaataggccctcacgagacaccaaatctgctagcaccttgatcttggacttcccagccaccagaattgtgagcaatgaatttctgtttattaagttcgcaggaattttgttacagcagcccaaatggactaagacagaactgactcataattgtagaataagaggaacccttttctcagctttttccactgataccttttgccacttatgatctacgaaatataatgcttttaacaaatattaaatgaatgcatcattttccagtgatttgatcaaacaaaacagacttcaagtcattaagatcaatcaaatggcatataagctaaaatctttaaagattaagtagaatcatttttattttaatccgatgtgaaagaaaataattttttttaaagaaaagtgtcacactgttcctagatgcattcagcaatactagctactacattttttatggttacctggaggttatatgtggatcctggtgtatcatacaaatggagaggtagacgttcaatagattctagtacagctattaactttcgaattaacgcaactgctggtcgactgcgaagaaataattattattaagaggttttgtataactacatgtaaatgttcatgcagaaaatatggtaatcaacttcaatatatacccctactttttcatgactacagtttaatttttgtattagattatgtctgagtagaaatactctcacaactcaatttcctttacttaagaataaaacatttcatttttctaataaaaacttaattatatttaaagcagatgtatgatttatttttaaagtttaaataattttactggataatatttgataaataaaaaagaatataaagcaacaaagttttgaaaaaatatttgatggctagggtatcacaacatatactttctcattattagtgtaaactgcaatgacacttccggaaaacaatgtgaaaatttgaatcaagaactttcaaaaatcgtcttgcagagctgggcaaggtggtatatgctggagtcccagctacaagggaagctgagaaaagagaattgcttgagcccaggagtttaaggctgtagtgcaaaattctggcacccgtaaatagccactggactccagcctcagcaacacagcaagactccatctcttaaaaaaaaaagaaatcatctataacctataacacagtattaccacttacggaatttatgtaaaaagatgcttccattgagactagtatatttaagtattagtaatagtttgcaaagagctaaaacacagtaatacttcaaaacattatacatccataaagatataatatgcattcattaaaaatgaaatttgaaattaacacaattatctgaataaattgtataacttgttatttgacaagtgcaatcccattcaaatgtacacagaataatataatgaacctttatcaacccagctttagcaattagctactaatggccaatctccatccaggtttttttctttttttttttttgttatagagtctcactctgtcacctaggctggagtacggtggctcaatctcagctcactgcaacttctgcctccagggttcaagggattctcctgcctcagcctcccgagtagctgggattaaagacgcccaccaccaggcccaactaacttttgtatttttagtagagatgggtttttgccatgttggccaggctggtctcgaactcctgacctgaagtgatccacccacctcagcctcccaaagtcctgggattacaggcgtgagccaccgtgcctggcctacttcttcttatatattttgaaaaaatactaaagagcttatcatttcatccagagatagtctttgtacataaatctaacaaaagaattattttttaaaaaaaaacagtattacacttttaaaaagaacaattattacttaatattatcaaacatttcatcagtgttcaaattttcaactatcttaaacaggcatgtaatttaaactaagtgatcaggctaggaacggtggttcatgcctataatcccaacacgttgggcagcgaagacaggagaaatgcttgagcccaggaggttgaggctgcagtgagccaagatgacatcactgtactccagcctgggcaacagagcaaaatcttgtctgaatttacaaaataataattatcatgaataagtaaactaagtgatcagctgcattcataccagacatgtaatttcaatgtttctttttattccattagattaaaaaaaacttcaaaaattttcctcttattatacatgtataatatgttactttcttattaagagtttcttttgtgtgcataaatgttacactagacttattttagaggaagtataccaactgtgtgaacattacaaacatcaaattcaaagaaatttgagattttacctttcatcatcttcattttcactaaaggcagttttaaaaacatttattctttctaccagttgactacaatcttgtttcatatccaaatccatgctctaaagaaaacaaaaagtataaagtccaaaaaaaaataatttaaggatcttactgaaattcatcaaaaactaagagacaaatgttaacatattgttatacaatgatcactacaatgtgaataaaatcattcatcatttcatgtttcaattaaaattatttttagtatgtgactagtaggccatggctaacatacaaaattttttccttcttcaatgttataatatactcaccaattatgctgcaaaatcagtgtttccccaagtatacaagatggtttcagactatattaatataggaatgaacattttccattttaacagtactatttactttaataagtattaggaaaaaactggtacatcaaaactatttcatagattactaagtgatataatgtgatatatcactataataaatgagaataaatgcaaatagtaaagtttatgaagggactatgggactcattgaagttccagtgaattttttttttttttttttgagacagagtctcgctctgtcacccaggctggagtacagtggtgctatcttggctcactgcaacctcgcctcccaggctcaagcaattctcccgcctcagaattacagaagagtaggtgggactacaggtgcatgccaacacgcctggctaattttgttttgtatttttaatagagatagggtttcaccatgttggccaggctggtcttgcattcctgacctcaagtgttctgcccacctcagcctcctagagtgctaggattacaggcacgagccaccgcgcccagcctaaagtaaatcttaagagtgcatcagcacatacaatgattaagatcaagaaatcaactctggccaggcacagtggctcacacctgtaatcccagcaccttgggaggccaaggaaggcagatcgcttgagcccagcctaggcatcatggcgaacacacagatgcacatacacacatgcacacacactaaaaagaactgagtagtccacgtttcagcagtacatataccaaaactgaaatgatacagagaagattagtatggcccttgcacaaggatgacacacaaattcgtgaagcattccaaatttttaaaaatataattaattaattaattaaataaaactaagtagaactgaaatgaatataattcttttattaaaataaaggaaaaaagagccaggtgcagtggctcatgcctgtaatcccagcacttgggaggcaaaggcgggcgggtcacttgaggtcaggagtgcgaaaccagcctggccaacatgacaaaacctcgtctctactaaaaatacaaaaattagccgggcgtggtggcaggtgcctgtaatcccaactactcaggaggctaaggcaggagaatcacttgagcccaggaggcagaggctgcagtgagtcaggactgcgccactgcactcaagcctgggcgacaaagcgagactctgtgtcaaaaataaataaatatataaacaaaggaaaaaagttttaccacaataaagagacattcttaaatcgaaaaaatatataaggttattagcaaatatttatcaaattttcacataaacttcctaaacttttttccttttaactcatctgtatttgttgtaactttaagcagaatgtgactcgagcgctacatttccatccacaagactgagtctgagttatttttgaacagctttatgatatgcttaggtaggcttataactttgctcctccaaacaacacttttctttggaaaacaagccctgtggagagttccttccatcataaacttcctaaactttcattgttcacacattatgcatataacttgggtacttaaggtctacagacatattctattttatataacttatgtaaaaatcagaggagtgaataataacaaatcaagctgaagtgtttttagtcaacaaaacctttagcaaattataactgggaacttagaaatcaaaataaacaattatttaattcatttggctcaaactaatcataaaacctaaaggctgaagaaattagaaatattaacatcattcagcttttaaatatttcttgacaaaacaaactaaaaaccactctaccgaaggagtaactacaaataatttttaaaactgtatttttgttctttactacttgataaacttacattgtttaacacagtaagaagtgcttgtaccaagccactgctacacatttcatatggtgaaattgtgttttcatccttcaaaagtacaattaggttttctaaagctgtcttcattaaatctctccaagtgttctcactctcaatacactaaaagaaaaaaaaatttaatgaaggcaatcaaaaacataaacatagctcttaaaataacttatcagaacatcaattatcatgacaataatttagatattaagcaaaattaaaagttcaaattattaacacaaattatgtctaccagaggtcagcaaacgttttcgtaaagggcccagtgcaaacagtttaggctttgcaggccatatagtctacatcacagctattcaaccacgcccctgtagcaccaaagtagtcatagacaatatgtaaatgaataagcatggctatgtgtgattaaattatatggataccgaaatctgattttcatgtgtcttgaaattgtccttctggtttgttttcaatcatttaaaagtataaaaaccattcttacctcataaagccatacgaaaatggggagcaggccagatttggctcctgggccataatttgctgaccccctactcaatacccatgacataaaggatagaggggaagacatcaaactaaaattcactacatatcattaaaatctagaggatgacatacttgtctatttgtatgaagttcccaagatgactctaactgagttgctatgtttctgagtgttaccactactccacgaggcatgctttcaacagctttaaaatggtcatcgtataaatctcgagccatagttcgtacctaccaaaataaacacaacaaatgtgaatttttacaattaataattttaccaaatcttcacttttatagacactcgtatttacatatttcaccacgaaaaggtacgtatgtactgtcatttgggcacaaatgagctctcgaagttacagttatttgaggaaacaacctatgtatgttctgggtctgatgaaatttagtacatgatattatttaaaaatatatgcttaagtaatgtaaatttaggattcacctaatgccattttaatcccaaacaaacccagcataactctaatgcaacagaaaaaaacgtatctctctaaactacttaataatactttctattctattttggtatgcccttcagaattaaaagatggcaatcatggatataagacaagtttgaagaaactatctctttataaaacagtattaataattaatactggtgtggtggctcatgcttgtaatcctagcactttgggaggccaaggcaggcagatcacttgaggtcagtcaggagttcaagaccagcctggccaacatggtgaaacctcgtctctactaaaaattaaaaataaaattagctgggcatggttgtgcatgcctatagtcccagctactcaggagactgaggcgggacaatcatttgaacccgggaggtggaggctgcagtgagccaagattgtgccagtgcctgggtgacagagcaagactttgcctcaaaaaataaaaaaaaataaataaattagttaaaattatttttgcctaaaatattttgatgcatacttgtttatatatgcaaaaggatagccacctactcactgagttgctactgatttcaaatcaagaaagtgaagcagtaatttttaaaatttttttcttacaatttcaacttttattttagattcggggtacatgtgcaggttacatgggtatactgtgtgatgttaaggtttgcaatacaaatgatctcaacacccaggtagtgagcatagtacccaacagttctggaacccttgccaccctcactccacaccctccataatttttttttttttaatgagaatacaggattgagacaatgtcctcactgattttttttagtttgtgttatgaaatttcagtatcctgtagtctagatttggttggttaatacgacatattagatattccaaaaaactcttgaggtaggtgatttatagtcagattattcaacggttccatgcttgcaaatatgagtattcattaaaatttgtaacctcaaaatcaatcattgcagagctttcacattcattgacagacatgcacagtgcagcaataaatttaaggtgcccaatatgcatgttcccagcagaattcaaaaaggtgacactctttcttgcttcaggtctcatactataaacaagtgccctattcacaatctacttagtgtcacatattttgaattttggggctttttcttcctgatttcattgtttaaaatggcccccaaacatagtgcttaagtgctatccagtgtttctaagcacaaggagactgtgacgtaccttgcaagaaaaaaaaaaaaaaagtgtgtgctaaaataagctttgttcaagcatagcagtgctgttggccagttcaatattaataaatcaacaatacatatcaggctgggcgcagtggcttttgggaggccaaggcgggcagatcacttgaggtaggagtttgagaccagcctggccaacatggtgaaaccccgtctctactaaaaatgcaaaaatgagccgggcatggtggcgcgcacctgtaatcccaggtatttgggaggctgaggcaggtgaatcggttgaacctggaaggcggaggttgcagggagctgagactgtgccactgccctccaacataggaaacagagtgagactctgtctcaaaaaacaaaaaacaatacatagcaaataaggtgtctttaaacaaaaacatactaaaaaacaaggtgaaaaaatgttgtcacaacaggccttaggcctagaagaaatctaacccagtatttctcccacaagcaatggttcagtattcacaataactttataaaatgtaactactgttggccggatgtggtggctcatgcctgtaatcccactactttgggaggccgaggcaggtggatcacttgaggtcaggagatggagactatcctggctaacacagtgaaaccctgtctctactaaaaatacaaaaaagtaactgggcatggtggtacgtgcttgtagtcccagctactcggaaggctgaggcaggagaatcacttgaacctggggaggcagaggttgcagtcagccgagatcgcaccgctgcactccagtctgggtgacagagtgagaatccatctcaaaaaaaataaaaataaaaataaataaataaaaaagctatgttctttccaaagtataccacctgcaaatatctttgggataacctagcacattcaaacaggaaataaagatgtgaacatctttatataaaacatccgcttcaaatgaaaaccactatcacaggactggcacagtggcaaatgcctgtaatcccagcactttggaaggctaaggagggtggatcacctgaggtcaggagtttcagaccagcctggccaacatggtgaaaccccgtctctactaaaaatacaaaaaattagctgggcatggtggcaggcacctgtaatcccagctactcaggaggctgaggcaggagaatagcctgaacccaggaggcagaggttacagtgagctgagactgcaccattctacagtttgggcatcaagagcgaaaccgagtctcaaaaaaaacattacaagggtttcactaagtttgtttaaaaaaaaaaacagaaacatcattattacaatttctctggtcaaagccataaaaacacaagaactctcccctaatcctaatcatatacaagtattctttgcatactgtatttaaaaactatcttagaaccaggcatagcgcctgtagtcccagctacttgggaggctgaggcaggaggattacttgcactcaggtattttagaccagcctggacaatacagagagactgtttcaaaacaaagcaaattaaaaaaatcctattttatattaccattataggtaaaataaacatactagtcaccagaaaatgttgactctaactatgagattatcttacttttttttaaaaatgaaaaaaaaaatgcaagaacaataaacatggaaatatactggccatattttaaagtaataatgcaaacctgatggaagcataaaaaaattagtcaattatgcatctgctactgtatcttcttgaagtaataatttcagctgagatggccattaaactaagtatcaaaataatctgaatttagaaccaggcagttaagtttgctgtatcacaaggtattaacccagattgtaaaatacaagtcattttcaatcccactacaacactaaaaatatcctagtatcattaataatctcaatgagttgaatttttttgtgcaattaataagtcaagtaatttacattttgtttcatattaacatccattttgattctgttttaatgttggtatttagtataggtataaaaattatatgtaaataaatatttaagaaaacacagaaaatagaaaaactaaaaatatattatattagggctgcttatgttctatggctcaatttttttcagtgcttatactttaccactgaaaatttaacaaatcagtataaaagacaagaataaagcacatccaacagatataccttttgctttgttttttctaacttagatttcagttttctgcctcttttgccagtccagccagtcacaaattctgaaccttggggggaaaaaaaagaatattcacagagcttactttgttacaatttaacatattcatttatttgtacccaataaacttacatatctacatacttacccagggaagtttctgcagtaaatgaatgtttggttcctctattagattcaaatacaaaaccaggtaaatcttctttcaatattgtagcttgctgaccatctgaattatgaatagcaatttctccttctttcaaacatgtcagtgaccaatttcctacagtaagtttagtgggtcctggtgctgacagtataggttgacttgaagtagatggctttacttggcctcgagctctttgtaacttctctaagaattcacttcggctttctataaagacaaaatacttgtttcaaaatcttatttctttcaagtatgacatgtattttctcttaggaaaaaaagacctattaaaatataaattttaaacaataaaactaaattagaaactggaaatattagccaggcatggtggtacgcatctgtagtcccagctacttgggaagctaaggcgagatgatcacttgagctcacgagtttgaggctgccatgagctatgatcacaccaccgctctctagcctgggagacagagtaagacactgtctccaaaacaaaaaaaaaaaaaaaaaaaggagctatatttgtaaagatattttttaaaaagtagatacagtgttgttccttgtcccatgcagtaaaaagacatttaggaaatattttcatggtataataatttttctctactgatacaaaagaaattgatattaaaaaataaagaaacaaatatttttgtttctacagtggctcacacctgtaactccagcacgttgggaggccgaggtagggggatcacctgaggtcaggagttcgagactagcctgaccaacaaggtgaaaccccatctctactaaaaatagaaaaataagccgggcatggtgacaggtgcctgtagtcccagctactcaggagagtgagacaggagaactgcttgaacctgagaggtggaggttgcagtgagccgagatcgcaccactgcactccagcctgggtgacagagtgagactccgtctcaaaaaaataaaataccttgacaatggtagcaaaaatatgagaaaaaaaccaaactgtagaaactaggaaaatattttaattgaaacaaaatattacctgaactgtcagatccaccttccggactaccacttgaatacatggtggcaagttttccatccaagataaatctgaaccatccattactgccattagataattccaaggctgctgcatcactccaaatatataagcagtcccttcccctaatgattgaccagtctctccaatgatatggtttaccttgttgcaattctttagcatcttcctgtggttcatcttcctaaatgtgtagaattattcaattaaacatggaaaataatttcaatttcaaatattcatacatattttaaaaacatgaatctaatttaatttcaaatttaaatactctgaacataatactcaattgcctgtagcttaatctttttccccccttttagaaacatggtctcaactctgtcatccaggctggtgtgcaatagtgtcatcatagcttactgcagcctctaactcctggcctcaggcaatccttccacctcaacctcccaagtagctgggattacaggtccaagccacggcacctggctctcaattctgactaattaattacctataactaaatcttacaaataagtgttaaaaatattaagaaattcatgtaaataatgacctatattatatcatgtccaggtgtagtggggtaaagactaatggattagagcactacacacaacaacataataacctaaaaccttggtgaactcattacatctctgggcctatttgtaaacaatgatgatttagagaggctcaatggtatccaaagtgaagtgtgtaacagaatcaccaaagaagctttttaaagataaattttggctgacagtgatggctcatgcctataaccccaacactttgggaggccaaggcaggaggagtgcttaggccatgagttcaagatcagcctgggcaacgtagcgagtctgtctccacaaaaaaaaaaattaaaaattagctgagggtggtagtgcgcacctgtagtcctagctactggagaagttgaagcacgaagactgcctgggccctggaatttgaggttatagtgaaggactgtgccacagaactccagcctgggtaacagatcgggactctgtctctattatctatatctatctatctatctatctatctagataataaagacactatctataatctctatatagataatagagacagggtctcactctataataatagagacattatctacaacctctataaagataatagagacagtgtctctctataaatatatatatttataatttatatataatatatattatctattataagtaaataaaattcattcattcattccaagaccccacccttagccaagtgaatcaaatatactcattcccatgatcatacaagtattttagttagagcttttttttttttttttttttgagacagagtctcgctctgtcacccaggctggagtgcagtggcacaatctccacttactgcaagctccacctcccgggttcacgccattctcctgcctcagcctcccaagtagctgggactacaggggcccgccactacgccggactaattttttgtatttttagtagagatggtgtttcactgtgttagccaggatggtctctatcttctgacctcacgatctgccctcctccatctcaaagtgctgggattacaggcatgagccaccgcgcctgactcagcatgtttttttttttaaaaaaaatgtataaacattttgtagctcagcctgtgttcctaaaactttttttggacacatttaaaaatggaaaatattcacataaaaaaagatattaaattatctaaatacgtccatcataaacaactaaaatatagacaagatatacgaaaaatgtgttttcaaacactaaagaacagtcaatgcaggactatgatccccaagaaaatgaaagcaaacaaagcgagtctcttagaaccagagaccattttctggctaagctcatgtggaaggggaacacagatcctagcagtacaagttaagaaaatagagatcagagtttgaaaagtttgaggcaactggaatatgtggaggctgagttcactattacggaactaaagagaaaaagcctctccagaaatctgcaaagtagtttccactgagtactacacttatatacggggtgatactgcataagattgggcaaagaacaactggaaagttataagagatcatacaagtagccagacatttgcattccaaacagccagagtagaaaatcctcatagatcaccaggatattcagtgaattcaaagaaatcacaaatttgggatcataggggtgaagttccctagagtaaaagctattctgccaccatgcaatgacaattttgtactctttgtagagacagagttttgccatgttacctaggctaggctcgaattcgtgggctcaagcgacctgtccgcctcggcctcccaaagtgctggagttacaggcatgagccaaggtacctggccaaaacccaatattctttacaaaagaccacaaagcccagagcccaacatcatcacatttacaatatccagtagcaaatcaaaacttactagacaaagaagcacagtggctcacacctgtaatctcagcactttggaaggccaaggcaggaggataacttgaggccaaaaaccaacctagccttggcaacattgtgagacccgcatctctacaaaaataaaataaatatttttttaattaaacaataaaaaaataaagaggccaggtgcggtggatcactttgaggtcacgagttcgagaccaccctggccaacatggtaaaaccttgtctctactaaaaatacaaaacttagctgagcatggtggtgtgcacctgtaattccagctacttgggaggctgaggcaggagaattgcttgaacccgggaggcagaggttgcagtgagccgagatcacgccactgcactctagcctgggtgacaaagcgagaccctgtctcaaaaaagaaaaaattagaaagaaggccaaataattttcagatacataaaatctgagagaattatctggcttgccttttcttttttttctttttttttttttttttaataaaaatagagatgggtcggccaggcgtggtggctcatgcctgtaatcccagcactttgggaggccaaggcgggcggatcacgaggtcaggagatcgagaccatcctggctaacacggtaaaaccctgtctctgctaaaaatacaaaaaattagccgggcattgtggcgggcgcctgtagtcccagctactcgggaggctgaggtaggagaatggcttgaatccgggaggcagagctagcagtgagctgagatcacgacagagcgagactccatctcaaaaaaaaaaaaaaatagagactgggtctcacctcaccatgttgcccagactggtctcgaactcctgggctcaagtaattctcctacctgagcctccccaaagtgctgggattacaggcatgaggcatcatgcccagccgaccatttcaacgtattttgaagagcgtaagtgtgtaatgatgaagtacaacttaccaattatttgttcttttacagtataaccttttgaagtttaatttacaaaatctttcccaagtccaaggtcactaagattttctcttttcctctagaagtgtcataattttagtgtatacattttagtctatggttcattttgttaatttttgtatatgggaccctaaccatgtatatatataatgtatatatataatgctatatatatacatgggtagtaagggttgagactaagggagactcaatctcaaaaaacaaaacaaaaaaagaaatgatacaaatatatatatatgtggtaagggttgaggtttaattattttgcatatgctattggcttgttcattttttgaaaagatcatcctttcttggtggtcttagcacttttgttgaaaatcaattggccatatgtgtagtgggtcattcatctatctttacactattgtcacactttcttgattaccaaagttttataaaagagttgaaattgatgtatatccttctacgctgctccttttccaggttgctttggctattacatttatatacaaatgttagactctccttgttttttttttttttgagatggagttctgttctgtcaaccagactggagtgcaatggcacgatccgatctcggctcactgcaacctctgcctcccaggttcaagcaattctcctgtctcaccctcccaagtagctgggattacaggtgtgtgccaccacgcccagctaattttttttttctttttttgagatggagtcttgctctgtcgcccaggctggagtacagtggcgcgatctcagctcactgcaacctccgcctcccaggttcaagtgattctcctgcctcagcctccggagtagctgggacgacagccaagtgctaccatgcctggctcatttttgtattttttgtagagatggggtttcacaatgttggccaggctggtttcgaacttctgatctcaggtgatctccctgcctcggcctcccaaagtgctgggattacaggcatgagccactgcactcagcctagaatctccttgtcaatttctacaaaaagactgctgggatcttggttgggattgctgtaacctatttcttgagagagagagttccagaaaataaactcggataatatttttgttttgtttttccttaaatcccccagtaattctgacgattaaacagatttgggtaacacatacacactctctctttcaccaccctcgggattctacaattattaactcatataccaccatttttttcaaaaatattactaccctgttattaacacacagtaagcattcactaaatattagaaataaatcttgctgggaaccactagacacagaaaaggtatatttaaatttgcagtctaaggcaagagttaccaatgaatacagaaattggtgggttaaatttactgaggaacagcatatttacacagtctggaattatgtccctacaaattacttattacaaaaggaaaaagaggccaggagcagtgactcacgcctgtaataccgacagtttgggaggccgaggtgggtggatcacctaggtcagaagttcgagactggcctggccaatatgatgaaaccctgtctctactaaaaattcaaaaattagctgggcgtggtggtacgtgcctgtaatcccagctacgccggaggctgaggcatgagagtcgctttaacccagaaggtggagggggcggtgagccgagatcatgccattgcactccagcctcagcaacagagcaagataccgtctcaaaaaaaaaaaaaaaggaaaagagcaactttacaactttacagtagagaaacctggaagagaaaaacttaagcaagtgatccaagttatcataaccaacagggtaaacagacacaaatgtgcctccaagaaggaacattatgcacctagaagagcatagtatcacctctataggacttttgctaaaacacataagctgaatttaatcacaaagaaacatgacacaaagttaggctctttgttcaaattaactgttctattctcttcataaacaccaaagctatgaaaataaaaggaaggctgacagactgctgtaggttctcaggacaaactatcgcaggttctcaggaatatgataagcaatgtaatgtgtgctcctggatttcattgtggaccagaaaaaaaaattactatgaaggacattaaagacaatggcaaaatctaaatatgtctccagagaatatattagtgttacataaatattaaattttctgattagtacgattttgataattatactacaactatgtcctggcttttttctggtgaaatatttaggttaaaaggtaaaactctgtattcaccttaccatcaatttttttttttttaagatggagtctcaggccgggtgcggtggctcacgcctgtaatcccagcactctgggaggcagaggcgggcggatcacgaggtcaggagatcgagaccatcctggctagcatggtgaaaccctgtctctattaaaagtacaaaaaattagccaggcatggtggcaggcgtctgcagtcccagctactggggaggctgaggcaggagaatggcgtgaacccaggaggcggagctggcagtgagccgagatcgcgccactgcactccagcctgggtgacagagcgagactctgtctcaaaaaaaaaaaagctggagtctcactctgtcgcccaggctggaatgcggtggtgcgatctcggctcactgcaacctcagcctttgggaggtcagggcaggcagattacctgaggtcaggagtttgagaccagcctgaccaacatggagaaaccccgtctctactaaaaatacaaaattagccagggaggtgaaggttgcagtgagctgagatcacaacattgcactccagcctggacaacaagagcgaaactccatctcaaaaaaaaagtacacacacacacacacacacacacacacacacaaacagatacatgtgtctgaaaaaatgttaaaggaaatggggcaaaatgttaataactagtgaatttggatagagagtattctgatattctttaactatatttgcaacatttctatatgtttaaaattgttgatcaaaatgttttaaaagaaaattgaccaatttaaaaaatatacagaattatttcatattgtcattatcctgtcaaaaaccatcaaaaattgaaactagattttcctcaaaaaaaaaaaaaaaactcttcctgatacctctataattaagaccactcactttttctggttttgattcctcttcattctcatcatcagaggaaggacctgccaacgttgacactttgctaattacaccaagtctggctagctgatccaaaaatatatcaccacctttatctactaaatcccttatgatctgcaaagccagcaagtggccatcatcatcatcctgaaaaataaaaaataaaaataagtttagttgccaggagtagagaaatgcagtaatttgcacaacatgatttactgaaattaaaacaaaaattttatttcagactactagctaaaggaaattaatgctaaagagttttgaaaaagaaacggacctcttgatccaggacagttgcagtgatttccactagtattgtaggcaaattgtgaccaacatcagaatcacaaacttcttttaacagtgcttcagagcaaaaatgaatcatttttcgaattagagcaagacttgctttccttgaaaagtaaaaatagaattatatgaagccaaatgaagttaaaataaatcaaaatgcatgcattaatgaacagtaaaatatccaatgttacattttatacactctgctaaaaaaatacacttaataaaaaaatacaaaaaattgggactcagcactatatgttcatttttgaaataattccatttattttctattataaatatattgagctcaccaaaaatgacttataattttcttaaatgcacttttctattctatattctacactttactagcatgaatgttaacatgtcatgataattttagaaaatcaagtaaaaagtactacaactactaagaaaataaatggggcccagtgcagcggctcacgcgtgtaatccctgcattttgggaggctgagggaggcggatcgcttgaggtcaggagttcaagactagcttggccaacatggagaaaccccgtctctactaaaaatacaaaaactagctagacgtggtggcaggcacctgtaatctcagctactcaggagcctgaggcggaataatcacttgaacctaggagatggtgccactgtactccatcctgggagactgaaggagactccatctcaaaacacaaaataaaattaaaaaaagaaaagaaatgatacaaattatacctaaaatttcctataatccaaaatacaatgctctaagaacttaagatactaggtaatttatatgaaaaacaaaattttgatttaatttgtccttcatcaaatttaaaatccacgttcactgcaactatggactcatataaatgaaaataagagatcctaataatcccatgcccccaaaatattcccatcattaacaaattagtatgcctcctttcccttttattcacttactgctttgcttagaccgtagcagacactcaataaagtcacataaattaacctcaattttttttttttttttttttttttggagacagagtctcgctctgttgtctcggctggagtgtagtggcacaatctcggctcactgcaacctccgcctcccgggttcacgccattctcctgcctcagcctcccgagtagctgggactacaggcgcacaccgccacgctcagctttttgtattttttgtatttttagtaaagatggggtttcactgtgttagccaagatggtcttgatctcctgacctcgtgatccgcctgcctctgcctcccagagtgctgggattacaggcgtgagccaccacgcccggccaaattaacctcaactttataacatgtaacctgatcttttaaaataaaaaacacatattcacatacatttaaatgataataaactactaataagatgaggcttggctgggtgaggtggttcacacctgtaatcccagcactttgggaggctgaggcaggtggatcacctgaggtcaggagttcgagaccagcctgaccaatatggtgaaaccccgtctctactaaaaatacaaaaattagccgggcatggtggtgggcatctgtagtcccagctactcaggaggctgagacagaagaattgcttgaaccctagaggcagaggttgcagcaggccaagatcgtgccactgcactccagcctggacgacagagccagactctgtcttaaacaaaaacaaacaaacaaaaaaaaggcttgtctattatgtaagagccaataatcaattcatttaacaaatattttctaagtatctaacaatgttctaggcactaagctgcagatatcattacccttgaggtgaatgatagaaggataaagaggcaaaattttcaactgatgtcctagagaggcatgtgacacagctgtatttctacagcatagggtctctacatattttataactctctctagctgaagttataacattatatttctttaatgaaggaatatgctttattacaaattcaagtacagtacagaaaatgataggtggacagaggacaaactgttctaacaggattggttctttccagtttttgttttgttgtttttaatttaatttaatttatttattttttttgggacagagactcgctctgtcacccaggctggagtgcagtggtgtgatctcggctcactgcaacctccacctcctgggttcaagtgattctcctgtctcagtctccagagtagttgtgattacaggtgtgcaccaccacacccagctaatttttgtagttttagtagagacggagtttcatcatgttggccaggctgatcttgaactcctgacctcaggtgatctgcctgcctcagcctccaaagcgctgggattacaggcgtgagccaccgcacctggccataattttttttttttttttgagacagggtcttgctctgtcccccaggctggagtgcgtggcaggattttgactcactgcaacctccgactcccaggttcaagtgattctcgtgcctcagcctcccaaatagctcggactacaggctcctgccaccgtgcccagctaatttttctattttttgtagagacagggttttaccacgttgcccaggctggtctcgaaatcctgtgctcaggagatccaccctactcggcctcccgaagtgctgggattacagccatgagtcactgtgcctggcgccggtttttattactggccccagtttttatttatattccactgtaaataccagaatttaactattagttttatatcatgacttatttcaattaacaatgtattagaatgtttatatgttatttatctatctctctctcgtatactgagccatcatgagcagtaacctttttatgtactttaaaaacataattcatttaacccacacaacaaaacctatgaggtgggttttattatctcaaatttacaagtgaagatactgagcgatagttaagtcagtctactaagatcaccaagctaataaattacagagcctgtattcaaattctatctcttaattagatgatacataatactcacaacataaaattttcctgtttaacactattatataaattttgaacatttagtttacagtcttttctattaaaaatagcactatttatttttgtgtaaacagtttcttcatattccttcagtacagagggattcttggatctaacagcctaaacactttcattaagtattgaatgtgtatgagtactgcattcatattggcaaactgattcaaaaaaggttgttaacaccttaaattatcactaaatatgaatatctacaatattcctttttacttaaaaaaaattctcattttttaagtttcttaactgtctaataggtaaaaatgataccaaattttacttatttctaaaatgttttgctttttactagtaaggaaatactttttttttttgagacagcatctcactttgtcatctagactggagtgcagcagcacaatctcagctcactgcagcctcgaccgcccaggctcaaacaatcctcccacctcagcctctcgagtagccaggactacaggtatgcgccaccatactcagctaatttttgtgtgttttgtagagacagggtttcactagttgcccaggctggtctcaaactcctggactcaagcaatcctcccacctcagcctcccaaagtgctgggattacatgcatgagctaacacacccagctaggaaatacatttttccatattaattttttgccgtgtttcctcttgaacactgtgccttaatttcattgactaatttactcaaatggctctgaaatttttacgatcaatttgtaaataccctttgtatataataaagacagtatccctttgtcatatttgctaacaaatacccacctgctggcaaatttttttagattaaaagtttctattctgagacatttgtggctgcaggtaatattgtttctgttatgtagtagttttatgttttttacataaaataaatttaaaaggacacatttggctaatgcaaataggtttctaaagtaagccaggcatagtggctcacgcctgtaatcccgcagtttgggaggtcaaggcaggggaactgcttaagcccgggagttcaagaccagccttgggcagcaaagcaaaactatctctaaaaataaaaattagctggacctggtggtgtgtgcctgcagttctagctactcaagaggctgaggcaagaggatacactgtgccatggaattcaaggttgcagtgagctgtgatcatactatgcactccagtctgggtgacacagcaacaccccgtctcaaaaaaaaagaaaaaaaaaaagaaaaaaaagaaagaaagaaaggaaaaagaaaaacaaaaagccaggctgggtgtggtggatcacgcctgtaatcccagcactttgggaggccaaggcaggcagatcacccgagatgaggagttcgagaccagcccagccaacatggcaaaaccccatttttactaaaaacacaaaaaaattagccgggcatggtggtgtgtgcctgtaatcccagctactcaggagctgagatggcgccacttcactccagcctgtgcaacagagcaggactctgtctcaaaaaaaaaaagaaaaagaaaaagccattcttcctatcaaggtctgataaacattcaagtatattttcttttgctcagaggttctggaggggctcacacctgtaattccaacactttgggaggctgagaagggtggatcacatgaggccaggagttcaagaccagcctggccaatatggtgaaaccctgtctctactaacaaaatacaaaaattagctgggcatggtggtgcatgtccttaatcccagctcctcgggaggctgaggcacgagaatcgcttgaacctgggagtcagaggtttgcagtgagccaagatcatgctactgcactccaacctgagtgacagagcaagactgtctcaaaaaaaaaaaaaaaagttttggaggatagggaaaaaaagtatcttatctttttgttttcctaatattttagtttttaagtcttagaatttgtttagatttaaaatataagataaaagattagggtgatttttaaaatcaaactacaaagcagatactccagtaccacttaataaatagtaccccctcccctgaatgatctgagaaacatccattataatacattcaatacctatatataactggctctattggggggactattttattccattgatttacacactactctgctagttatcataaaaatttcattgctaaagggttacactaacatttcagatttttctttaataatctcacctatttattcttccagatgaactttgggatctgtcaagttctaaaacaaattctgtagttatttcctttagaactgcataacctacaaattaattttagaagaatttatgtctttagattatttaatgttttcacccaagaacaatttcccactatatcccaccaagtctacttttttctctcaaattgttttaaaaaaaaaattgggccagtcgcagtggctcacacctgtaaacctagcactttgggaggatcactagagcttaagagttcaagaccagtctgggcaacatagtaagaccttgtttacacacaaaaaaataaaaaaattagtcaggtgtggtggtgctcgcctgtagtatcagcaacttgggaggctagagaactgcttgagcccaggaggctgaggctgcagtgagctgagatcacgccactgcactccagcctgagcagcagggtaagatcctgacacacacacacacacacgcacacacacacacacgcacacatgcgcacacacacacacggaaagcaagaaaagaaaaccagaccacacacggtggctcacgcctgtaaacccaacactttgggaggctgacgtcggaagatcgcttgagcccaggagtttgagaccagtctgggcaacacagcaagacttcatctctacaaaaaaaaaaaaactattttaattagccaggtgtttagccaggcatggtggcatgcatctgtagtctcagctacttgggagactaaggtgagaggatcacttgagcctgggaggcagagcctgcagtgagccaagattgtgccactgcactctagcctaggtgacagagtgagcccctttcctcccccaaagaattagctgggcgtggtggtgcacaactgtggtcgcaagtggttgggaggctgagttgggaaaatcccttgagcccaggagtttgaagttgccgtaagctatgagcactccactatactccagcctgtgcgacagtgagaccctgtagctaaaacctttttttttaatttttaaagggccaggcgcagtggctcactcctgtaatcccagcactttaggaggcagaggcaggcggatcacttgaggtcaggagtttaaggccaggctggccaacatggcaaaaccccgtctctactaaaactacaaaaattagccgggcatggtggtgcgtgcctgtaatccctgtaaacccctgggaggctgaggcaggataatcacttgaacccaggaggcggaggctgcagtaagccaagatcacgccacttcactgcagcctgggtgacagagcaagactctgtctcaaaaaaaaaatttttttttcaaaaggtcctcataaagatctagtttgctgcaaaggagactcaatctttgtccagttatttatactaactcctaagatgtttacttatcagacctgttcaaaattctatgtagctttcttctaaaacaaagtggagaagtactcagtctaattatcttacagagaaaataaccaggcttttacaaactactccaccactgatactaccaatctctgttttgaagccttcactgatctgctgtctgccttttatttcctgaacagatactgtgcacaggcctacacaggtaatagctaatgtcaatatacatggacactcttaactgtctgaatcagtgttatgtttacttatctgataaaacttcaaaaaaactggtaaaatatcaggttgtaaccaatccaccttgttttttcgagacagggtcacattatgttgcctaagctggtctcaagcgatcctactacctcagcttcccaagtagctgggaccagaaacgtgccaccgtgtgctcccccttgtttttaataatgctaaataattccaaaaaataaactatcacttttcaaatacctctaacattgtagacactatgctacacacatatttaatttttattctcactcctaaagaggattaagtataactatcctcaccttggagacgagccaattgattaagaggttatgtgctttgcccatggccaaacatataggaaagtgcaatgagttgattccagagtatgagttcttaaactaagacatatattattttcctagctacaattaaatgtgtctgctaataactacctgggaaaatttagcatcaaattttctaacactaatatctccaaacatttaaaatgataaaagaaaataaccatccaataagggaactctgttacatggtagcatactttataattttctgatggccttatcatgaagcacttatactccagaatgattcttgcactggcataacagatggtcctctaaaattttcagaccaaattatcttgttcaaaactgaacttgctcatttaagatgattcaagtcttgtgtaattaaaaaaaaaaaaaaaagtgaccccactaacacctacacctctgtagctatttggggaagaattaaaaaccaagctattaaatgttcacagtgaattattttgcggccagttctctcctatttaaagcagactgcttgtattttaatgtcagctcataatactggtatttgaggtacttgaatcttataaaactgcctgctctacagacctcctgaactgaaaacgaccaaaatcagattcctactcagccaaaaacctgcagtcatctttcaccctttcttccttcaatccaccatctaactggtcaccaatccctatacaacccatctgccaaactcttaaatttgttctcactaatccagttgccctgaagttcctatctcaatcaacacttgtctgtttctattctctccttcctccagttcttctctctgccagggtgtcaaagtgatcttgatcaacagaaatccagatgtgtcaaattttccttacaggtctttaataatccttcttaaatgtgaggtagagtccacgctctttcacatggcctacaaaagccatcataggttataaaaagctcctctctactttcttaacattattctcggagctttccaaatgtatcctgtactccattaatattgaaatacttgcaactgctaacaaaacacactcattcaatcattcagtaaatatctactgaggacctaaggatcaggccctattctgtatctccttgcctttgtaggaatatagcagtacataagaccagctctcgtggtgcttactttaaagagacaagacaataaaacaaacaaaaccccccaaaaaccagtatttcagagagtgaaacctttttttttttagatggagtcttgctctgttgcctaggctggaatgcagtggcgcaatcttggctcactgcaacctccgcctcatgggttcaagcaattctcctgactcaccctcccgagtagctgggactacagccaagtgctaccatacccagctaatttttttatttttcatagagacagggtttcgccacgttagccaggctggtctcaaactcctggcctcaagtgatccacctgcctcggcctcccaaagtgctgggataacaggcgtgagccaccgcacccagccaagatagcataagctttgtaaagtcagtaaaacattattgatataaaaagtgtaacggggtaaatttaaatcagggagacagacttcaatggatgtaacatttgaactgagaggtgaatggtatgaagcaaacacccattcagaagatctagggacagaaagtttcaagcagatgacaaacaagtacaaaagccctaaggcaaggatgtacttggagggttccacaacagaaagaaggctagcgtaagtgtaatgggccaaatgttaggtagtactctgttggagagctgggttgggattatgtaagaacttgcaagcctaagggttaaggagctgagtttttgttaaagccaattagaagctatgaagggttcaaactaggcagtcgtgtgatataattacgatttaaagatataattctcaagccaagtgcggtagctcatgcctgtaattccagcacttcaggaagctgaggccagaggattgcttgagccctggagttaaagaccagcctgggcaagatggccagacctcatctccacaaaaaaatgaaaacattagctggtgtggtagtgcatgcctgtagtcctagatactcagcaggctgaggtgggaggattccttgagcccaggagttcaagtatgcagtaagctgtgattgtgccactgcactccagcctggacaagagagcaagactttgtctctaaaaaaaatttttaaaaaaatgtatataattctcaggacaggtgcatgcagaagctcacacttacaatcccaacactttgggaggccaaagcagaaaaatcccttgaggctaagagttcaagaccagcctgggcaacagagcaacaccatgtctctacaaaaaatttaagaattagccaggcaaggcggtatacatctgtagtcctagctacttgagaggctgaggtgggggatcgctggagcccaggagttcaaggttacagtgagctatgattgtgccactacactccaacttgggtgacagagcaagacctgtctctaaaaataaatatggtcaggtgtagtggcccatgtctgtaatcccagcacttgggaggctgaggtgggcgatcacttgagcccaggagtttgagaccagcctgggcaacgtggtgcatccccatctacactaaaagtacaatctggtcatggtggcatacttgtagtctcagctattcgggaggctaaggtgggagaatcactggagcccaggaagtcaaggctgcagtgatccagccactgcactccagcccaggtgacagcgataccctgtctcaaaaattagttaattaaaaatatatatacacgcacacatctacatatataattcagcctaatatgtacaaacattgtaaaggagcaagagagaaaaagcagaatgattaactaaggaggctactgcagtggtcaaaccctttggtagtttggatcagagtactgactagcaaaagatgaaaagaaatagcaagctatggatacactgtagagggagagccacaaggagttcctgatggatggattcataccttcatgcatttgcacatactgttcttcactcatgcttccaaatctgtctgcctagaaaactcctaagtatcctttaaaccacaatttaaatctcacctctgcataaaactgtctccaatctgcccagcccaattagttgttaaattatctatattcccagagaaccctgaatatgtgcctaatctaccatttaccactctatgttttacccacatacatccttactagcccgcaaggggaagagtaagcaagagccaaatctcatttatctgtataactcctccagtggccatctcataccgtccctaccaacaggcttctaaaaagctcaataagtggttgcaatacttatcaaacagagatttaatattcagagagctacctaaaatttgttaagaatctagtaatcttttctaaaacttctcttcgttcagatcgtcagaagaaaagatagggctttcccacttctcatctaaattttattcttaccacacctttttaacattaaaataaacctcaaatacttctggaaaagggagataaataaaaccatataattggtgtaatttgactaacacatcaaatagtatgaataactaccttattgaaggcagcatagtttgctgaaatgtttgtgcaaacactggcaataaccttttcaagtatatgggtgccatttccggatctcctttgggctcattacattcttcttcatctttgtttgtatctttctttttcttatcatctcctttattaactggacacatccaatcacctacagacaaatattttttaaagaaatacttttttggaaacttttgctttcaaggaaaaaaaccttaagatatatccaacttcaaataataattatctctaattaacaaatacactgaaattagaacattgtttcaatgatgcttataagaatactaaagagcactagtaacttcaatgtgctcaataacaaattaagaagataattttggatactccacttcgttccaaaaattatttcacagagcttctggattcatcaaccctctgaaaacttaaaactttggtcagccgggagcagtggctcacgcctgtaatcccagcactttgggaggccgagacgggcggatcacgaggtcaggagatcgagaccatcctggctaacacggtgaaaccccgtctctactaaaaatacaaaaaaaattagctgggcacggtggcgggtgcctgtagtcccagctactagggaggctgaggcagaagaatgacgtaaacccgggaggcggagcttgcagtgagccgagatagcgccattgcactccagcctgggcgacagagcaagattccacctcaaaaaaaaaaaaaaattttttttggtcaaactacctatctaaacaataccaaagtattctttatctgacattcccatattccttgaactttagattttggttattctggaatcaggcagtcacaatctcaaagaacatagaaaattaagctgttaaacaggtttattaaatataaggatatacatatataattatttgacttcataggaatagttcatttatataaggttaatgtgtctacagaaagctatggaagtgaaagctgaaaaataacagtagatggcttcaaaagaaagaatgtagctctcacctggagactgaagaatagctaccacttcactatggcccctttctcgagctttatctaatggagttttcccatcttcatctctcagatctggatttgcaccatgccgtaacagagtctagagaagaaaagcatttaatttgaatataacaatactttatttctttgacatccaactatgtaaactaaagattttccagaattacttaatcaagcaggtggcaatccatatctctgcctttgcacttagtaccttaaaagcagcctattctgtaatctcagcactttgggaggccgaggtgggtgggtcacctgaggacggaagttcaaggccagcctgaccaacctggagaaaccccgtctctactaaaaatacaaaattagccgggtgtggtggcgcatgcctgtaatcccagctacttgggaggctgaggcaggagaatcgcttgaacccaggaggcagaggttacagtgagccaagatcgcttgaaccattgcactccagcctggtctacaagagtgaaactccatctcaaaaaacaatacaaagcagcctatcgtaacttgaaaaacttatgaattaattgtacttggttatttatcatcatctcaaattaagtatattccatcttaacatgtcaccttctccatcaaactctgcctcccaatttctttaaagagaggtactgtttaatttatgatctggcaatcaatgacatcgcctcctatatactgccaattaccaagttaagtcaaattaaattttagaccaaaaagtcaaccaggtgtggtagctcacgcctataatcccagcactttgggaggctacaccggaggatcactggaggccaggagttcaagatcagcctaggcaacatggtgagagctcgtctctacaaataatacataaataacaaaataaaaataaaaattagccagtatggtggcacacgcctatagttctatagtgactccggaggctgaggcaggaggatcacttgagcccaggaattcaaggttacatgagctatcattgtaccactgcactccagcctgtgagacagagcaataccctatttcaaaaataaaaagtcatcaatatatccacctctatacccactaacaccttaaacctttcataatttcatacccagactaattaatcacaatggctcaataaaaacttttttgctaacagctgactttaaaagtacttgaaagggaaactctaaaaccttctttgctcactcagtattagtcacccttagaagcatcattctctctaaaaactaaccaattcaaacaaatagaattcaggcttgaagagaccatccttcacaggctagaaagctacgaacctgttattgaaaatgttgttgtagtgtaaagatgacaataatagcagctaccatttgagcacctgcaatatgctgattactacagtaaatctatacaatatatttttctaattctcacaataatcttgctaagaatatatacttattttatagacaaacttaataaattgtccaagatcatatagccttttttgtgcataagctgagactcgaatccaggcatgcacaacttcagagtggactaacctcgtactataccaaataacttcacgattggcagattacagacacctagttcatacatttgatgtaaacctttccatttaacctctttggacctcaatttctctaactgtaaaaataactccccaaagtcctttgctagtctgagtctagtgattcttctacaaacagagtatttggctgggtgcagtggctcacacctataatcccagcactttgggaggacaaagcaggtggatcacttgaggctaggagtttgagaccagcctggccaacatggcaaaaccctgtctctactataagtacaaaaactagccaagcatgatggcacacgcctataatcccagccacttgggaggctgaggcacgagatcgtttgaacacaggaattcaaggctgcagtgagtcgctactgtgccactgccctccagcctgggtgacagagcaaaaccctgtctcaaaaaaaaaagaaaaggaatattttattgatgaatacaaacaagagaaaatataggcaaagttattcattgccaagagtaacaaattggaaacaatcacacgttcaacactaggtgactagttgaataaacttgtagtacaggatatgcatacagatataaaaaagttctctacatgctaacagggagagatctctaatttatattattaagtaaaaaaacaaagtacaggtgagtgtataagaaaaggagggaacacatatatatatatttgtttttattgaatctgtattaggaaacactaaaaagaaaaaactaattaaaaacacttacagtgagtaagggggaatgaagtggatggagatggcatggaaataaaaggttttatatcattctaatttttaaaccatgtaaatgttaaaaattagtaattttaaaacctagactttacctttgctacttgaggtcttccaaaacatgcagcataatgtaatgatgatgacctttgacctctattaacatctgcacctctctcacaaagaaattctacctgtaaaatgataacgaatcataaagctgctttttattaatatttctatccttaatttaaataccagcttttatttattagcttaccatttcctgagttccaaaagcagaggcccagtttaatagagtctgacctacatcatccataaaatttacttcaaaggctgaaattttgaaggaaaaaaaaagaaacgtatttttaaagccaataaaatactaaacttttctaaagactgaaccattttaagatcgtcattagtcatcatctaaataaagagccaagagagtgttttaaatatttaggtcaactatagagcagtacataatcagcaaacttgagatcagctaagaaaaagtatttaagtccaggcaccgtggctcacgcctgtaatcccagcactctgggaggccgaggtgggaggaggtcaggagtttgagaccagcatggccaacatggtgaaaccccatccctactaaaaacacaaaaattaggcgggtgtggtggcacatgcctgtaatcccaactacttgggaggctgagacaggagaatcgctcaaacccaggaggcagaggacgcagtgagccaagattgtaccactgcactccagcccgcacaacagagcgagactctgtccccctactaaaaaaagaaaaaacatttgaaaatgtttaaaccactggagattcacaaggctttaagtcttaaaaataaacatgaaataacaaaggaaaatactaaatacacaactaaataaggtagtagttgctaaaagaggctaatccacatccataatccaaagaacacagaagaacaaatctgatgacccagaagcatctttcaggaattatatttgctcatcacctcatgtagcagtcaaaaaaaatctgcattattataattcattcacatcagttcctatcaatcttgagaaaaccttagaatttataagatctccttcaggtaataaaacagaaatttcaaactttatagaagttttacccattcaacaagcatttattcaggtttcaccaagaaccaagctgataattacataattatgcacagggataggggagaatatcgaaggggtgccactttgttatctggatttctaagagtactgtccgaaaactagaaactgcctatatggttatctcacaactttctttttatatttaaaaaaatattttctgacctcctgtgtcaattgcatctataagtgcatcggtatctttacttcgaatacaatctataagctgccgatgtgagcgctccccagaactatctaatctccggagtcctgggattctgcctgtagatccagcactagactttggcaaagcttttcgtccttcaaataatagcaccaagagaaggtcaaccaaacgcatagtatcaagcacacatctttcatcaccctgcaatgcactttcaattgaatctggaagctccgacctcagaagatcctagaaagagaatgggaagaaagatgtttaatatattagcattatacaaaaacactttttctgaagattaaaaagcaaagattcaaaaacattcttacatgtgttactaccggagagcctctgcaaagtgttgagagcagacttacaattgttgacacctgattactcaatttggaatctgcagtggtggatggagctcctgtggtgctgcgacctggtttgcatgctgatgatggtcctgaaacagtaccaccagcagcagccattcgagataacagctcctcagttaatccatgcttggctaatggagctgggtcaacaccacgacgggtaaatcggtcagccagtgatgcaaagcatcgcagagctccatctgaaacctaacaatgtgaagaaaatgcccacagataaaatccacctaaaaagggttagtaatgatcatttcaatactgacactataagaaaggcaactgcagcaaagtgattaagcatgtgatctgcctattgaatcgtggctccatatactgctaactgtgtaatccgaggaagttacttaaactgcttaaggcctcagttccctcatttgtaaaatggggatattaatggtacctatatctcattgtgttagcttaaatgaggtaacacatataaagaatctagatggataataaaagctcaaaaatattaactattattatgtgtacctttgtcatgataatctatgatatcaactgaaaataacatctgaacaataaaaagtcattaaaagccaagttttattttctaaagtatgctaattcaataaggatttacagataagattataaatactgtcttatgcctggcacagtggctcacgcctgtaatcccagcacttggggagactgaggtggacagatcacaaggtcaggagttcaagaacagcctggccaatatggtgaaaccctgtctctactaaaaatacaaaaattaaccaggcgtggtggtgggcacctgtcgtaccagctacttgggaggctgaggcaggacaatcgcttgaacccgggaggcagaggttccagtgagccaagatcatgccactgcactccaccctgggtgacagatcaagactccatctcaaaaaaaaaataataaaaataaaaaataccgtcttatttaaatgagatctatcttaagtcaacaaaatcaggtcaacaaaattgcaccaagtcagcaaaattacactcagtacaagtacagctgtaaaaacatttttatgatatttaaattttaagaataaacatatatcacacttataatcttaaaagtttcattcccaaaatggagattaccacatgcagagataaaattagagaaagaggatggaattacctcgatttcatcaagtgaaaagcacaaattacagtctatcataattataaacaggggaacactaaaaaaatcactttctgaaaatggaaagtatgtaacagcaacttatttacctgatgatcttcatgctttaataaactagacagagattctacacaaatttctaaagaagaatcttgaggctccattttgccacagagtcttgataccacagccatagcagagtgcaaggtgtctttatgaactagatgtccactgtcacgaatgaaggtaagcacacaattcaaaccaccagcctcaaagactgctcctgactcacgagtacatatcagttctaatacctataatagtaaaacaaatgtaacgaaagaatgcaagcctgattttcaagaatcacagaaacaatgcgctctccaaatttattagtgacacattaaaaacagaaaagtgaaacaaatgaaattaattttaataatacattttagatgggtgtggtagctcacacctgtgatcccagcactttgggaggccaaggttggcagttcgcttgagcccagaagttcaagactaacctgggcaacacggcaaaacctgatgtctacaaaacatacaaaaaattagccaggcatagtagtggcatgtgctatagtcccagctactcaggaggttgaggtgagaggatcacttgagcccaggaggtcaaggctgcagtgagccattatcgcccattgcattcccatcctgggcaagagagtgagactctgtctcaaaaaataatagtaacagctgggcatggtggctcacgcctgtaatcccaacacgttgggaggccgaggcgggtggatcacttgaggtcaggagtccaagaccagcctgaccaacatggagaaaacctgtctctactaaaaaatatcaaattagccgggcatggtggcgcatgcctctaatcccagctactcgggaggctgaggcaggagaatcatttgaacctgggaggcggaggttgtcgtgagccgagatcgcgccactgcactccagcctgggcaacaagagtgaaactctgtctcaaaaaaaaaaaataataataataatattttttatttaacccaatatatccaggcatcatcatttcaacatgaaatcaatatagaaaattactgatatatattatagtcttttatgtatagtctttaaaaatgcatgtatactttatacttataatgcatctctatttggagtggccacatttgaagtgttcaatagacttatttggctaccatattggacagtgcaggtttagaaagtgacatctgtatggcaaggtaaagaactacaagtaatttagcaaaagctcataataatactctaacactatttgtctttttcattatcattctcatgagtctagggtagcattttccagaagctaagcatgatgtgatactgtacaagactgaatgcaaaagcagacaggaggatccagctgtctactgtaaaaacagagtgttcttaagagacttgcaaaaatgcctaacaattccagtcttctcactaactttgtttatttaaaaaggttatttttcattaacctgttatgtataacatgtaattaatttattttaagataaataaatactttaaatttatcagtttcagtatctaatatggtaaataaatagacaaaacctatatgaacaaaagctctttgggtatcctcaattatttaagacttgtaaggggatcctgagacaaaaaatttgagaactgctgacctaaagcagcaaaaattataaaaagaatgaagcagaaatcattaaaaaaaaaaaaaaacaagaaaagaaaaaagaatcaggggccagtcacagtgactcaagcctgtaatcccagcagcactttgggaagccgaggcaggtagatcacctgaggtcaggagttcgagaccagcctggccaacatggtgaaaccccatctctactaaaaatacaaaaaattagccgcgcatggtggcacgcgcctgtagtcccacctactcaggaggctaaggcaggagaaccgcttgaacccaggaggcagaggttgcagtgagctgagactgcaccactgcactccagcctgggagacagagcaagactatctctcaaaaaaaaaaaaaaaaaaaaaatcatgtaaaatctcaatgtattcaccacaaatagttccaaaaaagtatggatctagcactaatgcttttagagttacataaagacaacagcttactttacagggaatatagcaaaatagttaaatccctgggccctagaaccaaacttcctaatcttcaaattcctaaacttcaagtcttgactcttctgctcactactcccaagtatgttccttaacctcagcatacttgaatttctttcatctgtaacagagaaatgataatattcggctgggggtggtggctgacacctacaatcccagcactttgggaggccaaggcagggggatcacaaggtcaggagttcaggaccagcccggccaacacagtgaaactccatctctactaaaaatacaaaacaaattagccgggcgtggtggtgggcacctgtagtcccagctacttgggagactgaggcaggagaaccgctggaactgggaggtggaggttgcagtgagtcaacatcgtgccactacaccccagcctgggagacacagcaactgtctcaaaaacaataataataataataataataatactattcctggcaccaacctatcccatatagggttgctgtgaagattaaatgagttaataccttaaagtgcttagaataatgtctagcactggtgggtggtgtttgttgtggtggtgattgttactattataatacaaaatgatttgggtaagaacagggataacctatctctaagtgactaccaggaactgaagtgcactgaagcagcacataacatagcaatcacctacagttttccttctaagataagatttcttttcgcaagtcccatggaacctcctttggtgccacaagtgttgtgatttccactgttctcaactactctcaataaagtaagactgaagataggaagaatttttttttttagaaattttttttttttagtaaatacatttttcagtctctaagtgatgtttaaatgagccaatactcatccctgagaggtctgagaaaaataagtaatgagccaataagtaatacttacctttacacactgttcggctaagtctctgctagtcctgttgttaagttcaactacaaccaaacgattacaaagtgcttttatagctccatctaccccaacaatccttcgggtacattccgcagatacatccaggtagtatgttatggcacgggctgtcacctctaatacattgtctggagcactttcatcaagaaaaattttgcaaagggctggtaagaaagtgcgaggaggacatctgtagtgaaagaaatcatattacatctagggttattaaattcttaacagcaaaatattaacaaaataatagaaaataaaaagttataatgtaacacactgtgctcaatactgtgtctgaatgtttattaggtaatatttctcacattgtttttgcttccataacaatactcacatgctaatttcatcgctgctgagaataccaaggtgtaaatggtttaaaacagcagcattaacttgaaagcatgtttaaaaaaaaaaaaaatggccaggcatggtggcccatgcctataatcccagcactttgggaggccgaggcgggcagatcacctgaggtcaggagttcaagaccagcctgcccaacatggcgaaacctcatctgtactaaaaatgcaaaaaatcagccgggcgtggtgacaggcacctgtagtcccagctactcaggaggctgaggcaggagaatcccttccgggagatggaggttgcagtgagccgagattacgccactgtactccagcctgggcaacgagagcaaaacaaactctgtttcaaagaaaaaaaaaaaaaaaaaattcagcgctcacctcaaacatgaactgctctatgaaaccctccttaagctcccaaatacttaagtggtactttcatgttccttaaccctcataaaagcagcacatacactgtttaatgtatcactttatttccttattcacttaaaatcccagaaggccaggaacactgctcaattcatatttttcagaaagaagcactgatttggggtctaaaagactggggtgaaaaaaagaacagcaactgtgtgacttttctgcgtctgtttccttacttataaagcataagtaatagctaaataacacctactttaggtcaggcacagtggctcatgcctgtaatccttgcactttgggaggccgaggcaggcagatcacttgaggtcaggagttcaagaacagactggccaacacagtaaaaccccgtctctactaaaaatacaaaaattagctgggcatggtggcacatgcctgtagtcccagctacttgggaggctgaggcaggaaaatcactcaagcccaggacagggaggttgaagtgagctgatattgcgccactgcactccagcctgggtgacagagcaagactacatctcaaaataaatacataaaataaaataaaataaaataaaacaaaataaaataaataataatactttatatggttatgaagattaaatgaaatcatacacattaaaaacagctcagtgcctagcatattaaactaaactttagcccccatcctctccctttaacagtctaatgcttattacacaaacctgtccaagatagttccatcaaaaacagaatttttgagatatcattaatactccctatattttatcaacacttaaaatatgaaaagatcataatttacatttagtagaaatctcagctatgtgacatcaaatacattattctagtttctctagacagactaaactacagctacagacaacacaaagggtaataccctcaacattttaatggaataatttatcttcctattcttagtgtatgcaaatgagtacttcccatacctttagtagcctttaagaaatatctgtatgaggccaggcccggtggctcacgcctgtaatccttgcactttgggaggctgaggcaggtggatcacctgaggtcaggagttcaagaccagcctggccaacatgatgaaatcccgtctctactaaaaatacaaaataattagccgggtatagtggcaagcacctgtaatcccagctactcaggaggctaaggcaggagaattgcttgaacctgggaggtggaggttgcagtgagctgagatcatgccactgcctgggcaacaagagcaaaactccgtcttaaaaaaaaaaaatctgtatgaatgttaaagtatatctaattctatggtttaatatctgcttagatgattcttaacttaaagggtccagaagaaagaatactgttaaaaaaattttagggcccgtatggcggctcacacttgcagtctcagcactttgggaggctgaggcagttcaagatcagcttggcaacatggcaagactcactattaaaaaaatacataaaaataaaaaaattttagaagacatctttcatgcaatgactgagtaatcattgattaaacacaggtttttgtttgttttttgatagtctcgttctgttgaccagtgcagtggcataatcttggctcactgcagcctctgtctcccatgttcaagcaattcttgtgcctcaacctccagggtagctaggattacaggcacacgccaccacacacagctaatttttgtatttttactagagatggggtttcaccatgttggccaggctggtattgaactcctggcctcaagtgatctacccacctcaacctccaaaagtgctgggattacaggcatgagccactccacccagccagaggtgttttttactagccagcaacactggcaacctatgacatatagtcatttgtaatatttctaagtcaggaattaaatgccttgaggctaggttgtaagagctagtccagcagttctcaggtaaggtcacaaaactgcctagcatatcagaatcttaagccttgttagagcatactacatatgctctatatatgcatatgtagtagatggaagaaatgaaaagagactgttaaagtgttaatactaaagaaaaaacacagtctaaaagagtaatgtgttttctttagaaaatagtagttttttgaataaagaataaaatgaagttgatagtccaagtatcaaatgacaagaatagatttaccatatgctttatagtaatacaattattcatccatttttcttacccagggtaaaaactgtacatcaaaaaaaaaataaaatttaagagcaatgcttagtataaacttaatacatttcatgggggaatgtagtatttgctaatttggggaataatagttcctgctgtgttccctaaaatgcgatgcatttcctgaacaagtatagttaaagagccagtttaggctgggtgcagtggatcactctgtaatcccatcactttgggaagccaagatgctcccatcttgagtgcttgagtccaggacttcaagaacagcctgggcatcacaaggagacttcatctctacaaaaaaatgaaaaaccaagccaggctggtagtgtgcacctgtggtcccagctactcgggaggctgaggcaggaagctcatgtgaatccaggaaatcaaggctacagtgagccatgatcgcacctgtgcactccagcctgggtgacagagcaagaccctgtctcaaaagaaaaaaaaaaaaaaacaacaacaaaaaaacagagccagtttcaaaaaggtcaaaacccagaaagctctaacctcatagggtatcagattttaattgtgatcaactgtgttcctaagaaatatctgttgtgccttggctattggacagaaaaaccaatttgtttttttagctgttgagttactttttcaacagtaacaaggtatccggggcatattcctacatacgtaaaatgcacttttttttatatcaaggtttcaaggaaaatcaaagaatgtctttttcttttttttttttttgacagtctcgctctgtcacccaggctggagtgcagtgacaccatttcggctcactgcaacctccgcttcctggggtcaagtaattctcctgcctcagcctcctgagtagttgggactacaggcacctaacacatgcccggctaatttttgtatttttagtagagaatggggtttcaccatgttggccaggctgatctagaacttctgacctcaaatgatctacccatctaggcctcccaaagtgctggggttacagatgtgagccactgcgcccagcctcttttttttttttccagacagggtcttgctctgtcgcccaggctggagtgcagtggtgtaatcatggcttactgcagcctcaaccttctaggctcaaccttcctcccacctcagcctcccaagtagctgggaccacaggtgtatgccaacacgccgagctagtttttaaaaatttttttgtagagatgcagttttgccatgttgcccaggctggtctcgaactcctgagctcaagcaatctgtccacctcagcctcccaaagtgctgggattacaggcatgagccactgtgtccagccaatattcctattaaactagttacatgataatgagatttttctttctgtgagttttgctaataaaaactcacattactggccaggcgcaatggctcacgcctgtaatcccagcactttgggaggccgaggcgggcagatcacttgagctaaggagttcgagcccagcctggccaacatggtgaagtctcatctctactaagaatataaaaattagccagcatggtggtgtgcgcctgtagtcccagctacttgagaggctgaggcagaagaatggcatgaacccgggaggcagagcttgcagtgagccaagatcaagacactgcactccagcctgggcaatagagtgagactctgtctcagaaattaataattaaaaaaaaaaaaactcacattactataagctactattatgaatacattaattgccaatgcaaaaggaaatcagctggattaggcagactcctttcatttacgtggtatttcctgtaatacagccactgatttacggcaaatacagccaaattcttgaaaattatctctttaatacgaaaacttaactaaaatttactttacacacaaaaaaggtaaaaaaaaatcccagattcctaaaaataaagcaagaaatttgatgtaaaactcagtaaccctctagcaatcagtatgtgaaaacatatacattaaaaaaaataaattatatagaatttgttatattttatttaaaatatacataaatataattatactgtatttatgtgaaatgtattagcaaaaaggtttacatgagtaacaaatttttgaaagttaactcaaagttaatatacttggatacctctcatgctaacaatacttacctaacagaacaggtaaatttgctctaaagtttattctgttataaattcagttgctcataagtgaggttttaaaaataacaggtttttttcttaagggattcaagtgtatattatttcccctttatctgttaatttataatagactagcatagcaaataaaatttgcaacacatgaaattatagtgtatgaaactcaagatgggtcaaaattatctgaagtgaacaatgttaaattcagtcttcagagaagagaaattctgctgaactcagtggagggccttttaagtcaaaaactattccaataattttgtgtcatcactactcaacttaaaacttatgagaattcttgaaatagtaaaattttgtctttttttttttttttaagacagggtcccactctgtcacccaagctaaagtgcagtggcgcgatcttggctcactgtatccttgacctcccaggctcaagcaatcctctcaaatcagcctcccaagtagctgggaccacaggcatgcaccaccatacccagttaatttttttatttttggtagagacaagttcttgctatgttgcccaggctagtcttgaactcctgggctccagcaatcttcccatctcggactcctaaagtgctgggattacaggtgtgagccaccacaccttgcccaaaataataaaattttaagtggttataaagacatattattcaagtgaaaatagatgtaatcattatcttacacataattctaaaaacttttctttaaaacaactttaaaacactattagaagattcctaacaaaagtactcaattaaaatacaggttaagccatgcacagtagctcactgctgtaatcctagctactcagaaggctgaggcaggatgatcacttgagcccaggatttctagaccagcctaggcaagatagggagacccgtctctaaaaaaaagattaaaaaattagccagctgggtgcagtggctcacacctgtaatcccagcactttgggaggccgagccaggtggatctcttgagctcctaagagtttgagaccaggctggacaacaaagtgagaccctgtcactacaaaaaatacaaaaagccaggcatggaggcgtgcacctgtggtcccagctacttgggaggctgaggtgggaggatggcttgagtctgagaggcagaggttgcagtgagccaagatcacgccactgcactctagcctgggtaagccacaccctgtctcaaaaaaaaattagctggcatagtggcgcatgcctgcagtcgcagctatttgggaggctgaggcaagaggatcacttgagcccaggagttcaaggctgcagtgagccatgatcacgcacaatgcactttagcctgggcaacagagtaagattctcttaaaaaatatatgtatacacagacatacacatacacacacatatgcatataggttaatagtatttattcacaactgaaaagccaattacaaaatctcaaaaatctaactataaatcaagcaaagacattgggaagaaaatgccaacattaattactgaattctaaaaaatacagatagttgagagaattgtattacctgaaagttcacattgaaactaaaaaaaataacaagtgtcatttcctaatagatacttggctggatattctgctttaatacagccattgtaatttaaacagataagatttaaaaactgatgcttctggccgggcgcggtggctcacgcctgtaataccagcattttgggaggccaaggaggacggatcatgaggtcaggagatcgagaccatcctggctaacacggtgaaaccccatctccactaaaaatacaaaaaattagctgggtgtggtggcaggcgcctgtagttccagctacttgggaggctgaggcagaatggtgtgaacctaggaggcgaagcttgcagtgagccgagatcgcaccactgcactctagcctgggcgacagacaaagagagactcagtctcaaaacaaaaaacagaaaaaaaaaaaacctgatgcttccactgttagggaatttcatagcatcattttcagagaaaccctgtgttgacagataattcaacttgaggccaggcatggtggctgatgcctgtaatcccagcactttgggaggctgatgtgggcaggtcacttgagcccaggagttcgagaccatcctgggcaacatggtaaaacctggtctctacaaaaaacacaaaatttagcaggtgtggggacacgtgcctgaggtcccagctactcaggaggctgagatgggaagatcacatgagcccagggaggtccaggctgcagtgagccataattgtacattgtactccagcctgggcaacaaagtgagaccctgtttaaaaaaaaaaagaagataattcaacttgacctttgtggttattggacaagcactcgactaccttctatgagcaaaactctcaaatcccttgccccatttctggctaaatgaacgaccccccacattccctaggtctgaatctatgtcaacagggattgacaaagaaaaaatattcacattatcaggaaatttgaccttgctataaatttacgatcaccaaccttaaatgagcacaatacctaataattctgctacatttctttcacggtctggaatgagtattttcttcaattttctctcgatttatgactcccctggttttccactctagcttccttcctagattccctcgtcatctttcctatctctttaattacctttttaatggatttcatccattctcttagttcatacaccacaaatataaatctcatccacatatcacaaaaactccctaagtattttctccaccctagactgactcaatatcactatctccatttagaaatatcacaggcatcttaaaatgagtatattcaaaacaaaactcctgatgtgtgcctctattcccaaatctccatcatagtaaatgtcaaccatccagaaagccaaaaagctgagaatcattcttgatttccccccatttcacacccaacccatcagttaaatcccaccaattaggccaggcatggtggctcacacttgtaatcccagcactttgggaggccgagccgggtggatcacctgaggtcaggagtacgtgaccagcctgaccaacatggtgaaaccccatctctactaaaaatacaaaaattagataggcgtggtggcacgtgtctgttatcccagctactggggaggctgaggcatgagaactgcctgaacccaggaggcagaggttgtagtgagctgacatcacgccactgcactccagcctgggcaacaagaacgaaactcggtctcaaaaaaaaaaaaaaaaaaaaatcccaccaattaagccctccaaaatatatcctatgggccaggcacagtggctcatgtctgtaatcctagcactttgggaggctgaggtgggcagatcacttgaggcaaattcgagaccagcctggccaacatgcgaaaccccgtctctattaaaaatacaaaaatcagccggacgtggtggcacatgcctgtaatcccagctactcgggaggctgaggcaggagaatcacttgaacctgggaggtggaggttgcagtgagccgagatcgcactactgcactccagcctaggcgaaagagcgagagagactctgtctccaaaaaaaaaaaaaaaaaaaaaaaaacacccaaaaaacaggcctggcgtggtggctcacgcctgtaatcccagcactttgggaggccaacgtgggcagatcacctggcttacagagttcgagaccagcctcgccaatgtggcaaaacctcgtctctactaaaaaacacaaaaaatcaaattagcaaggggcagtggcttgtgcctgtagtcccagctccctgctgggaggctgaggcaggagaattgcttgaaccctggaggtggaaggggcagtgagccaagatcacgccactgcatttcagcctggacgacagagtgagactttctcaaaaataaaataaaagtaaattaaattaaaataacctctaatctaagccaacttcaaagtctggtttgcactactgaaataacctcttatacatctacataagagctatgtccagcactggcactgaggagcagcatatctggaaagaagaggagatcattctggtataggatattacagcatgagcaaagtgaacaggacatttgtgcaatggaatgtcccagtgatgggcaattgatacatacagaagaattgatcaaataaatatatgaaggataatgggaaggataatgtttctcactgaaggaaaagagaactgaaaatacagaaagagaaaactagcatgagccctgtggtgttagattagaactagagatacttgtatgaactcatggttttttgtttttctttgttgttgttgatttttgaaacggagtctcactctatcaccggagtgcagtggcacaatctcatctcactgccttctgggttcaagcaattctcctgcctcagcctcccaaggagatgggactacaggcacaagccactgggcctggctaattttatttttgtattttttagtagagacggggtttcaccatgttggctaggctggtctcaaactccagacctcaggtgatctgcccaccttggcctcccaaagagatggtattacaggcgtgagtcaccacacctggcctgaacacatgggtttcaaaatatagagacagctgtagatagatagatagatagatagatagatagatagatagatagatagatagatagacagacagataaaagctaatgtgtgtgctgttccatctgtctaaaatccttttcccctaactctttccaaagctagctctttgttattcttccttttttttttttttttgagacagagtcttgctctgtcgcccaggctggagtgcagtgacacaatctcagctcacttcaacctctgcctcctgcgttcaagcgattctcttgcctcagcctcccaagtagctaggattacaggcgcctgccaccacacctggctaatttttgtatttttagtagagacgaggtttcaccatattggccagggtggtctcaatctcctgaccttgtgatacacccgccacggcctcccaaggtactgggattacaggcgtgagaaaccgcgcccggccttgttattctttctatctcagcctaaatgtcacctcctagacttttagactacattccctaactaccccaaacagacctgtttttttctctttagaatttatattttatttcttcttatccattgtaactctctcctaaaagctcctcaggactagggatttatttcatacagcacacagcagagtttcctgcacagaagtgacactagccttttacatgctgaataacttttttctgcatccagaatgagaagccaaatgaaaagaattccttcagctcccttaatgaactccaccacacatgcccaatccctcacaaatatacccccatccctccatacacaacttcatcctggcccaattcccacagggtcacccacctcactctacccacctgcccccaactttcccacaacacaaacaactgaatccacttccatctctcatttcccatagtaaagcaaaatgtcaactctagcctctagcccaaactgctcttctaaataacagaactgcagacacaactgcctcccctactcatctactgccacctggatatgtttcaggagccttcaaacataacttgcccaaaactaaaagacgcttctctaccaaaagccatattacgcatatcctctaacctaccatatgcctagtcactcaagtaaaattcataaaagttttccagaactcttgtttctaaaatacaaaatctaagacttaatcttgttggttctacctcctaactcggtttagtatctgtccttagaattccaaccctcctcacttcttttttgtattactaccacagcttcctaaccagaatctctcactagattctccagtccattcaccattctattacctattaccaaagatatatttttaaaacacaaatctgttaatttcatatccttcagtaccctgaggataaaatccaaatgcatcagccaggcacagtggctcacaccattaatcccagcactttgggaggccaaggtgggattgcttgagcccaggagttcaagaccagcctgggcaacatagcgagatcccatctctacaaaaattttaaataattagctgggcatggtggtgtatgcctatagtcccagctaccggatgggggttagagggctgaggtaggaggatcactcgagcccaggaggtagaggctgcagtgagctgcattccagcctggatgagagtgagaccctgtcttagaaaagatgcttgaggaattacatgataaggcagctagtattttccaatgatgtccacaacattatctacctcccaccccacataatcttttttaaaatgtgactttgatagtcttccctatgagagggcctgagttctttcctcttgaatccgagcaggcttatgattatagtgaaagtgaccactgtgtgacttcaaatgctaactcaatgaacaagatgatacagcttctgctgcattcttttgggactcatgctcttagaacccagtcaccatcctgtgaggaagcctaagcagccacattgagagtccacatgtaggtgtttcaactaaaaaatctaggcaaggtcccagctagaagccaggctcgaccacatgcaacagaacaaatcatctggtgattctagtgcctaagtgtcaagtcacttcccatctttgagatttcctagctgaggtcccagatatcgcagaacagagacaagccatctccactctaccctttccagtttccaaaatccagataatctgttagcataattcttgtttaatactactaactttggggtgatctgtcacacagcaataagtaactgatataaatgatccacaagtattgtggtgcggctggaaatcagagccaaagggcaaaagatcaggatgaactcaccgagtccagattgtgtcttagcttttttctgagtacaaagcaataaaatgaaaataccatagaaacatataatgtacaaagtgaaagtccccataatttcaaccaaagaggtaatactgtatctaaagattgatgagtgttagtccttttcttgttttgttttgaattctaagagagtcagtcctactctgtaggccagactggagtaggatggcacaattacagctcactgcagccttaaacaccatatgcttggctaactttttttttattttttgtagagatgggggtctcactatgttgcccaggctggtctcaaactcctgggctcaagcaatcctcccaccttggcctcccaagtgtggggagtcgctgcgccaggccctattttttatacattgatttttttaagagataagttctctctctgttgcccagactggtctccgactcctggcctcaaatgatcctcccacttcagcctcccaaagtgctgcgattacagacatgccccactgcaccccaccttttttggttttgttttttaaaaagacagtgtctcactctgtcacttaggctggagtacagttgtgcaatcataactccctgctacccggatgtttcaggagctccaaactcctgggctcaagcaatcctcctgcctcagcctcccaaagcactggggttacagacctgagtcactgcgcctggcctcatttttccatatacttaaacattttatgttttcgtaattcacaagtagaaccatactataaatactatcccataatttgcttatttccttagtatgttatgaccggccaggtgcagtggctcacgcctgtaatcctagcactttgggaggccgaggcaggcagatggctttagctcaggagttccagaccagcctgggcaacacagcaaaactctgtctctacaataaatacaaaaataagccgggtatggtggcacatgcctgtaatcccagctagtcaggaggctgaggcagggaaaaatggcttgagcctgggaggtcaaggctgcagtgagccaagatgacaccactgcactccagcctgggctggagatggggtttctccgtatggaccagaccctgtctcaaaaaaaaaaaaaaaaaattactaactgattgaaatacatatataacatcaaactttgtaggatacaactaaagtagtatataaagaaaaatttatggcattaaatgcttcaggcctcaaaccccagctttcaaaaatcaaaccccagctttcacttaagaaaacagagaagggctggcgtggtggctcacgcatgtaatcccagcactttgggaggtcgaggcaggcggatcacctgaggttgggagttagagaccagcctgaccaacatggagaaaaccccgtctctgctaaaaatacaaaaaaaaaaaaaattagccagatgtggtggtgcatgcctgtaatcccagctactcaggaagctgaggtaggagaatcgattgaactcgggaggcagaggttgcagtgagccgagatcacaccattgcactccagcctgggcaacaaaagcaaaactccatctcaaaaaaaagaaagaaagaaagaaaaacagagaaaaaggccaggtgtggtggctcacgtgtgtaatcccagcactttgggacactgagacaggtggatcacctgaggtaggtggatcacctcaggtcaggagttcaagatcagcctggacaagttggtgaaatcccatctctactaaaaatacaaaaattagccgggtgtggtcttgagcgcctgtaatccgctgaggtaggaggacaatcgcttgaacccaggacctggagcttgcagtgagccaacatccctgtcactgcactccagcctgggtgacagagcgagactctgtctcaaaaaaaaaaaaaaaaagaaagaaagaaaacagagggaaaaagagcaaattaaacccaaaaccaaagcagaaagcaataataaagaacagaaatcaataaaactttaaacagaaaaatagggaaaatgaatgaagccaaaagctggttcttggaaaaggttcttggacaatggctaaatctctagtcagattaaccaaaataaaaaggataaaaataaccagtatcaggatgaaaaaggggtttatcactaaagaccctacagatatcaaaaggataaaagggaatatcacaaacaactctatgcccataaatttaaattcagattaaacagacaaattccttacaagacattctactggccgagcgtggtggttcatgcctataatctcagcactttgggaggccaaggcaggcagatcacctgaggtcaggagttcaagaccagcctggctaacatggtgaaattccgtttctactaaaaacgcaaaaaattagccgggtgtggtgacaggcgcctgtaatcccagctactcaggagaccgaggcaggagaatcacttgaacccaggaggcggaggttgcagtgagccaagatcacaccactgcactccagcctggcggcagagcgagactccacctcaaaaaaaaataaagtaagacatgctaccaaaactcacgcaagcagcattagataacctggataatcctatatctatcacataaactaaattagaagtaaaaaccttcgaacataaaaatttattctcttatgaattgtgcttttggtgcttatctaaagaaatatttgcataacgcaaggtcacaatgaatttctcctatgttttcttctagaagttttatagttttaggttttacaactagatctatgattcatctgggtttttaaaaatatatatagtgtgagatagtatcaaagttaaacttactgcatatggatatccaattgtttcagcatcacaaaaaaaactatcctttttctactgaactgcctttgtacctttgtcaaaataagttttccatatatgtggaagtctatttctgaactctatattctgttccacagtactatttgtctatgtttatatcaataccacattgtctttattactgtagctgtataataaatattgaaatatagactagtgttagttcccaactttgttcttcataaaagttgttttggcaagcataagtcctttgcatttccatataaattttgaaatacgtttttcaatttctacatcttgttgaatttatctccaagaatttcagaataaaaacttatggctggacgtggtagctcacgcctgtaatcccagcactttgggaggctgaggcaggcagatcacctgaggtcaggagttcgagaccagcctggccaacatggtaaaatcctgttcctactaaaaatacaaaaattagccgggcatggtggcgggcacctgtaatcccagcaacttgggaggctgaggcagaagaatcggttgaacccgggaggtggaggttgcagtgagccaagatcacgccactgcactccagcctgggcaacaagagcaaaactctgtctcaaaaaacaaataaataaataaatattttttaaaagcttatgttctcacacacacacaaaatctatacactactgtttatagcagtttaggtcataatcaccaaaacatccatgaaaaggaatattacttagcaactaaagagaatgaactattgacacaatagcaacacagatgaatctcaaatgcgatatgctaagtgaaagaaatcagactcaaaaaactacgtattgtatatatgattccatttacatgacattctagaaaagtcaaaactatatcaacagaaaacaggccaccaagtgccaggcattgggatggggaaagggtttgagttcaaagggacagcactagatgatgtttcaaagtgatggaaatgttctgcatttcaattatagtggtggttacatgactcatagcaatgtacaataataaaaagctaacttccccgtatgtaatttaaacaaatttaagaaaaagttaactatcattcatagaataatcacagccctccctgaataatgctaaaatgatacttctaggcacaaaattttatatataattacagttgctcaaaattttaagcttgccaagtatttacctcttacattacaggtagaaattcttcttttttattatcttaacgtgagtactatattattaatataataccaatagattaggaagcctatttaggaaactttaggatcaatcagtctatacagaactcctgtcagagtagtcaaccacacaagtgagattatgaagaatcttcagatgactccaaattaggcactggtttccaaaatgctacctgtaaagacatcagaatctttccctgatggaagcaataaaaaaaggttacatgaggttccaaagagaaagaatttccctgggaactgtaatattttctgtattataactaccatatgcttttttcacttgaacttgggccaagatttcagaagattggcaaagacatgaaagaatataactgtttttaaaaaaaataaagggcattatctgtagtagagatattttataaaatagtctgtaaatcaggcacttcattttaaaaaaatgaaatattttaactgaaaaacctgaacacatctggtttcttaaagacaataaataacgcaacatcttttgatccatttcatattccatttttgcctctgctcccagccttgactttcttggtattgctgagctaaaaataactcctggtacagcagctgaaaattgtggttttcccttgcaaagaaaaagggggtaaagtccaattataagatgtaagtttgcttttctccaattaaaatacacatacaaatttgactgcaattcattcaacacatctattgaatgcctttctacaccaagtgctatgctaagtgttgggggtgggacacaaagatgagtaagaaagagttcactgactctgaagaattcaatctaatgatacagtcaagaactatgcaaagtacacttacaaagcgttataaaacacaatgtcatacccataaataaaaatgataaaaatctatctctgataaattttccttgtatttttcctgttgaaactattaagagtggtttttaactttttttttttttgagacaaggtctcactctgtagcccaggctgcagcacagtggtgcaatttcggctcactgcaacctccgcctcccagggtcaagcaattctcctgcctcagactcccaagtagctgagattacaggcgcatgccaccagacctctgctaatttttgtatttttagtagagatggggtttcaccatattggccagactggtctcaaactcgcgacatcaggtgatccacccgccctggcctcccatagtgctgggattacaggcatgagccaccagtggagcctggcctctacatttttttagctgacagaaactctggtaatcgtcacaaaagctccctgaatttaatcacctatggaccccctggagtcccaggtaaaccctcacagacagtgtttctcattccagcacttctctctgctgtccactgaaaagaagcacatacacagttgctgtctgtttacaggaattcatttaactttttttttttttttgagacggagtctcactctgtctcccaggctggagtgtggtagtgcaatctgggctcactgcaacctacacctcccgagttcaagcgattctcgtgcctcagcctcctgagaagctgggattacaggaatgtgccaccacaccctgctaatttttctatttttagtagggagggggtttcttcgccatgttggccaggttggacttgtactccggaatttaagtcatccacctgactcagcctcccaaagtatcgggattacaagcatgagccaccgtgttcagctcatttatttaactcttgaggattatacatatttgatatatcaatgaacattccttctccagtaaagggtcagggctgatcaacaaaagtaattcatttccctattactctgccattgggtagaagaaaacaggtcaatatagaaaaggcaggtacaggtcgggcgcagtggctcacacctgtaatcccagcactttgggaggccgaggcgggaggatcacgaggtcaggagttcgagaccagcctggcctatatggtgaaaccctgtctctactaaaaaatacaaaaattggctgggcatggtggtgtgcgcctgtagtcccagctactcagaaggctaaggcagaagcattgcttgaacccgggaggcagaggttacagtgagccgagattgcgccactgcactccagcctacacgacagagcaagactccgtctcaaaacaaaaaaaaaaaaaagaaagaaaaggcaggtatattaatggtagaaagtaaggaaagtacttattgatactgtatctgctaaaaaaaaaaacaaaaaagaatacaatactcttcctcctgcatactaacaacaagtttctcaactccacaaataccttccatgggcattttaggcattaggtggaaaacaggtccaatataagcaatctcttcaattcactccttcagtatctggatattagctatttgtgtgccaggcactatgcttagcaatgggaaaacaaagacgagctcgtagtccagtggagaactgaaagtatagtaaagtggaagtagtgtatacatgtgagaatatgcaggaggggtctttgaagacatttaaatttgatcctgtaggtgaagaacccaacagattctgtaaaagggagtagcacaggcaaatcaatttttaagactataactcagggccaggcaccgtggctggtctcgaactcctgacctcaactgatccacccacctcggcctcccaaagtgctgggactgcagataggcatgagccaccacgcccagtcccagcccttaactttttaccatcaaacccaaaacatgtgcatctaacgtctctatcttctctgttacaacggcagtacacaacttctttctgcctaaaaccaatctctccaccagtggatcagggttttgctactcaaggtgggattttctgaccaacagtttctgcataatctaggaccatattagaaatgcagaatatcaagcttcatataagaccaactgaatcagaatatgcattttaacatgatccccaggtgactctcattatgcacattaaaatttaagaagcactgcttctatacaaaagccaattctctcccagtttttcagaatccttaccctagggattattcactctctttcttatctctttgacctttaaaagaaaaaaccccacactccttttccaattcaattcttcaaaaaagtttccacatgtcctccatttcatgttccactcactcctcaacccattcagatctgcccctcaccaccactccactcagctctcattaagatcaatgaccttgagaatgttgctaaatctaaaggacatcttttcatctaacccctacttgacctctcactagtattcaaaacaattgccctttctcttcttgaatcactttctttcctgtgttgacatgcgcactaatgatgcaaaagcaatagtggataaaactgcaggtgctttaacatgaatcaaggcagtagccctaacctgtactagataactgtattcttcactgccaagcactggtattaagaaaaaagccagtttcactaaagaataaactagatgaagcaaaattattaaatttactaaatctcaacccctgaagatacatcttttcaatattctacttaaaggaaatgggaattaattataaagcactgcatacggaagaataatggcaaagtacatacttgaggactgaactagccacttttttcttgcaacaccatttttacttgaaggactatcagacaaactgatcattcagacttggctatctggcaaacattttttcaaaatttaatcacgtatgcctttcatttcaaggaaaacgatcaactgtatttgttgccaatcataacactcaactttacaagcaaaaatgacatttttggaaaacttgtatttgacaccatgagcttgaaagcttctgaatatttaaaaacttgtctgatgagagtggtagtcatattgacaaataagactttttggcactgtggaatgagatatgtccacatttggaaaatctgtgtaactcagtggactgatattttccacatgaccaatgcataatttttgcaaaagtaaacatgggtaaaacagtcactcaaagtataagacagaccatcagattttaatgtaacagagtgagtataagttcactgatatgatatcagaatccacattataactaatcctggtagggtgcagtggctcatgcctgtaatccagtactttgggaggccaaggcaggtgcatcacttgaggtaaggagttcgaggccagcctgaccaacataaaatactaaaaataaaaaaaattattccagtgtggttgtctgcgcctgtagtcccagctactcaggaggctaaggcgggagaactgcttgaatctaggaggtggaggttgcagtgagccaagatcgcaccactacactccaacctgggtgcgagaatctgcctcgaagaaaaaaaaaaaaaaaaaaacagaatccacattataactaatccttaagaaactatcacttgttgaattttgacatgttatcaaagaagcatatccatgattacgttaaaaaatataatattcttcttccctttcccaaatacatctgtggatgattttttcatatatttcaatcaaaataacataatgcaacaaactgaatgcagaagcagatatgagaatccagctatcttccattaaggcagactttaaggagatttgcaaaaatgtaaattaatgcctctattctcccaaaatgttttcttttaaaaaagttatttttcacaaaaaaattttaacatgtaaggggtttattattataatttttttttttttttttgagacagagtcttgctctgtcgcccaggctggagtgcagtggggcgatctcggctcactgcaagctccgcctcctgggttctgacctgaggtcaggagttcaagatcagcctggccaacatggtgaaactccgtctctactaaaactacaaaaattagctggacacggtggcgcacacctgtaatcccagctactagggaggctgatgctggagaatcacttgaacccaggaggcagaggttgcagtgagccaagattgtgccactgcactccagcctgggtgacagagcaagactccatctcaaaaaaaaaaaaaaaaaaaaaaaaacaacttcccagtttcattctgaatatggcaaatagcagtaagcatactaacataaacaaaagttcttcaggatccacaataatttttaagagcttaaggaagtcctgagaccatagagtttaagcatcactgccctagatctcaatcacatcccatggccacaattaacctccacaggtgcttgactctaaaatttttctctaatccaggcttcacctccaatttccatttatacaactgcttacttaatatctccactgagatgtctcaaaagtacctcatactcaacatatccaaacccaaactcatgatctcaatctctcaaacatggtcctctttccagtgttctctctcagtgagtggcatcatcatccattgtaacctgagtcatccacgacacttccttctccctctctcatatttaatcattcgacaaatcctgactatcttgccttccaaatctctctcaaatatattcaactttctacttttatcacaaaaccctctatctctctggatcatagcctcctatcaagtctacaagcatttgtttgttttgttcccacttcctatctctccttactcatccttcctagctctaggaaaaaccacttcccctttcttggccaggcacggtggctcacgcctgtaatcccagcactctggaaggccaaggcgggaggatcacttaagctcaggagttctagatcagcctggggaacctagtgagaccttgtctccatctaatttaaaaaaaaaaaaaaaaaaaaaaggtcacacctgtaatcccagcactttgggaggccaaggcgggcggatcacttgaggtcaggaattcgagaccagcctggccaacatagtgaaacccgatctctacttaaaaatacaaaaagtagccaggcatggtggcgtgtgcatgtaattccagttactggggcggctgaggcaggagaatcacttgaacctgggaggtggaggttgcagtgagctcagatcacgctattacactccagcatgggtgacagagcaagactcttgtcttgaaaaaaaaaaaaagaaaaaccacttccccaaagaccactctgcccatccccacctctccaggtcttgtccctgcttcatgctgtcacagtaccctgagcttttccttcatgacatttaacacagtttgtaaccacattttttccccacaattatctgttttccctattagactattaggcacataaggtgctgtatttgttttggtcatcaccatatctttccaagacctaacataaagtagacaatttaaagttaaaaaacttgttcctgtacaggtatttttttaccttttagtgtaaacatatcaaaaaagatttttttaccactgtgttcaataactttggaatccagactcaaaacaatgttccttggatatctcttgaaggatacactaggaaatgattaacagtggtttcctctgggaagaggaaccaagtaaccaggagacaggaaagggaagacaacggactttttactgtatatccttttgtgccctcaaaattaagtgacatcattattttttaaataaagcctactagcacctaaaagcatcttctgagatgctcaatttccagaggacataactttcaaattatattcagatttagtagcaagatctagaaatgcccataatacatatttataacattaatacatatgatgatcacctattttgatgtgaatacaaaatgctcattagctaataactcatattactattacttacttttttttttttttttggaggcacggtctcactctgtcaccgaggctggagtgcaatggcacaatcttggttcactgcaacctccggctcccaggttcaagagattctcctgcctcagcctcccaagtagctgggattacaggcacatgccacagtgctcagctaaattttgtatttttagttgagatggggtttcaccatgtttgccaggctggtcttgaactcctgacctcaagtgatctgcccacttcagcctcccaaagtgctgggattacaggcatgagccaccgcacccggccatgtttacattactacattttagaactcgatacatcaggtaaaagcaaaaacgaatcttgaacgtgttttactttctggagcattaccttgataagttcaggcattaataagaagcactgacacatcatagaagaagttatattcgttgaacttcagaaagacactgtcaaaatgggtacaaacagtggagagccggccgggcgcggtggctcacgcctgtaattccggcactttgggaggctgagatgggtggatcacaaggtcaggagattgagaccatcctggctaacacagtgaaacctcgtttctactaaaaatacaaaaattagctgggcatggctaaaatagcactgcgctccagcctgggtgacagagcgagactctgcctcaaaaaaaaaaaaaaaaaaaagtggagagccatgtacaatactaagttaaaggaaaaagaaatccttgactattatcccatttattttcagaaaaatcctgcaaggatgaggaaacagacttcaaaggctatcacacaactattcagtggaaaaggcaggtatctgaacccaagtctatcccattgcagaggccactgtttctaccacaccacctgcctttcctgactaaacagatgtgaaactattaagacaagctaattaagcaaacatattatcaggacatacaggcatgttttggtttattagacagaactaagtcctatttgctactactttatgaaatcaaggtagtatgaaagatttttaccaatattcaaaatatgcacatcatcttgctttttttgcctgctgggagttgattgtttaaaagaattttaaaagacctttccaaatcaatcactttattcatggaataaagtgctaaaataaaattcaaaattagatatttattaatgatggcatcagtgggtagcccactttactcaaaacacttaacatacattctctcctttaatcctcacaagaaggcccactggaaaaaagactactggctgggcatggtggctcacacctgtaaccccagcactttgggaggctaaggcaggtggatcaggagatcaagagatggagaccatcctggtcaacatggtgaaaccccatctctactaaaaatacaaaaattagccaggtatggtggcacgcacctgttgtcccagctactcgggaggctgaagcaggagaatcacttgaacctgggaggcggaggttgcagtgaaccaagatcgcaccactgcactccagcctgggcaacagagcaagacttcatatgaaaaaacagaaaagaaaaaaagactactgccattttacaggggaagaaagtaaggctctcagaggctaatgaacacaacagaccaagaatctgaacccaagtctctgatgccacagcccattctttccatctcactatgcctccctcactagtttcaagaaggaaccaggacaattttcccttgtaacaacaagaaaatctggctatagaatgaaaagcaaactaatgtttaaaaacaaaacagtcacaaaattaaaccaaatgtctagtttttggaggttactggtacactaccccaaacacggctaaccccttcaacttgaaatactcttgtatcttcatatagtaaatcatatctgacttaactttaggttcatttccttaaaattacattataaagccaggtgtggtggcacagcctatagtcccagctactgaagaggccgaggcaggagaatcgcttgaacccaggagctcgaggccagactgggcaacatagtgaggccccagtctcttaaaaattacatcatactatatatgaataaagcctagaaaggaaaatggaaaaaataacagctgttatgttaggatggaaggattttacatagagataaattttatgttttaaaaatttcatttaaattgttttaacatggcaacactttttttttttattatactttaagttttagggtacatgtgctcaacgtgcaggtttgttacatatgtatacatgtgccatattggtgtgctgcacccattaacttgtcatttacattaggtatatctcctaatgctatccctcccccctccccctaccccacaacagcccccggtgtgtgatgttccccttcctgtgtccaagtgttctcattgttcaattcccacctatgagtgagaacatgcatttggtgttttgtccttgcgatagcttgctgagaatgatggtttccagctccatccatgtccctacaaaggacatgaactcatcattttttatggctgcatagtattccatggtgtatatgtgccacgtttgcttaatccagtctatcatcgatcgacatttgggttggttccaagtctttgctattgtgaatagtgacacaataaacatacgtgtgcatgtgtctttatagcagcatgattattataatcctttgggtatatacccagtaatgggattgctgggtcaaacggtatttctagttctagatccttgaggaatcgccacactgttttccacaatggttgaactagtttacagtcagtcccaccaacagtgtaaaagtgttcctatttctccacatcctctccagcacctgttgtttcctgactttttaatgatcgggcaacacttttttaaatgtcataacaaatacttctactacatattagtactaaacagaagctacgaaatgacaattgacttgactgacaagtatgatttttaaaataccaaaagtaactttcaggttacctctaatgaaatctatgaacgcaatttttaacttgagagtcaggatgaggaaaaaaataaaaaataaaaataaattttaaaaaatctactttactataaatcctgctaaaacaagtgtcaactaagggctaagttattcttacatactcaaaattctgccaatgacaaaaactaatggaaataaatggaccactaactaattgtaatttggaaattttattagtaaggatttttatcttagtactgttttaacaagagttacaactgaaagttattcaataatcaaaaatgaaggtactttaaaaattttgccaactgagtaatataaactttattcccacctaaaacacattaggataattataccaaattttttaggtcaacatctcaaacattttctactaattaccttaaaatagcattaaaatgaataaagaaacatcagagttttcaattacttattactggagttcaaaactgtaaatacaaatgtaaaataaacagtaaaaacgaaacacatgttcaacactcagaagaatggttattctgactggacaagttatgacttatataagagggaaaaaaatggctgtaaggtctatctagtaagaattctcttttatatttttgcatatatactaagttataacctcccaataaaactgtttaaactccccaaacttcaaaatgtttctactactccaaattttctactcttctgctacacggttaagatccaatttataccttcccaaactgaaatttacaaaccaataatcggctttaacaaaagtactgtcatatgacaacatcaatgaagaaatgggcagttcaaaacatatgtttattatcatctcttattccataaatcaatttcatggtacagaaatagatacctttaagaaaataaatatttgtattttccccagttcatgacatattttgaaaatgaaccaaccaagctatgggttaaaattaatattcctactaattcccattcattcaacaaatatgtatttgtgtcatcgtaatcatcagtcctagagtttcttcacctaccaatttttatttcttggaaaagtgtaaacacaaaactcttcaggaatatttttaaagatacgtgttaaaattcactagagaaatttctacacaaactgaagtcagcaaatggttgaaaacagatgtcactacagtaacccaaaggaacatgatgaaggaatgtacttacgtttcaaaacaacgatccacgttgtcagacatcaaaagcagcatgcatagctgttcaagggctattagttgcatgtccctttcatctccctgtcccatctgtagccattccagcaatgtatctgggtccacatctgccatggttttttaaaagtctctttgcttaaatttgaaaagtaaagggagaaaagtcctttaaattccgggactgaacagcttgggcttaaatttttcttcctttacatctgctagaaccaaattttcatagtgtcctcctagcaattaaaaaagactcctaagtacgtttggacgtaagagtgcttaatgcagtttttcaactttccttatccgccaggtttaacgtacagatatcataccaaatgaaaaccagttttgcacaagagtatataagctgattaggttgctgcttaactagaaaccagagctgtctgtgtcaaagacagtcagtcaagcttcaggtcccactactgctatcactaaagtctatgccaaaaggcaaagaacacctaactaaaggttctgttttttccagcaaacttcatccccctccttctctacccaaaactgatcttcagataagggttagattcagtattttgaggaaactctaaacaccttgatccaatccccctccaaattgtttctccttcaaaattacctccaatttcacatattctgctgacttctcaatttacttctattttaaagatatccaaatacaaacgacaattatatacaagatttatctatgaataaagagttggttaggaattttggcagtcttggcaactattcttaaaagttaaaaaaataaaaaaattaaaaaaggaaaggctaaaagtaaatgcaatggaccagcaggttacggatccgaacgaatgtaggccaacctagggccctctttccccagcttcacaagatagggcagttggttaaaaaaacaaaaacaaaaccgagaagcaaccccaacaggtaagtcattacaaaagcgccccgtaagcgccctgactggaggacagctttgggtcccacgtaacgcagccgcaagtgtgggaagccggcggcggggcgcggtgggcacccaacggcggcgaccagcggggttgaccccacacccggggcccggccgagccgggcgctgagaggcgctggcccccgcgctgtggttccccagcaccaaaccccgctaagttaactacctgtgtctacgaggaagggaagttctggagaagcagcagcaagccttcgtgcccgagaggaggccgccgggccaggcagggcgccggctctcccgggagctgcgcccggaactcgaaggcctggcagcgaacccttctcaagggcaaaaggagccggcctgaggctctggcgcgggcaaccgggccccgccgccggcagggccccgggaggggaacaaaggggccagcggggaagtcggcagcagcctggccgacctcactcggcgccggggtctcgctttccgccactcgccgggcgtccgggatccgcgcccccacgcagggcccttccgacggtccgaggcgctcccgcctccccttcccgcaggctcttactcgggcttgtcgttccaaaccgctccgatccagctcccaacaggccgccggcagagccaggcccggccgcggccctagagttcccaagaagcc

SEQ ID NO: 1619 - DNA, 84556 bp, Homo sapiens
cttctagacaaatgaaaacatgttttatttacaagaaaaaagtctgtacattgtgtatacataaaaatatacaaaaccaaaatagaaaatatccaagtgttaaaatgtgtacaaacacttttaaaatgcgactcctggaaaacttcaagctttaattagtttgaagagtacacatttcattttaaaaattatcatacaaaagaattcccaaagctgttaaaaaagttcactggtttccactggaagaattgtctaagtatttcatctagaataaaacaggatttgttataaatgttagattttaacaccaccaatgcaatttctttgtttccaatctacctagcaagaagactattttccatagaaccagtaaatgtttcttctaatctttgaaagccatgagctacagctaagcttcccttcaaagttcagtgttaaatcaggcttctgactaggataaaatattaaggtagtgttctaccttcatagtgccttttaaataattctgtcagtccattttaatgtagccaagatgtgcagagtatgagtgtgtgggaagcggttggcggaggactgaattttttttcttttaacagaaggacatataacatttgcttccttctctcaaaatattagtggttacataattaaaataaaatttattgtaaaggtttcagtcaaaaatattgatgaaaaagcaatataaaaccaaccatgtgtgtagatatgtatatacacaattatataactatatctacatgtacacttttcatactaagaactagatcaatgtctttaattccttaaatgtcattagctcaagtttgaacagaaacatattacattactttttttttaaccaaaaggcttcattcatttaataaaacaagaacttacattttatttccttgaacggacagagaaatacctttcatttatcaagtgtgtaaataatgcccatgtgacagaaacatgcataataatctcataagagaatatccagagataaaagacaagttgaaactcagggacattttacccaagcaattaatttccagatggagttgccttgatcagtcatgtaaccactgggtaagagttctaaactatcagaaagagttctaaactatcagaatcaaaacagacaatacaatagaacatacttggaagctacctggccaataggttcactcatgtctttctgataattcccctggtcccacctcactccctttctctgtctcttaccacagctaagcagaaattcaaccaagtaactgaccacatgtactgtgtgttgatctataagaaaaactggagagagaacttgaatcatggcatttgtgcgtatgaaattcaatcacatactggcactcatctaagactgatcccacttaaagcacccaaacgggacctacctaattaattcaggagatgtgttactgctcagaagagtcaatcagcagcgtaagtatgatctgtccagcagaattaactggctcatacacatgtaagagagtgacccagctactttgatttcctaattttgaaaacgctaatgattattttagcatttctttttttgcagatgctatggctacaatgactgaggactactggagagtccaggattgattaagtgtctggctgagagaccaagaggaccagacacatgggaagtgctgtttctcgaagctctgccttcaggcagacaaggaaagacctggtcgttcaaagatgtataaaagccctcccttgcccatccaagcctgatgcttacatgcaacttttaattgaccatcccttggtcctgagcacaaagttctctgtaagagcagctctataaggacatagtgagaaaggtcagctccctgggacgagcatcggtattccatgagaacaccaggtctgttaaaggttacccgtctgcctggtgtgactggctggagaaataaggtagggagaatctagatatggttgaattgtcattgctgctcaaaatttgtttctttgtaacaacaacaacaacaacaacaacaacaacaacaacaacaacaacaggtgaaattatcttgaaatacaaaagaacgtctgttggtcctgagagtgaaaaaaggaatccttaacagcttcagcttgcaccaagaggatttttttttatcagcttcccttcataagagaggatggaggattttggaagagacagaacctgggagaaattcagtgagctgccacttactgttaactactccacagaagaactatatgtttattggaattcagtaaatgtggcatgtaaggatttagtcaatgtctggcaaaatgctgccacttaggacccatttggctaatactagaagtagtcatcaagttaactgtaactgcccaacattttcttagaagccaaagaacttaaacttttatagaagaacgcccagtcagtactatattaatgtgtgtattacatttattgactgttgaacagagcctgattcccaagagtctttaaggccataataaatgcaaaaattgtaactaaatttcctttgtactcttcagtctttcttgtaacctcaatgaaactgaaagtactattttaaaagtacaatgactacgacaaaattccatttaaaaatctttaaagtgttgggttctgaggcttttgaacttgaatatttacactgaccccaataaattctcctctaaccaagttctcatgtcagccaagggggattatgctggatagtaaggatgtctacaagtaaatccacttgcaaaactataaaaggagcttcaggggcatttaatggtctggaagatctagaaagatccaaggagggtagggagtaatattcatccaccacagccacctcacccacattccagagttgctgaaattattacacacatgtaaacataaggacaagacaaagttttttcaagaaattagaaaggaatgaccgggcgcggtggtggctcacgcctataatcccatcactttgggaggccgaggcaggcagatcacaaggtcaggagatcgagaccaccctggctaacacggtgaaaccctgtctctactaaaaatacaaaaaattagctgggcgtggtggcgggtgcctgtagtccccagctactcaggaggctgaggcaggagaatggtgtgaacgtgggaggcagagctggcagtgaaccaagatcgcaccactgcactctagcctgggcgacagagcgagagactgtctcaaaaaaaaaaaaaaaaaagaaaagaaaagaaattagaaaggaacatggcttaaccatgtctatttagacataagttaatatataggacaaagttacctatcccttctcattgacttaataacaaaactctcaaaatgggcttttattggatattattgtgattaaaactttccaatttctccttcactattatagcaagctataggagatgtcttgttttccagctccatatctgctgaatagactaaccaaacagaagccttcagtctctgtaagccattcttgctcaagaaagtagtcctgagaacagtctagaagaaaccaatcctgaaacaaagaaaacttttccactaaactctcctgacattcatacattttgcaagggagaacgcatttaattaagctgctattgtcattgcaacaagtcttaactgtaccatggagatatgttttggttatacattgaaataatagcatgtttaattaaggtattacagaatgtttctgtttcactatattcatagcaaaaatttttcaatgtatcagtgacagttgagattaaagaaaaaatcaaccctgaatatagctaacatattgggatgaaaatttccctctagctgcctttccctctgaagcatctacatattttccttgttaataagcaatgctttcacataaattatttaattatatggctttgtcatgctgctgacataaaacatatctgcaaaagcaaggactggattcctaaatgtctgtaggaagatttagtgaagattcagtgctcatcactgtggagttcccactggctgataaaaacctgcaagaaacctgtataataaagacaggcgtgcatccctagaagcacagggtgatggctccaaaatctttccttctagtttggaaggagcaaggtgtctcccgtcttccccagcacagctgtgccaattgtcaagtgtgtcactgactatgcaaaagctgcagggtagatctgcaggtgaggaggtacaaggcagaaaagccagaaccggggagtgtccaggggcacctgcagccctgtgattctatgttacttgccagtgatgtgcctcctggtggatgtgatactaatgttcctggttgaaatactgcagggaaacaaagggcctcctctgtggtgctatatggaatttggctttttcttggacctttcaagatggatgttttctggttttagaactctgtcttgatgcacagaaagcaaagcattcagtgggcaatgggaggcagagatgaagaatgcaacggttggaaataaaagcctttgccaggatgtgctgggaattttttgctgttaaacacatctgagtgataatttcaatgtctgtcataaaacctaggatatttaatgatgaatgcatgtataactgacacactcgatgctgtaaatgatgtccctcaatttgaatgtttctaaacataaaccacttcatatggtcaggaacatcaccaaaacctgtcattgaaaccaaccctgatgaggggtactcatggcagaagaataagttgttaacatttctggaggtatcatacccatggtcatacatgtgttttctttctagctatccttggttttgcatctttcttgagccttatttttttaaaaaaaccatttctatgttcaaagcagtaatacatactcaatggcttagaaagagaaggattatcatgaccaccactaaattactgtttaaagactcaaaactacactgtctaaaatctatcttcaagtattcttttgtgactttgagtacaacagtagtaccttattgcacattgattcccaagaaaccctttttaagagtgtggaatgactggacttggtgcagggcagtgcaccgcctggaagccgggaagaaccaccttgcccttgcgatgcaaatccccctgcgtgcccatgttcaggcgctgcaccaggagcttctcatagagtagtgggtggtacgccccgagggtgcaggctgcgtcgtagtacagctcgtggtagtggcacagctccgtctgccgcacggatgggatatattcatacacgtgcacctctctgcacatggacatcattatgaggattcctgacatgaaaaccaaaaattagaacctaatgaacaactccatgtgagagggatgagttttttgggggaggggtggtggtgatgggatatgactgtggcaagagacacttacttttttgttgttgttgcatttgcaatgttataacttccattaagtggtgtgtatgcagttcatggagtatgggggcatattaaaatgtaacactatatatatatatatctattcgctcatttaatttatcactgtgggcctggtaaggagagatgaaaagaagtcagtgaacttgagggaaccacacgctagtgaaggacagatttgcaaccccccaaatcagagtttcctgtatcacattctatacacatgtcccatctggtttgcaatgatgggacagttatgttccaaagaaacaaatgccataaaaactaaattataaaatagttgcttgattataaattgactataatacagttgtttgaaaacttgtaacataaaactgtacaatggatcagctcttatactatagttgtctgaatggaaagaaatggagttaaagcgacagagtttaagattcatattaacaaaattatttttctcactgaactatcagtgttaaacttttaattttttaatgtttcaaataatcagctataacagctaatcatcactgagtacattttattctttttttttttttttgagacggagtctcactgtgttgctcaagctggagtgcagtggcgcgatctcactgcaagctcccccttccccgattcacgccattctcctgcctcagcctcccaagtagccgggactacaggcgcccaccaccacgcccggctaatattttgtatttttagtagagacagggtttcattgtgttagccaggatggtctcaatctcctgacctcctgctccccccacctcggcctctcaaagtgctgggattacaggcatgagccaccgcgccaggcctgagtacattttattctttatctagactaatggctttctttcttttctcaacaccaccatgccactattaacttgaaagttaaaaaaaaagacatctcttttctgaaagggatgtcccttgttataaaaaacataaagcagcacagttattcttgttatagccaatatttatctgaagatgacagtaatattccctaattaaccaaccatgtgtgcaacacaaaaatcccataccagaggagtcctgtataagggacactgggagagaagagagaaagggcctaattttgctgaggggttccagaaaggctgcccaaaggtggagaagtgtgaagctcaaggggctgcctggtggacaaggggtagaaggaaacaggagaggggatactgctccagagtcagcaaggatagcttgtgtagtagatgtcagagtcatgatatggtatcatagttgagagtaaaacacactcctaacaaagacaaggggattatgcacttcaaattctatgcagtcaagttgctctcaagagcgatggtcagaacctcaagttactgggtcaattcctcttgtttttctcccaggtccctctaccagtttccttccttcttccatggctgcctggctgctgcccctcccttagatcagcctaaagcactgtgattcaggcattcgggtggcaccaattgaggaaaaggaagcagtaccccccagatgctcgaaatgtctgcacccatggagaaacatgagtgcagtggtcaaaagtctgcctcctgattagtaatgactgctctcaaacattttttctcccctgtataaaatcatatacaaggaattcacatggtgaatgacatctgcccatggagaattaaattcttttatttccagtcacttgccgacatggtgaaatcccatctctactaaaaatacaaaaaactagctgggcatggtggcatgtgcctgtaatcttagctacttgagagactgaggcaggagaatcacttgagcctgggagttggaggatgcagtgagccaagattgcaccactggactccagcctgggcaacagagcaagactctgtctcaaaacaaaacaaaacaacccacaaaaaaaccttaaacaaacaagaagtgctctggtgtgaatgttctctggtggctgaagttttcccagagcctgtgtctgtggagctgaggacggcttcatgttttctaatcaggggctacagaccaagttgctgtgcactgcccagcattgggggctccccatctcctgggcatgacatctgctctgccagctctgcacaaggaatcacgctgaagggggtggacttcatcacgggcatcattaatcaatatatttattacaacactttgcttgcacatggcaggggggtggcttcaagagtgtcttttacacaaagtcactgtataacctagcagtggaactgtacccagaaaccacagttctttgctacttgggcatttctatgagctaataacacaatggcgtccgtaaggactggagtcagttgtgttggagttgtgacctttgcaactctggttcttaaactggatggttttcaaaagccaatcttatacttaggggagtatgttagctgtgcagttggtcctccccataaagcagtagtcctcaaagttcagcatggaaaagaatgacacaggcagcttgatcaaatgcaggttcctgggacttgtcttcatttccagaaattcaggttctattggtttgtgctggggtccaggaatctgaacttttaacaagcgttccctttaggtgaaaggccagttagagaaaagttccaacctatcacagaccaatgcttttgtaaaataccataatgaggaactacgagaaaaatgatcaactatttggatgccatggctatgtgaaattgctataaggtgtctaaatccttccattttctacacgaatctagttgtagaccagtaacacacgttcctggaccagtgctggtctactctccatgctttaaggaccaggttgttttaacacacatattttttgaaaactgctgaggaatccctaagttctctcataggtagcaagacattctgcatgttgacagctgatctagatttgaactgctaccaaatccaagtaactctggggagcttccctatacatccttgctatcctcttagactcaaagagctatcagatgcttgaatctgattgtttttccagagaaaaattttatccttgctgctagttaaccgttaaatcgtgttatctgctaaatatacaatatagattttgtcatagactatgcaaatagttatgctttcaatatatgtaaataggcacacttttagtattttcttatataagtactctatatttaaaaagaacttcttcagcttcagaaatagagggatttgtcagttagctcatggcagtccaaattgaaagccaatagatcctatgaaagtgggtgtttgtcctgagttttctgcacagttcttcctgatctttgcctatcagatagagatttagcaacaatgatttctccatcttgttttgtagtctcatgaattggtggcttcctgaaactatgaaccatggcttggagcatcctaaaattaaacagtagaatctaccctgagtgtttaggcggcagccagctgcagccactgatacggaattggtatggaggcatcttccaaaaaaaaggaaaaaaataatttaaaactcactgtggagtagggcgtgcagtggctcacgcctggaatcccagtactttgggaggtcaaggcaggtggatcactcaaacccaggagtttgacaccagcctggacaacatggtgaaaccccgtctctacaaaaatatacaaaatatcagccaggcatggtggctcgtgcctgtggtcgcagctactcaagaggctgaggtggcaggatcaccttagcccagaggttgaggctgcagtgagccatgattgtgccactgcactctcatgctcactgagcgacagagtggcatcctgtcaaaataaataaataaataataaaactagtaataataaaactgtgtaatgtgaaaggcagacaaggaggtttatggtgccaaagacgtagaatattctttaacattttaactttttttttcaggcagcatgatcaattcatttagcatatgcatacttagtcttttaattttctttaaggctgttgttatacataaatttgagtttagattcagactctgtcatataataaatagtgaaaattattagtattaaatttgattccatctacatatcaattttcctaagagttaataatagtacttagcaatacacaaacacctgaagaataaatttcttcatactttgcaaaagagaactaggtagatgtcaatgtttggacatacataacaatagctcttacatggttcagaatggggtaggtggggagtagatactgcaggcagacaggacggggacaggattagggaagaatagagtctttaagtgctgtttgaggcctcctcaattaaattcaacatctatcaagctgaccacggtactaatcattggcaatttagagcacctttctttaaaaaggtaaagatattaaataaaactaaagatttcacctttaaatttaaagacagtagaaggcccatgaccattcttaggatggcttgaagaaagtatcctaaacgtcatactgagaaaaatgtttatgaactaccaccagatctcttctgcaatgccccaatgctgagccttgtcattcacaaatgactaccaacagcacacagctctcaaatgaactctgagtcaccaccattaaggtcctgtgtcagttcccaacacacccctaggttcaatgattcaataggaagacccagaatctagcatagggttttactcacgatgatgatttatacaaaatgatacgaagcaaaatcaccacaaggaagaagtgtacagggtaaaaagtccaggggaaccaggtgcgagcttcaagaatccactcccagggagtggcacagggactgaattcccccagcaatgagttgtgaccactgctacgaactgaatgtgtctccatccccactcacaggttgagatccttcctaatccttaatgtgatggtattaggaagtgaggccttgggaagtgattaggtcacgtgagtggagccctcatgaatgggattagcgcctttgtaagaagagatgttgtggagatgatttctctctgcaataacaccatgtgtggaaccagcaagaaggctccgtctctgaatcaggaagagaggccaaactgaccagcgcctgctctctaacgtctcacctccagaaccatgagagagaaatttctgttgtttaacacatccagtctatggtatttcttatagcagccagaaataatggagacaacaacacaaatgaaattttgccaaccagggaagcttttgagagactcagtactcagtgtttctatttgaaactggtcatgtcagcagtctctgcctggcatgtactaaaattccagactctcggaaggaaagcaagtatccagcataaaccacatttcttgcataaacagcacacacatagtgaaccacgcttatcagttagaggggtgggaaccttcccaaaaaatccaagttcccagacatcagccaagggccagtcttataagcaggccttcctgaggataagcagtcaagctggcggtgttgtcttttctgcccggataccatatatgcacaaattcaaagtatcacattactttgtaatcatttccccatgccagactgatgtggggaatttacatctggttatgctaaaaatgttattgattctttttttatttcctctcttatgtctgctcaggactacataaaatgcaagaagaatacaaatcatctaataacatgcaattcagtaaaggacagcttttaaaaagcatttaagaaacttttatgttaagtaattttgtttaagaactacaaaaaattaacaactttatcactaatgaaagttttactgctttcaacatgaggctggactttttgataggcagatcaagatttagacacgttttaatgtattttttcaagccaatcaaatgggtatggggccagctgttttgaatctttaaacagtatgaatgttaagtttcttatatggccagttttttttttttttttgagatggagtctcactctgtcgtccaggctggagtgcagtcgcgtgatctcggctcactgcaagctctgatatggccaatttttacaaatgagcctatatgagggattcatttgaagaaaataagtattagtattttctaggcaattgtgactcaagaggcattcatttgctgaactgtatgcttttaaacatcatataacgcaagataattatcaaaccatttaaaaagcatttctactggttttgataaaatgtcatgttatatgattcagcataataagcagaatgggcacttatttatttgctccaaaacctgaataaaaggcaaactttaacacatgttcagattatcacaaattctagatgactgaggtttcctttatacatctttaattggcatatatagatatatttgatgtgttatcagagtctagtataatcatttagcatttagcttaattgtggttatgccaaaactatcttgttttccacttggcagaatatttaaaataacatcccaaatcattgagaaaaacaaaattttctccttgatgaaaatagcctttcattaaatagcaaaatgagctctggatataaaacagaacataatacaagtaacaggaaaactaccagtttaaatcaattctaataaacacttgaacataactcacacatgaagtaaattagcagtttctaagagtcaccaatagaacactgcagaacacttttccgaatgaggggtgagggtgaaaggctaagtgtattaaatatgccagactaacagaactctaggagctgttttgtggtttctccttaaattcaatcataaaatggaaaataatgacagctacacttgagattcttaaagagataaaagtgactttttaagtggtagttctagaaaatatttgtaactaaaagatggtttggaaatttgaacctgatgtaatttaagaagactctaccaccctaaacaaaatagtataatgcaagaataatactggaaggtcaatttttagctcatttacactgcattatttgttgttatcacacactcaggattcattatttacaggaaaatacaaaaagttgttcctaaccaacaaaactgtgacacatttgacacgatcctaaatatagatgttaagtagcttattattttgtgttaatgttctgagtttgggtgacacattaaaaaatgagattccaaaagccaatataaaatggaaaagaaagaagttatgatgtgtttttaagcctattattcttgtgcatctataaattggcctgaaattacagtgtttgcacctgtaagcttcagaaatattagttacaatattacgagtagtgtttgcgttcaaaaaaaaaaaaaaggcaaggtgggggtgttgctggcttctgcaataaaaagaattggcaattgtaccttaaaaaggagttccacgtctatgtgtatgttgggcagaggccctggctacaaggcctgtctgcctgttaacactcaggctgggagccggggtgggtgaggctggtgcctgctggtgtgcctggatgccctactgcatgcaggtggcaaacccatccagctgtgcatgaagaccccaggtgagatcactcacctataaaaatatgtcattacgtgggcaaaatagaagctacaggactccaagtaaattattccttatcctcagtcaggcacagtcaaaatgacttcattgcactgaataacaagataaaatctctagtatctgactagggatgaaagagagaaatgctcttcatatgtgaacaagtagctcccaatgggctgagtgtaaggaagctaatgagatggagaagttgttccaaagaaacgagtccttatggatcatctaaattaccctgattcatgttacatctttttagttttaaaaatacatgtgcagtccaataataggtgtatgaattcctttattgcttctctagagaaggagatagtacatgtaacacaatccaatatatctactagtgtactttcttctgtgaacccagaggacaaatatggagtctaattagaaactcaactacataattcttgggaaagcaatatgtcagctcttatcaataatcaccagaatgccataccctttgcactggcactaatactcctgggaatttatcttaaggaaatagtttaaagaaaagtctatatagtcacttactgcacataatttgtatgagtacatacatagagtaatgacttgtcaacataattgtttgataatatcaagcactctgaaacaaccagaatatcaacaactaaacaaaggcatatattatgatacacctgtttgatgtaattatatgatctctgtaatagcaaggaaaacaaaagtctattttcaccttgattataggtcttaatgaaagaacagtccttttctgtttgggaaagagtcttatttgacctattatacattttcagatgacacgcattacaataacagcaaatagtaaacattagttattgtgtttaggcacatgataattcaaagctaaaggtactatcagtatcttcattttacagatgaaggaactggggtttggagatgctaagtaacttgttcaaggtcatatagctactcagtggtagggccaagacttgattctggtctctgtagaatctaaggtcttagccacagtgcacacataaagtgacaggccaggagggtggccacccttctacatatgagaccagttaaatcaaaggtgagagtctataagatgacatcaatcacagcctcccattcattcatttgttttttcaatcagggaacaccatgcactgtgctgtgctgcttcacagtgagggagccttgttcattacaacaacgttaaaatctggatgtgctcaagatttggaagggtatacactaaaataaagtcaggatggcagtaccagaaaaggaggtggagttatttggtgtttttaaaattgtataaacatttagttatattactattttgcttctttttataaggactgcaaagttctaggagattatcccaaaagttgcaaagaaaaactaataaagtaaggcagagtcattctcttccttaaggtttggtgaaagctttggacacatacttatgtgaggataaatagtaattctaaacctcctcagccttacatacgttaataaaatgggatttgttaaaaagctagtcaggtttttactgaattccaagaaataatcttgatactaaaagtcaaaacatatttgcaaagttatggtttaagtgttttgaaaaataattatcaataattgatatgcaactttgactcaggtttccatgattaattgcagtaaatagtcaactctaataatgattcttcagaatattttgtgaggtggagttgctcagtaataacaaaaacctgatgttaaaaacacagaaaacaagatttaaaaatattaatttagaaatttgagagggctaacttcagtacacattagttttaaaaccttaataaggatatagggaggcagagcaagatggccgaatagaagcctccaccaattaattgtcctgccagcaggaacaccaaagtcaacaactatccacacaaaaaaagcatcttcgtaagaaccaaaaaccaggcgagtgatcacagtacctggttttaattttctatcactgaaaggagcactgaagagagtcggaaactcagtcttaccttgccaacaccgtgcctcctccatcccccagcagggaggagaatctgtgcacttgtggggagggaaagtgcagtgactgggagactttgcaatggaactcggggctgccctgttacagcagaaagcaacaccgggcagaactcagccagaacctatggaaggagcatttagaccagccctggccaaaggcaaatcatccatcccagtggtcacaacctgagttctggcaagcctcgccaccaggggctaaagtgctcctgtgtcctaaataaacatcaacggcagtctaggccacaaggacttccattcctgggcatgtcctagtgctgtgctgggctcagagccagtggacttggaggcatgtgacctggcgagacacaagctagggcagccaagggagtgcttgcaccactcttcccccaactccaggcagcacaggctgcacctctggaagagactccttccttccttatcaggagaggagagagaagagtaaagagaactttgtcttgcaacttggataccagctcagccacagtaggatagggcaccagatagagtcctgaggcccccattccaggccctagctcctggctgacatttctagacacatctgagccagaagggaacctgcttcatggagagaaggactcagtcctggcaggatccatcatctgctgactaaagagctgctgggtcttgaataattagcagtggtactcaggcagtactcactgtgggccttgggtgagactcagagccatgttggcttcaggtgacactcagcattttcccagtggtggtggctacagggagggactcccgcttgaaaaaaggaaaaggaggagtaaagggcactttgtcttgcagcaaaggtaccagcttgggcaaagtgggttagagcaccaagcaggctcctggggtgccagattccaggcgttggctctcacacagcacttcttgacctgccctgggccagaggggagccccctgccttgaaaggagaatcccaggtctggtagcatttaccataagctgactgaagagtccttgggccttaaatgtacattggtggaagccaggcaatactcactgtgagcctgggctagtagtggccatgggagacacccctctgctgtgaaaaggggaaagaacagtggggaggactctgtcttgtgccttgggtgccaggtcagctgcactaaatacaataccaggtagaatcctaagtttccgactctaggccctggctcccagatggcatctcaagacccacctggggccagggggaactcactagcctgaagggaaggacacaagctggctggcttcatcatttgctgattgtagagccctaggacattgagtgaacataggcagtagccaggcagtggttaccatggtccttaggtgagagccagtgctatgctggcttcaaaacttatccagtacagtcccagtgatggtggtcacagaggtgcttttgtccccccttccccactctaggcagctcagcacagagggaaagactctgtttgtttgagagaaagtgagggaagagaacaagtctctgactggcaatccagagaattcatctggatcttatccaagaccaccaaggcagtacctctacaagtctgcaagggccacagtgttactgggcttggggtgccccttaatgcagatacagctgaagtgaccaaaaacttagatcataataccatactcaactcctttcaaaaacctagaaagccttctcaaaaaggttagatacaaacaagcccagactgtgaagactacaataatacctaacacttgaatgcccagacaccagaaaacatccacaagcctcaaaaccatccaggaaaatgacctcatcaaacaaattaaatagggcatcagtgaccaatcccacagagacagagatatgtgacctttgaacagaaaattcaaaatagctgttttgaagaaactcagtgaaattcaagataacagaaagaagaaattcagaatcctatcagataaatttaacaaagagattgaaataatcaaatacaatcaggcagaaattccagagttgaaaaatgcaattgacataccaaggaatgcatcagggtctcttaatagcaaaattattcaagcagaagaaagaattcgtgagcttgaagacaagctatttgaaaatatatagtcagaagggacaaaagtaaaaagaataagaaagaataaagtacacctgcaggatctagaaaatagcctcaaaaggacaaacctaagagctatttgtcttaaagaggaggtagagcaagatataggggtagaaggtttattcaaagggataataacagaaaacttccaaaacctagagaaatataccaatattcaagtacaagattatagaacaccaagcagatttaacttgaaaaagaatacctcaagaaatttaataaccaaactaccaaaggtcaaggataaagaaaggatcctaaaagcagcaagagaaaaaaaaaacaaatattaataacatacaatggagctccaatatgtttggtagcagacttctcagtggaaaccttacaggccaggagagagtggcatgacatatttaaagtgcagaaggaaaaacaaatacacttttatcctagaatagtatatccagcaaaaatatccttcaaacataaaggagaaatgaagactttccaagacacacaaaaactgagcgatttcaacaaaactagatatatccaacaagaaatgataaagggaattcttcaatctgaaagaaaagaatgttaatgagcaataagaaatctgaaggtacaaaaggtactcactatattaagtacatagaatattataataattatagcctgtaaactattcatatcttgagtagaaagactgaaaaatgatcaaacataataactataacaacttttcaagatacagacattaaaaaaagatataaagagaaacaacaaaaacttaaaaagtgggaggacgacacaaatgtagaatttttattggttttctctttatttatgcaattggtttaaaataatgaattgaagatattatttgccaacctcatggtaacctcaaattgaaaaacacacaacaggtacacaaaaagtaaaaagcaagaaattaaaataccaccagagaaaatcactttcactaaaaggaagacaagaaggaaggaaagaagaaagaggagactgcaaaagaatcagaaaacaacaaaatggcaggagtaagtccttacttatcaatagtaacactgaatgtaaatggcctgaactctccagtcaaaagacacagagtggctgaatggataacaaaacaagacccaatgatctattgcctacaagaaacacacttcaccaataaagagacacatagactgaaaataaggagatagaaaaagacattccatgctaatggaacccacctcccaactaaaagcaggggtagctacacttgtatcagataaaatagacttccagccaaaaacctataaaaaaaagacaaagtaggtcattatataatgataaaggggtcaatttagcaagaagatatagcaattgtaaatatattttggacccaacactggagaactcagatccataaagcaaatattactagagctaaagagagagctagaccccaaaataataaaggctggagactttaacaccccactttcagcattggacaggtcatacagacagaaaatcaacaaagaaacattagacttaatctgtatcacagaccaaatggacctataattatttacaaaacatttcatccaatggctgcagaatacacattcttttcctcagcacctgggtaattctcaagggtagaccatatgttaggccacaaaacaagtcttaaaaaatttgaaaaaactgaaattgtatcaagtgtattctctgactaccatggaataaaactagaattaacaagaggaattttggaattaaaaagatgaattttggaaactatataaacacatgaaaataaaatggtatgttcctgaatgaccagtggtccagtgaaaaaatttagaaaaaaaatttaaaagttccttgaaacaaatgatagtgaaaacacaacataccaaaacctatgagataaagcaaaagtagtaccaagaggaaagtttatagctataagcatctacataaaaaagtagaacaacttcaagtaaacaaccaaatgatgtatctttaaaaagcagaaaagcaagagcaaaccaaaaccaaaattagtagaaacaatagagatcaagcaaaataaatgaaattgaaatgaagaaaatgatacaaaggtcaatggaacataaagttggctttttgaaaagataaacaaaattgaaaaatatttagccagataaagataaaaagaaagaagacccagataaataaagttagagatgaaaaaggagacataatacaactgatgtcacaaaaatccaaagggtcattagaggctactatgagcaactataatagtatatattaaattgtatatatattaatagtatataataaattggaaaacctagaaaaaattaatacattcctagacacatacaatctagtaagattgagttataaagaaatccaaaacctgaacagaccagtaacaattaatgagatcaaaactgtaataaagtttcccagcaaagaaaagtccaggattcaatggctttactgctgaattttaccaaacatttaaagaagaactaataccaatcttactcaaaccattctgaaaaataaaggaggagggaatacttccaacctcattctacaagccgtcctgataccaaaaccagacaaagacacatcaaaaaagaaaactatgggccaatatctttgatgaatattgattttaaaaaatcctcaataaaatactagtaaattgaattcaacgacacattaaaaaaccattcatcacaaccaagtgggatttatccctgggatgcaacgatggttcaacatatgcaaatcaatcaatgtgatacattaacaaaatgaaggacaaaaaacatataatcatttcaaccgatgctgaaaaagcatttgaaaaaattcaacatcatttcatgataaaaaccttcaaaatagtgggaataaaaggaacataattcaacacaataaaagccatatatgacagacccatagctagtttcatactgaatggagaaaaattgaaaacttttcctctaagatctggaatatggcaaggatgcccactttcatcactgttattcaacatagcactgaaagtcctagctagagcaatcagagaagagaaagaagtaaagggcatctaaattcgaatggaagcagtcaaatgatccttgtttgcagacaacatgatcttatatttgaaaaaacctaaagactccgccaaaaaactattagaactgataaacattcagtaaagttgcaggatacaaaatcaacatacaaaaatcagtagcatttctatatgccaacaatgaacaatctgaaaaagaaatcaagaaggtaatcccatttacaataactacaaataaaatacatgggaattaaccaaagaagtgaaagatctcgataatgaaaattataaaacatccatgaaagaagttgaagaggccacaaaaatatggaaatatattccatgttcatggattggaagaatcaatactgttcaaatgtccatactactcaaagcaatccacagattaaatacaatccctatcaaaataccaatgacattcttcacagaaacagaaaaaaaatcttaaaatttatatgtaatcacaaaagacccattcaatagaatgacccagagtagccaaaactatcctgagtgaaaagaacaaaactggggaaatcacatgacctgacttcaaattatactaggttggtacaaaagtaattgtggtttttgccatttttgccatgcagtttctccattaataagaatcttattaatattgaagtaagcttgtaatgaaagcatagtttaatttcatattaaaatgtatttatattatgtcaataatgtaattgttcgcatgttttagaattcatttattgtaaggaaaacagaatcattgttatctttgataaactttctatgtacgtaaattgcaaacttctgaaatcaggtgtttttccaacaataaaatacttttggtgaagaggttcttagagtttgctttcttcaatgctaggtcaatgtgttcttcaaattttgaaacttattgttctttctcttgaagtggaaaaggaagccctgttattttcagataaaacaggaagaatttatttggttgcaaactaagtatttctgtccaaatctgattttactaggaaatctgattttcttctccataggaaataatgcacagatcttacagcaccaaagaaaaagctcagccgtgcctatggggtactagatcaatgacaattctgatgtcacaatatctccaggcctactaaccaagaaacattcagactggtgcactgaacagaagttgtttctatactccttttccctttaacatttattgctttccttttcccagcagaaaacacacacacacacacacacacacacacacacacacacacacacagagagagagagagagagatcgagagagagagagagagaaagatttcctaatccaataaggcaagaacacacgatgtatgagccatcaaagagactactggtactgggctaggggttgctaatgaaagtgcaaaaagtatgttatgctttttgagaggaaggtgttggctgaatgtcttattccatttgggctgctgttccaaaatgcaataaactgggtggcttataaatgacaagaatttatttctcatagttttaggggcctgaaattccaagaacaatatgcagcagattcaatgtctcgtgaggacccacttactggttcattgatggccatctttctgctgtgtcttcacacagtggaagaggcaaatgagctgtctggggtctcttttataagggcactaatcctgtccatgagggcagctccaccttcatgacctaatcacctcccaatggtcccacctcctaataacatcaccttgagggttagaatttcaacatacaaattttacagggagaaacattcaagtcgaccacaccaaattgcatctgcccaaatgttagtgagagaatgccttcctgcaatcaatgacagttggaactttgcttgctttttgcaaacttataccccactaatcagtatattcaagaatctgggtccccacttgataggaacaaacacaaatgcacttttaagaaaaggatttacagttcacattgtaatgtatgtcatttcacaagaagttttaaggacaaaaactgagttcattagtaaagcaagtaaattttatagttatgtcttccaaagaaacaaaaagaataattgtatttgtagttaaaacatccaataatgctggaataggccaggcaaggtgactcatgcctgtaatcccagcactttgggaggccaaggtaggctgttcaggaggtcaggagatcgagaccatcctggctaacatggtgaaaccccgtctctactaagaatacaaaaaattagctgggcacggtggcacgcgcctgtagtcccagccactcgggggactgaggcaggagaattgcttgaacccaggaggcagaggttgcagtgagccgagaaggctccactgcactccagcctggatgacagagtgagagtccgtctcaaaacaaacaaacaaacagaaacatccaatactgctggaatataggatttaatgttacggaatttcaaaagatgaaaatatacaaaaatgttatatttttagtaatacattacattgttttaactaaatacaaataaaaataattatcccacttgggattaaagattgcaataagtacatgattagtagttattcaagattcctgtgtcctctactgagccaaatgcatatcaccttgctggtacctccatcagtacggagcctgtggactagacttctaaagttcttaagattccaaaaagctgaaagaatggttctcaaagcgtggccccaggaccaacagtgtcagtatcacttgagaacttgttccaaatgcaaattctcacaacctccggcaactcaaaaacactaggggtgggcccggtaatctggtttacaaaactgtgacagccaccctccaaactgactccataatgattcgtgcctgctattcatgcctttgtatagtttcctcccataacaatggtgctgacttgtgtataacaaagataatgtagcagatgtgttagcttatgacatcataaaaacattgggccttcctccttgctctttctcagatcccccgttctctggaagccagctgccatgttgtgaggatgcccaagcagtgctatggagagaggttcatgcagtaaggtctcttgtgctcagctatgcaagtgagtcatcttggaaacacattatccagcctgaatccagacagtttcattgtaaccttatgagacactgtgagccagaatcatccaaccaatcttctcccagattactgacccatggaaattgtgtgagagaataaatgcttattaatctttttagtatctaacttttgctttgcagcaatggtttactagcatacaaaccttttgtttgactctgacacatgctaaattttgaaaaacattgagctaaaacattcattcattcaccaagtaattattatttgtatctgctatgtaccaggctaacagcagaaatacaatgatgagcagaacagacactgaccattccttgatgcatccttttcttttccttcgttggacttatcatactttataatgattttatttatgtctgtcctgcaaattttgggtgggcaggacccttgtctggtttcttcaccaccaggtttctggggtccagtcctgtgtctggcacacaggaagtgtgcaattaatatccacatgacagtgacccttaccttcctttttcaccacctttcgcctatatgaaggattcaggcgccagtaacaaggccttgaattgcactaatagcactacatttaaggggctcagtaacttctccctgggaatctaactgccgctggataatctccatacaaagaaatgtctttcgtgttcaaaagagtcaacttttagagtctctctatttcaaacatgcagattcctaagcatgtataaagaaaatgtatgcagtggatgtgttagcctgttaaatgtatgcagtggatgtgttagtctgttcttgcactgctataataaaatacctgagactgcgtaaattataaaggaaagagatttaattggctcatagttctgcaagctgtacaggaagcacagtgctggcatctgcttctgaagaggcctcaggaagcttttactcatggtggaaggcaaagtcagagttggcacttcacatgttgaaagcaggggcaagagacagagtgggcgggaggtggtgccacatgctctcaaataaccaaatctgtagtcccagctacttgggaggctgaggcaggagaattgcttgaacctgggaggcagaggttgcagtgagctgagatcgtgccactgcactccagcctgagtaacacagcgagactccgtctcaaaaaaaaaaaaaaaaaaatcagaaaacaaccaaatctcacaagaactcactatcatgaagatagccccaagccatgaaggatctgtccccatgatccaaacacctcccaccaggcccaggtgaattgggaattacaattcaacatgagatctaggtggggacaaatatccaaactatgtcagagggtttagaaatataagtaatggcatgggagactataaggatgaacatatcagtaaaggtttcagccaaaaatattggaaaacaaaagcactatgaagccaaccatgtgtgcagctatgtgtatatacatgtatctaatgagcatatcagtataggaagtggggcacactgtttcacctccagtgcagccctttgtggatcagaacaatcggaggccagggacactgccagggtgatcttttgcgatggtgaccgtcctgctgaccggtgtacccagagctgaagatgggactgtgcaaactgaaatgatctaatcccttctaacagctcttcgatgagttctttcattcaggagctgacgttagaggttagagcacttggaaacaatgaggtgctgagacaacaagtcaataccttcttaacatgacctcagagcatgaagggggcatttggagaacactttttgatagcagaaaaaaaaccagtcattgatttttaaaattcttacagcagacagattgagatatgggtgacatcattttactgctatttaaggatgttggataagttataaaacagattctggctctcagcctatttatgatcaagatcaaagaagaggggcaaagactactgcagtctcgtgagtcatcagaaggtgctggagtttttctgagcagaactcatccaagctgtctccactgcccatccttggtgagggttctcacatgcttcaccatgacaaggcacaagggccacaaataaatttaacaacgccagaccacatcttctgttgcctcttctatcctcgcccacccccaacccttacccacagagcacagcctgcccagtgggaactgagggatttcttatcaacttgctgtttttctttcttttgtgactagcaaaacataacagtgctgtctacataacgttctgggacaatggaattgttctctctctgcactgtccaatatggcagccatcaggagcacacggtgactcagaatttgagattgggctagtgagattgagaaacaaaaggtttcctcttattcagtttgacataattgaaacataagtagccatattggtcagtacagtgttagaaaataataatgcttattagtatttccatttctcatctgtggatattcagggtcagaggattaactaacttgcccaaggtcagaaagctaggaaacagcagaggggaattcaaactcaacccaccctgcacaacctcaacttcttgcatcaaactgcagccccttcttcaggtcaaagaaggcttaaagataatcttcagcttctgaaactttaaattctcagtaaatagctttaaaaggaagctggctatatatggcatgatttcttttaacaaaaacaacataggaaagtactttttttcagttatgactatctaacttgaattttttaaaccccatgttgataataagtgtatctgacaggcccctctaactgtgctttaaaacttttgctctaatcaaatattagccacatgaattcatgagagggtgacaatatgaaaaagactttattaaacttctgtcacatcctattatgctgtctaggcattattctatcctgtttatcctttgctgacaaactagattatactttctttcctaaatcaacaagatcctatgaaaccacacaaaagataaagaacttaggatttcaaaagagtgatttggaaacaaagagtgtcaaaggcatgagtttaaaagggagaaaaaaagctgagcttaaggaaaataatatgcagtcatattgtaaattttgtttttaaattatatgtaaaatatttcacattattacaataccaaaacccactctaaaatctgcaagcttcaattcaggatacctgtgtgtcctgaattcataaccaaaccaatgttatctccacaaatctttcctttattcatggggaactactgtgcagcccaagaaaggaaaaggggtgtaaattcattaaaactggggaagagaacattacagttctttaaagacaaaaccaatatcctttggttcttgtataggttttaatattgccaaaagggtctaggatattccttaatattacccactcgggtaatatcaaagaaacaatggggtgataagctaaaacacagataaagaaatggggtaaaacccaaaaactctgaggatcaaagctagactggaaaacaatgtaggcccagtgtgatgctcttgttatataaaacccatctgtagatgaaagatggcatactcttcggttaagagagctaaatgaggtactggaactagtctcatcaaagcccgcacctactcataatcttgaaacacaacacactatcctgtggtcacagattcagctccacaaccaagcatggcataagctatgtgaacaggcatgggtggtggattcacgatgctgcacattcctggacatgcctccctcacttccctcaagaggcgggggtctatgttttgtcccctggaatcaagtgagccctgcagtaactctggccaatagaattgcacatgtgatgctgtaccagttactaggtgttggccttaagaaactggcagtggcagagaagaattcaaattcttgattttctgtgttttcagacattctccctaggatccataagctgccatttaagaagtctaattactttgagaccaccatgcaagaaagactatgtgcaggcacatggtcaactgtcccagctgagctgggcctttagccatccctgcaaagggactggatggatgtgggagtgaagtaatcccacaaagcagctgaatacaccagataacccccatggatgccatatagaacagaaagaactgcccagccaggcctgtcctgacccataaaaccatgagaaaaataaaacggttcttgcttttacaccttggaatttcagagtagtctgttacacgagtgttttttttttccttagttaacctaccttccctccaaagccacctgttaatggctcttactatacaggtggaacatgcctaatctgaataaccaaaagtttaaatgctccaaaatccaaaactttttgtgtgcctacatggcactcaaagcaaaggctcattgaagcattttggatttttggattagagatgctcaatcggttaaatatctgcaaatattctgaaatctgaaaaaaaaaaatccaaaatcagaaatacttctggttccaggcatttcagataaggtattttcaacctgtataacacgactgtatatttgttaaatattagatatcatcctgtctgccccccaatcattccaatttttaacataacacctaccaatgaaaccagaagatggtgggtttggttgaatcttctctttagtgttctcctggataatatcccagagctgccatataaatttaggatgaagaatgtaaaatggctgatttgggtttctctgacgatgctgaatatatggagtgaacaggttgtaatccggttttttgtaccactaaggaaaaaaaaatcaatgcagtcaagtagaaagaactaaactatgaaaggagacagggcatggctggttgatttgaggcagaggggccaggctggggctagaggatggggaaagatcatgactcatgacatctacagacacttcctcattgggatgaggggacaagaacaaagacagaccagggcgctagccctagcagatataatgctttgtgcttaagtaaaatgaggaaaagggactagatcacggatcagcatacttcttccacaaagggccagataatcaacaccttgggctttgcaggccatagagtcagtcgtctctactcaacggtaccatcgtagcacggaagcagtcatggacaataaatactgaatgggcgtgctgtgttctaaaaaaacactatttattaaaacaggtggtggctagatttcgcccatgggtgtagtttgttgacccctgggaactggatcagtgtatttcaaatatgagttttccaaatttcatctacagtaacagaaattgtatcgttgctgcttgggcctgagttggggctgggaagattaactaggattgattaacaaaggaactttctagggtgatggaaatattccagtttttcattgtggtggtagatacatgagtgtataaatttatcattcatcaaaaggtacatttatatttgcttacaccatgtatgttattgtatgaaaaatcaataaagatgttttctaaaaaggaagttttcagaagcatctcagctgtaaccatgacatggatttggagagagtagggagaagttcaactcatcaaactccctttaaacagacatcaggggtatataatgggtatatattaagatcacaggaaatattccactagtgaaatggcactgtcactttaaaagctttgagaatgactggaccagagtatctttcataaatgaagccccaagccatgtggcactggcaagggagcaagaggaatgtggggccagagggagagtcgctcctttaccctccctcctcttggggcctcacatggcagcaaaggccttacagaaagcggccttgtcactgggattttagcactgctgggtggccagctctgtgccctgggctgagctgcttctaacagaggaagaaataaggtccaatagctagaaactctcaagtctgttcacaaatagcaagagagctgtgagagcttaaaaccagggaacctcaggctggaaaggaagttgaaaagttcaaacacccatctgatgcttgattctcagcggagggtacatatgagaatcaaagagccctctcaaaaaatatacattgaggctatatatatcctccatttctggagatggggctctgacagattttgaaaaatactctccaggtgattttgacttgcactcctggtcaagaattgtaagtaatcatatgaggtaaatgtccagcctcagtctcaaggtcaacagtgaccaaaatgctccttctccaggagccgcttttatcttgggaggttacctctcacagaagcaaagatctttccctgacactcatcttaagaaggttgcatcctctctggtcttgactaaacaagtcaaagacgctcatttacagaactgacagcatctcttactaggctaaatactatccatcttttccagccctcactgataaacaagcatgctggcttttcatgaaaggtttcaccaaaagtagctggctgcttgtttagacaggcaatgatttaccagaatgtcccaaatataacctgtttgtgtttttatggctagcaataaacttgtttcagccctattgcataaaattcaacagatttagaagcagaggccaaagaggaacacactcaagaagagcctggaacaggccccatttaaataaaaatgagctgtggattcacaaagttgagattttcgtgccatcaccttcaatttatttcaaaaggtcttccaactacttgaaaggtaatgtagccctatcacaatgaaacaattctgagtttaatcagtcaaccctttagtgtaactagaaatttctgaatatttagatattctacatttcccccacccggctgccctgcccaccgattctgcacaaaagcactttggcattagatgactaatgctcacaagtgtgctattgtaactgggtatcaacgtggtgttcacaaacatgcattaaattgatattgatgggtactttcattgtctgtcaaagcttaatccttgccttgctcttatgattaattagtcaaagccattgtctgaccgttggggtgggcaaatccagggaaacacttaccaggttaagatttgcggaatatggggcagggtcccaggccaccaaaatgacgtctttatacagtgaactgtcaatgaagtgatggctggggttggtcagaatctgcaaacacacagaaaaaccatttcaaagccagggtttggtttttaaaaattgcattttaaaaagaggtgaaaattaaaaagaactggggcaaaaaaacaggtggctcagacgttgtattttcttctgggggagggagagaggcaggcgttgcatgcagaagcacttaaagaatgtttgaggaaattacttttttttaaaaaaaagcacaagttctgacattttcaccagcaatgtactcatgtctagtggtattgaatccagatcctgaacgatgcaactccctagctaattcaagccgcacaacctcttctacaattgccttcacatgtaatttggagacagagttgcaggtgtggatgaagtgagttcagaaggagcctccagggtgccagccacagccttccctctgtggccctacctagttctaaatgagttcttcaatctcagctgccaatcatctttttaaaattattatttcaggaaaaaacaacatattattttccctcagttttaagatactttttttttttaaccattattacgatgtacttttttccttctcatgttaaagtttcttagttagaatgtatgttacagatgatatgtattctaatttggtggcatttacctcctcctttgtaaaaagttgttattaaatgaatggcagattttacagtcaaatgacatctctgaattaaggaaatatggtaattgtttcttaccttgcggcaggctgcctggtgcagtgaactgtgcagaaagctaatcttttgttctgtaagcaactcaccataaatcactcatcacctcacttttttctacatattttgaaactccagaaattgttgtggtttgttctgaggataactttgctataaattttcaaggcattctcattaagaacgtgaagaaacgaggtattttcatttccaattaaacaattcctttccattttttcaaatttccaaatggcagactaaagttgcaaagatctcctatgaactcagattttatactttgcttttctcccctttatcctctgctttctttattgccatttcttctaaatttaacttttgtcagttcacaaaatgcaacatgctaagtctatgattataaatatatatatttctatttctactgatttttccttttaattttattcatttcctcctattcatgtcatgtctaaattcccatttctctgcagttttcttcattaatttctattaattataagattgatagaaataaacaagtaccacggtcataattaaccaggtaacttctcttcactcatccggttaaactcatttctcttcactcatccagttaaacctaagaaacatacatccatgaaaacactccatctgtcttacctgcgaattaatgatgcgtatggtggttttattcccaacatctttctcataaccacgtgtaggagcagagttaaatctcaaaaccgcatcatgagaatctaagggcacataagtgacaagcttacttttgttctctgtagaatcacataatctaggaaaaaatgttaaagcaaatctttcaatacctgaagctaattatacatcaccaataaagttaagatatgcccacatgattttcagagaatttactcttcactgagaatgagatcttggctggaggaaacatcaatatggatatatatagatgtaaaatctgttcaattatgggcgagactgtatgatctaagtgatatttagatacttgctaccttttcaacattcttacaagtgacatgcttgatgcagccattctcccaaagcttccaatacatcttgagggagactgtactggagcagataaagacactagaaagcaagggctgctttttggtgctggtgtatgcttaaaaagaaagccagccctgcaagggctgctttttggtgctggtgtatgcttaaaaagaaagccagtccttaagcagagattctgcatgtaatgttgaagaaagaaagaaagtcagccctgacttcgacgcagccttacatactgctgccgatggcaagaagacctgtgtgagagcaaccttaagagcattctgcattagcagcaatagcctgccagaccaccatagcccctgaggatgggtgagatggagagaccaccaatgccaccagctgccagggctcttatgttctataaccacacaccgtgcttcaccaaacttgaactatgaatgcaacgtaaatctacatctcacttcgttcaacttgacagcccgacttgcccaagttctctgaatgctgggctggaaggtcctggatgaaaacaaggtacccctatcctggaggctgacaaggaggtgaacagtgggaggcacaggaaagtgggttcacctgatttagcattgggactaggggatatgttccctttacagaaggcagcctataaacatacatgcgtcttgaaattcctagaaaccagcctgaagccagagtcagtgagcaagaaagcaattttctaagggccatctttagctttaaatatctcatgcagattccaagctcggcctggagcaaggacagtgcctgtctgtgagggagaggtgaaaagaagtatttctgtcatgcccaaggggagctgcatttatagtccccgagcccgcacaagtgcctaaggcagccgccttcttccctgagttcctgctatctgctcctttggagttgtcttcttgctccccaaatagcagaaactcaccatgcatgcccccactaaaacaatgtttaaaaaggtgccttcactgacaaaccctaaacttaaaaaaattcaaattccagctttagcaccaaaattaattcacttttggaacatgtgaatgcataaagcgtaggtggctgtgtcatcaaaaccctgcaatgttcttttaggggaaattttgcaggagttggcaaactatgaccttctggccaaatctgacctgccacttgttttagtaaatcaagttccaccataacacagacacactcactgtacatgctgtctataactgcagagttgagttgttgagacagagacagagatacagttcacaaaacaaaaaatatctactaccaggctctgtaaaaaagtctgccaatctctaggttcaaggggatctattctttgtgtaaatgatgccaaaatacatgaatgcctccaagttaaaaccagttctttacttcacaatttaaggatttgttcatactttattgaggtaatggatttcttatttatttttattgaataatgttttgtcaaaaaattcaaataatatttgaggtagaaaaactagattacccaaaacagtagactcttgaaatttattgataatccaaacactttttaggcagatggaatatatctactgatatttaccatactaaaaggtaaaacggaattttaaaatgtctattaatttattttaaaacagctttttttcaatttaaaaaacctctatattttcaaaaaccaaaagaatactgagaagactggcaccgtttttaatgtctgcaagtctctttaaggtctggttttttagaaagttggtttctcacatctgcttttgaattcaacttgttgcaatatgttgttttatttgaagtatatgaaggctcagacacactgttgaattgagagagctatttaaagaatccttccaaagaactgtgaatattcttctttgatacctaacaagactctacgagggctagtttcttagggttggttacaatttggaatctgaaacctatcaatgaactttttgtgctctgttacattaaaacttgtggtctatttttctcttaaaatggatctttcactcacgcataattgtataatattgtacaatgatcagctgaaaactatcagctaggcatagttatacataagttatatatatatataatatgttagtcagacattccaaatagtgatgcattttgttataaagagttgaaacactggctgggcatggtggctcaggcctgtaatcccaacactttgggaggaacaggtgggcggatcatctgaggttgggagttcgagaccagcctgaccaccatggagaaaccccgtctctactaaaaatacaaaaaaaaaaaaaaaaaaaaaaaattagctgggcgtggtggtgcatgcctgtaatcccagctactcgggaggctaaggtagaattgcttgaacccagggggcagaggttgcagtgagccaagattgcaccattacactacaacctgagcaacaggagcaaaattccatctcaaaaaaaaaaaaaaaaaagaattgaaacaccacattgattagtatcaccatggagttccccagtttttaaagtctggaaaacttccaagttcatggttcaaagcttgaattttatcattggcaacaaatactatcagttattttcctaaaagtgacaggctcgcttgattcctttttgagaatatatctgccaaatatccaagtctgaataattaacgtttcttttcaagttaaaattgtatttcatgaaaaaagtggctagttcggctcacagtgcaattacccaagggcttttcctttgtgaactggcacacataagtgcttttctcctatttccccatgtgccccactgaatctgaaaaacacgtgtattcaaaggttgagctttgggttctgctgccctgacttgtgctaagaagcccctgtctcatgcatcattcattgtgtttgtaccaccagtgcaaatgtcaacaactgaaaggaaaagaactctgagtatacttaccagaatagttttttctcatggaccctcgaaagggtcttgcaaaggctaagggtaagcttagatctcactgttcccactgctaagctagggaaaccctctggttgcagacagtgagaggagactccaccagcgaggtgactgcaggtgctgggagggaatcagccctaagccagagaggaagtgtgatgccagcaatcctcaatctcagttctctccaaaccacgctacccacccctcagacacagcctacccaagggcctcaagcggtgggtgcatttctattatttgactaataaatctgaattaattgcatcacccttgaaaacatcccagcatttaaatgcccattgtcttattgtggagctgtgctctaaaccatccaaggacttcacgaggcacagggcacagaaagataacgcagtgtaattcctttggaggtggtattagtctgcagagttaaaaggccacctgcatggagagggcagggaggcagggtcatgtaggcttgtggctaggcccagtgcaagccctctatgaacagccactgtgagcagcgtggggttgggatggaaggggagggtgcgctgagactgtctctcacacagacacgttctgtaaacgtacacctggctgtgcattccttgataatgcactgtgagaatagaagctgtccattcatatttagaaaaaaaggaataggtcagacagcaaatacaaggggaagaaagtcaagttccatttctggagaaggcatttccaggccagaaccatgctgtgttgtccttgagaatggagccagacaagtgcatccatggaaggaaaattaaagcccttcaaggagctgctgggccagcacccggtcaccgccctgccccaggccccattcaccacatcatccccctctcctacactgatgagaaaattcaaacagcaggagagcaagcctccagtcactagagaatggcctgcctgggattggacaaagcatcgctttgggagctccatcaccctgggagccctgtttctccccaggacctgtaaccctcacctcttgatgtacttcccttgcaccctcaagtccaggctctggagtgatctctctacagtgactatctgcaatggctgcacatcatgggcacagggctgagagctagtgtttctggagacccagactggggtttgaatccagactctgcacatgtgactggaggtaccttcatttccttatctgtaaaatgggaacaaagttatctatcacttagggttgtaaggtttacaacagttagcacataaaaagcactttgggttgggcacagtggctcacacctgtacttccagcactttgtgaggccgaggcgagcagatcacttgaggtcagaagttcaagaccagcctggccaacatcatgaaaccccatctctactaaaaacacaaaaattagccgggtatggtggcgcgtgcctgtaatcccagctactcgggaggctgacgcaggagaatagcttgagcctgggaagtggaggttgcagtgagccaagattgtgccactacactccagcctgtgcaacagcgggagactccatctcaaaaaagcaaaaaaacaaacaaacaaaaaaaacaagagcattttgaacagggccttgtctgtactatataagtggtacctgatttcaattaagtgaagtctaatattcatagagtggcttgcaagggcatccaggaagatgatctgccttccaagcctgcttctctcttctgtccctacgagcccatgtactccctgtagctctcaccacctgcacaacatgctgtttctcacttccatatgatgctgggccttcagcttggtctcctctccctggagcagtctttaccaatctcttctctctaccagccctcaggggagttaggaatccgttgtcatttctgccttgtcagcctacatatctctctgtccttctccaacccacaacactggaattgtctgtttaccactgaagtgtgccggtatggatagttgagcctgtgacctattcatttttgtgtctagcctaggatctggtggagagttggtgatcaataaataatgctaattggatgagtatatggactgctttcttctttcttgcttttttaaaaggtaacaggacatgtcaaatctcaagccctctccaccagtctatgcatcccacccccagtctctccctccatgtcccatttcccatgcacttgccagaattcgagtttcaggtacacagatcttggtttcccacatgaaggctattactggtggttcagagcagacctttctgctctgtaacatgtttccacatgaatgctagtagcactgcatagaagcaaattattattgcttatatgcatggatgaaaacagatcatcttataactctaggaaagaatgatccaggtttccaaaacaattagtttgtttttcaataacacattcacagtggaagtgtttacaactgctctacttttctaaccaaaaccaattccattgtgtgacccagttccaacagaagggtagggggatgggggctgcactgccagtggagcaaacaccagggggagcgaaagggcagccagtaagcaaacctgagactgactgggtctccctttgacgtcagcatggagagggctcctcctggcagaacataggtagggctgataagcagtgatcatctgagacacttcctagctctgccttcaatttttcataagatcgtgatctttggtaagtcttttgatcttcatttagccaattcacaagtagatgcttagcggccaacaagaatttcgctacaccatgcccccaatattctaagctgcctgaaggaatttgctgccagagtttgtttgtattctgcaagccattcataactatgtgggtttgcttgcatatattcaggtgaacaggaaggagcgaggtcggcacctggcatgtacactgctgatgctgagataccaacttatacaaatgaaactttttgtttatacaaattgagccatgctatggttacatgttcttaaaatagtagatacaaaatctgatccaaacaaccctagacaaaacaataaagagaattttaaagaaatttccaggcatgttcttcagttgtgattctacagttctaatcataaaggctcatgcaagtgcatgccaaataaattagatttggatactagaaattaacaaagatataactggcatttcaagtttcccagaaacatggacttctcagcgtctttcacgttctcttccaaattgtaaacagagtttacaagattctggtcagggatatttatgcagaaaaaaagaacgagggactgcccactgacatgcaagagcaatccagatcttcacctctgatgcagaggtgtttaaaacaaaaccaaaccggaagcaagttactgcctgcttcaagcataatacttaaattccttctccacattattaatattggctctcagaaatgagaaagaactgtggtgttatttcaccccggggacctctaaaccactgcttcttcttaataaattgcaggctgctctgctctggctttggctacaagcttatatgacacatggactgtgttattatgagcctgctgtaatgtcagcacagggacacaggtaccccagaccttgattccagactcactgtcttgttttttttaactttaaaaatatttctcattcagcctcatgcccaaggacttctgctgagctgagatctgggcttctgagcctgcctacagtggcttcaccctattccgagagaactctggaacataggccactcttcaaggacacagaacaactaatggatccgcttaaaatgaagacaacaaagattacttatttgcaaagagggagcaacactcccggaatgtcacttccagaccagttatgccctaacaacgcctactgtgagagtgtacaggacatgattgttttatatctggacttgaggctgacgctgtatttgactcacatttgttttactgctcctcgtacagaatcaagcacatattaggggctaaacacatatttgtcaaatgaatgagcctaaagggccaagctgcttgctgactggtctagcagtggaattagcctgggaagaaggggggttccgggagcaaagggatctgaaactgctgagggagagcccagctatggcaacacaagagcctgggtatctctggcaagacagggtgagagtctggggcaggtggggaaatgaatgtgatccagcgaggaaggggaattctgaggagagccaatgcaggcccatctggtgcagaacctacaccactctgcaggagggaaacgtatttgaaccctgccatggccccatcaatcaaaaaagattagaattggtattttacttgaaaactaggaagaaatagtgatggctaatgttgtgtgccatcttggctaggccacagtgcccagctggttggtcaaacactagtccagatgttgctgggaaggtgtttttaagatgtgattaacagttaaatcactagactttgagaaaagcagacgactctcaaaatgcaggtgcgcttcctcaagccaggtgaatgctttaagaacaaagactgaagtttcctaaaaaagaaacaattctgcctcaagacagcaacacagaaactctgcctgagtttcccatctgctgggctgcactacctatttcagacttgccagccttcacgatcatgagagtcaagtccttaaaataaatctgtctctgtatagacacatatcctcctggtgtgagtctctggagaaccctgactgatacaggagctgggaaacatgtgctccagggctcttgacagggatgtgaaggcagagcctggcagggagggaggaagcccaggtgttgcatgttatttaccatcttggagaaggtccctggtaggtgcactggcagtgccccaaaggttggatttgcgccaacagttgggaggccggaacttattctcccatgggaaagatgttcccaacagcagctgggctcttctcagagctcacagtaaccaatattatcttcatgcaccctgctctttggagctgacgccctgattgggcagcttctgctttcttgcctcctcctcttgttcccttcccatattcccactgcaggatgggttcaccgggctttcaggggccacagcctgggggcatatccatgcagactgcggtttctatgggatacgaagtctgaacagtgagaaggacgccgggggcaaagggcggcgctttccttccactgcctactggcatcagctatggggaggacccttcctgctccctagcattccccaaatccctgctctaagagtctcccgaagagtacttctgctgtgaccccaggcagactcattctgtgccagcaatgggaaagcacctgaagaatctccagctaatattaggaacacctggtgcggagaccccagcttgccccgtcagagatccagaggcgcgctcagaaagaaccggcccccagggacacactggctcaagacagggcgacctggtccccccgctgagacctacctatttcctcgcccaaggaagagttgaggattgcgcctgcagacatgacgacagcgcagctgcgcaggccgcgggggtgcagctggctcaggggcacggcgggcaccaggcgccgccagcccagcgcagaaaagggcgcctcggtgccgtccagcgtccgcacgcgcgcgcggctccgcagctggcacagcagctgtgccctgctcagcccggcctcccgcttcccgcggaagcgcaccccgtgcttgttggcggtcaggtaatccttcatcgccttctgcaggcgcgggttcagcattttggaagagacgttccccttccagagccggtacaggaaggccctggacatggaggagtacagcctgtcgccgtcgtcgccctcctccaacacgtggctccttctctgcctccggtgcctcttcttcacccgcctcctctggacctgtgcagccggaaaagccccctcccgtgggcctggctccccgggggaagggaatcccaatgtcccctgagtgtggctgtgccaccctggctgaccagcagcaaaaaagtagtcgtcatcctccgggtagaaagcactttgagattttctccccacctgggatgaaaaaaactctttatgttcaaacccatcttgggactgggcccatttctgcaggtctccaggccccgcatgaaaggaaccggctgggtgggcgcggggcagcgcctggcgtgcgtccaggcccccaggcggggagggctcatgtgcggcgcccatgatggcccgctgcttcccctgcaccggcaggagcctcctggtctccaggaaggagagggagctgggtacaggctcagcggggttgctgtcggtgaagtagatgaaaatcagcaaaaagaggagcccccaagcgaatattccgaaaagcattcgttgtctccattgcttcaagtgtggtttcatggcaggtctctgcggtcagcaccttgtgtcttaatgcagatgggtggcagaatgaacctgaaaaacagccagatggcagttagccaacatggggcatctgctcagatgctgctggggacattctatcttgagcagtgtttctgtaggtggtggggtggggttgtagaaggggcactagaaaccagaatcatccaggagttttagctaaatccaggtgtcatatctgtccccctccccgccccccacctcccaccaacctctgcaaaacaagggatctcaccatctcaggtgagtctttggagagaggcgatggatgggtgtatatttgcaaaatcctccccatgtgactcagggacacgtctgccttcccactttgatagacagtagtgcccctgcccacaagttccccctacttctgagatgataaaattccaatttgataaagcaaagccagagaggtaagcatggtttgccccttttgtctgcctatcagaccaccgaaagctcagagctcatagattttacagcagcgctgctgtgcacttctaaggagtgacaaccctatctgattcttcctgttctccccattctggaaggctgcctagaacataccagaagtccaccgatggcactgaataaagcaatgcttcagtgactgtgtctgtgggtgaatgttatttcagggtgcctgttgtcttcaacaatgtccccaagactaccctcctacttcacccttaccgtgaacttttggtgagataagagggaagtacattaaaacttgaaataggaggagagatggggagagagcttgctgattctagatgagactcagagaaagggtaacaaaaggggcagagatgaaaagtaagatacaatgaaagagaatgaacctctcctctgtacagcattgcaactaatatgtattgctgtgtgggaagcacacagcacttagtaccaaaggaaacacaaaaacattaataagaaatgctcctaacttcaggaacttaagcaaagtcctggaaagggaaaataacctaaggtatgtttgtggaataataactaagcttgctggaacttcaagctgagcactaaaccaagcacaggcagatattcaataaatattggctgggtaaatgatctgagcttgtgtttgtgtgtgcgttttgcagagggccttgtgtgtctgtggctatgatgggtgttttggtgggggtgctggaagaagaagcaagaccatttggggaaaacataattggaaagctatcctcttccagctgtggagggtctggagtgcctacctggatgtctggggcacatgctgtataaaaaatagggagagagtgaagttctgagagcaaaggagttatgcattggttccatgggctttcaggagattccttggtggcaagtaaggtagagaagagtgcagggaggcaacacagactgcaaggaagtcgttagtagaaatcagatactcagaaagtagggtgattctgaggggagggtctgccaggggaaatgtgtgacccccacgatccttccccagtacaggctgaccaatgccaaaacacaaaggcatgtagggcatggctgtaatacaatggttgtgttttcactaaaaaagataggaactgaaatcaaaatgaatgttcctacctcaatgtggtcaccttgggaagtcatacaatgtcgctggtgggaaaggacgtgctaaactaagaaaactacattccttttgtggctctatggcaggttaaaggtggacacagattctgtgaccctccacccagagagaggcagattctgtgtctccccctattaaataaggacaggctcaatgactgcttggactagtagaatatggctgtggtgatactatgccagttaccaggcccaggtctagcattttccactttctgcctctcaggacattcactctgggggaagccagacaccagtgaagacatatccctaagcttagcccagcatgcatcgaggaagcccaagctaggaaagtccacgtggaatgagagatacccagccagccccaagctgttccagccgtcccagccatcccagccatcccagcccaggcaccaaatgtgaagcgcgaagaagtcattctggatgtcccgtctgttgcacttcccgatgactccatctccagccaacatctgactgcaaccccatggaagaccggataggagagccggtctagcccagtcagtcaacggtgagtgataatgatagattgttgttctaaaccacgaagttattttttatttgttttgtttgagatgtgtatagatgtgtataaatacatttatatacctatatatgtatttgttttaaattttagattcaggggtacatgtgcaggtttgttacaggggcatattgcatgatgctgagtaaactcctacattttaaggtgatttgttacatcagaagatcactggaacaggttctaatggaaatgttaaataagttccagaaatcatcagtaacatatacaactatcttatacccataataattaaaaagaaaaattaagccaaaaagaagaagtcctaaaaatgcttccaacaactgcaacattttcagataagactctagcatctcagagggattctacaaaatgcaacattcgcttacatgtataaattgtggcttttaaactgtgtttactttattttgtattcacatgagagcaaggctatagattttatatacagtaatacatcaaacctacatagacagaatatactttaaccaagccggaaccacggatgccaagaagcgagcgtagaagaattaatacccgcagttagcttactatatatacaggtctgtggttagcacttgttctggattattttatttggtctttccagcatcgaattagataggaaatactgtcatatccattttctagatgagggaactgagtcccagagcaattaagtaacttgcccaggaccacagagctagcaagcagcagatattacatgcaaatccatctgcttcatcctatggctcacacctttcacagtaagttctgattccatctggtcataccaaccaaggctacattttctaaatttacactccccaaactatctgtggtgaagggtaatttttcccccaaattgtcactgtgtgatattttaatatttccatttctgaatgtcttggcattgtacaattgctataaaagtttctaaatgcctgctctcaagttctgtaaacatcttaccaggaactggtaatgaacagttgtggatgtgcattagtctgggcccacactttgagtagcaccttccacatgatctgtctaacctgtccacccagggacagtgctttgagctgtaatgaccaacataaaggtctagaaggtgtttctaatatttcaagaattctattaagaaattgcaaaattatccttaataacagttattctgttgcatcccattgggtgcactgcagtataattctgacacttgctactgggagttagtgtagaccccatgtgttaagggctcaggcctccaggagactgccctcgtttcacatgccagctgtgtggatttgcatgtaattatctgctgcttgctagctctgtggttctgggcaagttactcacaagttactcaaagccactcacacttttaactgttcaactaccaatccccagactctaggacacccttcaggttcgataatttgctaacatgactaacagaagtcaggaaagtactagatttatggctatagttttattgtaaaggatgcacacagggtgagatctaggggggatgcagttccaccctctttccctgtggaatctgagtgtatcaccctcccaacacatcagtgtgttcatgaaccagaagctccagtgaaccccagaatctagagttgttattagggttcccattagataggcatgattgattaaatcactggccatgtgagtgaacttaatctccagtgccactcttctccctggatgccgggcagcccaaagttcaaaaagtttgaaccctgtaatttctttttctctttctttttttttttttttttgagacagagtctcgctctgttgcccaggctgcagtgtgcggtggcacgatcttgtctcatggcaacctctgccaaccgggttcaagtgattctcctgcctcagcctcctgaaaccctgcaatttcatctgattgatctttctggtgatcagagcccaagctgaagctatctggggacaaagtgagttccctcattagcagaatgaaaacagtcctatcgctaaggaaattccaaaagttttagaagttccatgctgggaataccaaggctgcagcagctgatttaaaagacagtctttttgtttctgactggtagtcaccatttcctggtttccctgcactgagcaacagctctggtgggcaactaaaaaatgagaaatgcaggtttctgatttcagcatttgctccagaaaatgttttttaaaaacagaggcaaagatgagatgtgtgcacagtggtgggaagtgaaacaacaaaaacaaagctttgacctgttgggaggagctcaaaatctctggcctagagggcttggggctgagagccagtgcccccccacaccagataatctaatatgaccttggtttgacgagtcaagaagccgcaggaacttgagctgagaaagtgaacttgggaaatttcatggcaggattcaaattatcagatgtaaaattaaataattcaaaattaaaataattcaaacttaaagctattggaactcaaaattatcttgagccttgggaggaatgtggctatgtagcctgcgtcagacagctgcaacttctgcctttttgttcctgcaaataattagaaagaccaagcagcgccagagataagaccctctcagatcactgcacctcctcatggaataataaagtattcttgcttaaaatggaacaatctgtaaccaatcaaacagctgtggcatatatacctggtcttgtatggaaaatgctgtgattctgctggaacttctctgactctgcctatataatcgaaactttaacttctccgttttggaaacactgaccccattcatctgcagttggtgctttcccaggtggccagcctcaagctttgcgctcaaataaactctgtacttaatcatatttcctgaacctcattatttaaggttgacacagatgtaaactgaaaataaattcctaagcgcctcaactgacccaacagaccccctcatggccagatggaccccagagaaacatgaaaaactgaatttccagtcatgactggaagggaggtcagacaggcctccatatattccctctccctttgatatgtggacacaactgaccaggattaatattaacatagacatcataagctgaccaaactctttgtggcgataagatgccaaattccaacctgactctggtatagcatcacgtgacagttagaagaccctgaaggaaatcaaaatattttaccccaaaatatatttctttgacatatgttgaaatggccatgcaaagctgtcttttgtgggggaaatttgcattggtagagcatctccattaatgcagcctacctttccccttctaggcctttcctggacctaggagagattaaatgtgagtgtaacacctttaagttcccaaaagagacatgtaccatctatcctctctgaaggacactacctatgaggcgtcatctctataacaagaatcttggcttccacaacccctcttaactcaagcatttatttctattgacttcaagccttgagacaaagcttaactctttcaaccaactgccaatcagaaaatctttgaatgtacctacgacttataaacccgcatttcaaaatatcccaccactttaggctaaaccaatgcacacctttcatgtattgattaatgattttatctacaatgcctgtctccctaaagtgtgtaaaaccaacctgtgacccagttgcctcgggcacacgttctcaggacttcctaagaccataagcctgggccatggtcactcacattggctcaggtttaaatattttacagggcttttgtgtttttctctgcatcaacacagacatagcctccattatatgaaaacgcctagtttctacccagaagaaactacccttgtttgtcatggggagatgacatatgggaaaggaagggagaagaatgagaggatgtcagaggacacaaataaagagaagaagcacctggcaggatagagggggctgcgttggtgccaggaccctgtggcagagtttgctctctctgcccgctgtgctgggaagtagaaagaggcaggatttgtgaggctctctgagcatctttaaaggagtattacaatgcaaagaatgaagactcttcattaggtggagcttaagtggctcctaatgcacaagaataataggaaggagtggatttgctgcactgcctcaatttgtgattaggtctcaacttttaataatccaaaagcctccactgcagcctctggagctgcaaaccttctgctgccaattgagagaacattctccaaaatgattaagtctcaaggcaatgtcaaatcctctgctagcaaaatgctacagaaatcacgatctgcatcatgggtctcagtcatcagcatatctgtaacaaatccaggttagagagaggcaagggacatcatcaatgttacagccctggatcatcgttttccttgaaatgaccataagcctaataggaaggctcggctaagcaagagaaaacacatcttttcctctgatatagtatatctgaaatattataattatacaacttaaagaaagtcgtcggtaatactcactgccatatcccatcattagctggtgtgatataaatgacatcgggggatataagaggcccaccaggcaaatcatctgtccccaggcaccaatgggacagtgctccttaatcacaccttcacatgtgctttgtctacgatggtttaagtgactggggctgtcgagttcttgccagttttcccctgggaagagcactggcaagattatactcatactggattgggtgtgactttcttttcctttccactgcaattctaacattattacctggcaatgcaaaggtctgaattcccagtggatgttctctgcctatttggactacttttttctatttccattctttctccctgttctctgccctttctggccaggcctctagggaacttctatttttagaggcaaaatcaaaagtgcctcactgctggaaatcacggtgattgttccacttgcttaggaaggtcagtgcccacatcttaaatactaatgcccaaacaaagacacgagtcacatttcttagggatagttaaagtagcacaaaagagtgtttaaattctccttcaaattcttctgagagaaatgacattttccaaaaggcacaatttattacgagttgtcagataaaactatgaaatgtaaacgctgccacagaggaacattacactgcagcttaaggttaatgcagctaacttcttattttgttcaagggcaaagagaagttaattctaggtcttaccactttaacgatgtccctcttaagccttgtggttgacaagctttattgcccattttcttgactggagagtgtttttctttcttttttttttttttttcacattttgattgatgtgtctgctattaattgccagctggccaagttttctgtgggtctgagacacactcacgtcctttttttgtgtcaaagagttgtctggactaatgctaagtctaagtatttattttaatgttgaaataataaagaagatttagcatgtgagctgtggtgagatactcgtgtatcttaatggccttcagcagtcattttctttcgagaatcattttttctaaaattagctcccgtcacatatccaagaaaacatccagtctgcagcaaagaggaagatacctccctcagctggaattcttttatctcttaacacccttattggcactttttacaaatgggcccttctcttttctttgcttttggtaaatgtgagaaagtctccagactgctaaaggcagaacaccaaagaggcactcccttattcattatccctctagtttctgcccattcttaagctaatgtccagaagaacagaaagaaaaaggtcggccaggtcagcggagcctgtggtagcgggaggacatccccctctctaaggagtacagtcctgcgggattgccaagtccttgcctcctcagaagggcagcccccctgcaggcagtgccccctccttgtgatggcgctgtttgacaccagaatgcatggagcaatcccacctgctaggaagggcactgctagggctggccgacccagtgacctcgcttggttgaggcataagtttaaaacactggcggctgggcttccggataatgtaaaattcagatgtttgagtaacccacaatggggatgcctgtaaggttcccgaaggtggggactacatcttattcattcttgtattcccaccaaccaacatgggctggcctgtggaaggttcccagtaaatactcctgcaatcaatgaatgtctgaaattaagaaaataagtggggggaatgtactgcaatggcattgcctgaccaggggctgttggttggttcaggaggggaagggttcctcatttactgtgctgctcagcctggcagaggtgtctgggtggctccaggcaaaatcatggttaggctgttgtagggttaggcctgagtcattaacagcagtcgtggcaggagtcagggggctggtgggtgcacgagcagcgaaggtatcccaggctgccactggccaaatgcctgtgctgtgctgggcactgtatctagcacctcactcacattgtctcgattcctcgtctcagtttaatcttgacaacaaattccttagtaaacattatttgtctccttaggcctatgaaagctccgagtggttcccttctggtttactgtcccaaagcccctgtctttttttcactagaacacgaagccagaaaaaattgctggggtcaactcaagcaccagccttaaaattttaataagatttatttttccttttggccacaaagtactatgtctaatttcactccagctccctacatttagcagaacaagtgatcctctgacatccgtatctttgtttgctggagtaaatgatgttcccagttaggctttacaatccatactttcccatgccccgccttcgtcagagatagcttagtttttggacaactgccaggcggattttgcctaggcagaatgggctaccaatttactaacatttccaaagagactacaggtgttaggcccatggttgcaggggttttctacctcggtaggaaggcaaaacagttctgcctttgctgttgcatggtcccaggactgctgaataaatgacaagcaatatggattaaagtaagcctggaaggcttcaagcaagaggaggtccagagctggacgtcgaaggatgcacaggtatggaggagaatcagtgatttcaagccagtggaatgcctgggcccagtgtgccagggatgagaatgtgtatgctggacagactcatgtgagctggggctggacaagggtgagctgctcttagaagatgataccattatctttctgggtcaggtcattccagcagtacagggtttttgctcaagagacagggcagatgggaactagtttaaaaggcaaagattcacatatgtgagccactctgggcatctcccagttgaggaagggggaggtggaaatgattccagacgtctatcagtgattgtgcagagacacaacacaagctgcctactagttagggtctgctggcttccagaaacagcattcatctgctttggactcagtggcctgtttgttttacaataattagcattcaaatatttatacttcataccagaaatgtgccaaggctcatgactggagctgtaaattcgcttcagtcctgatggctaatactaagaagatggaagatgtatacctgccattgggacttgaaaggttaggtgaactcctaaaatgtgaagtgggctttgaggtaaaagcacaggtggccagcagatggcttttacaaggaggcttctgtaccagcagaggccacatttctttcagcgggtgttacagagtgagatagataatgccacctattctgaggagtaaaggccatgcacggttgaccagaaagccctgttggcacctgcataattttggataagccttaatttcggataagcctcagtttcatcaaatgtgagttgtaagatcatcactgctttatgagatgaatgaataaagtaatgtgcttagcactgtgcctggcccaaaaagagagcacaatatttttcagtccaagttttgaaattctgtaaaagtggaaaaggtggcataacacacatggatttcactctatattagtgtattgtattgtatgatataagcatatattatactaaataatttaatatctattacatacagtaatttaatttatatgttgcattatatgtattataatacaccatattggtgccatgtgtataaacttgatggtttcccaggaggcacctctctttaactgacaataaactaacacgccccggtttagataaacacgagtgtctgactcaagctaataagcacagaataaggcctgcctaaatagttgtgactgtcattagtgtacccatcattaagtaacctgagtgtttttacttgcaaaaatgttatttatggcttattttattgtataaagtggctaatgaagtattctctcatgttttcatgtttcatgtttctcaaatccttttttaaaaatataaataaatatactttaaggaattttttattattttttccaaaaaaaaaaaaagacctctctctagtgtctcagtcataaaaagtaaccctgtcagggactgaatacctgacaaatgtcttctaatgggttcactgtgttaatgagcttattataatttatgctgctataattcagcaaatatttattaagtctatcataaggtggcatatatagcacatgataccttgcccctggagaagtgacttcattcttgggaagtatttaaatgcttgagtaacaagcatgaacgaaaggatactatagattcaaattccagaatctctcttcagtccagaccagtgaggcctctcacaagaacccagggaagaaagggtgcttaggggcacccattcagaggactgcaaaggccccacatggcatttgtttctctctttggaaatggtgttttacgtggtaagagctacacttaaaaagataaagcaaagctaaatctcttagctccatctctgtgggtaaacttcctgtgtaacagttgagagaacaatagaggctgcaaaacaaacatacagaactaggccatttatgtaaaatgtttaaacacataatataaatcacctagtagctacctctgaggacggaggaaaggggtttggatgagtgagagaggggatgcctgcttcattactaaagtattccttccttataaagaaaaaattggaagtaaatatggcaaaatattaatatgtgttacatctaggtacataaactcttattatattagtttttctattttaccacatatttaaagtatttaataattttaaacaatgaaaatttataaaagtaaagttgtaataaaagttgtaaaaagttctaaaataagacaaatcatttatatttacatctctgtttccaaatcaatccccttaagtgacaattcttgctgatctggtaacacaaaacatacatctaacattttacacggaactccagatttagttaaagctttcttctggtcttgacatgaccagtcaagacaagaattactgaatgctataatgctttatgaaagcttcacagagtgctgagcttccggtggaacaacgattacaatcctgacttttactatccatgtaaacttggacaggtttctttacctctttgcaccttggctgcatcttctgtaaaatgaagagcatcccaacctcacagagttgtcatagaataacatattttaaaagagaaaatgcaaataaactataactcccataaacaatagatacgtaaaaatcccagctctgctgtgtgcctgcaggctgagctaagcactcatgtattccatcttggctcctaactgcctaggataatggcatctctcctctttccatgttgagggacaacccaagggtaacaaccctggcttctcactccaccttttaatccttcccacagaaaaggagtccccagtccactgagagacacggatcatggtgtgagtctctgtagacccaaactgtccctcaaatgggtttgttcaagatctagacttgagtgtggaagggaaaagggaggattggctacccaaattgttgctcatctccaggacaaaagcttcacctggctttttcactaatacccttgagattttaccctcctctgtttgacattcgtggcaccaactatggtgttgagcagttaccatttcagtttccttcacatcctatgattgaggagctatgatcaagcccattttatggatgagaaaaatgagtgacagcaaggtattaattacttaaaagcactgcttgttactgtgtggtgaagctaggacaggacctggtatctttgaaggcagtcaaaataaggacatttgacaatgacatctgctctcatcacctcccagtgttgttgaaaataaccaagaaaaaatgcattggcaagaacattttgaatttagatattctaccaatttgttcaattttcatgacatgaggaacagtcaatatttagatttaataatatgccacaggaatctgggtcaatttttggtttcataaaataagtgtaaatgaaaagatgatcctggtatacacaaaaatcaccttggcagatgcagaggtgccagtgaaagtcatagacaggtaagcatttttctgggcatgtgcagatggaagctgtttgctttgcaaggctttgtaaaggctgtggtagagtagtatcgacattacttaagttttatttttgaggatggaattttaagaccttattcaaagaaaatgccaagttgctaaggacctaacatcttgctttttatgatgggatacattatccatagaagtgactggaaaagccagccatgaggtgttgattttaatagaagacttgggctgagagaaactcattaatttttatattagaacacataatacggccaggcaccgtggctcatgcctgtaatcccagcactttgggaggccaaggtgggaggatcatctaaggtcaggagtttgagaccagcctggtcaacatgctgaaaccctgtctctaccaaaaaatacaaaaattagctgggtgtggtggcagatgcctgtaatctcagctactcgggaggctgaggcaggagaattgcttaaatccaggaggctgaggttgcagtgagctgagattgtgccactgcactccagcctgggcaacacagcaagaccccatctcaaaaacaaaacaaaacaaaaccaaaaaaaaccacacacatatacacacatgttctggagtcaaatataaaatcaacttgaatatttaatacaaaatatggcccttcaaagaaatttcttagtgtagggttttcagctctgccctctgatcatcttgacctgagtgttctctgtccgtagagtggcctctttgggcaggtgtgagcagcacggccgaaggaggttgtggggtgacactcaagaacaatgcctcgctgctgacaagaataacctacacacaggtcaggtgttttctctccagtctacttgtccagtgctcacttttcaatgccagtaagaaagatactactagattatgagcaatttctgaatattacaaaataatttttgaggtttctacctctgaggactagcttgctgtcacatcttcttcttaacaataaactccagtcatggccagtgagtcactgttcccttgtgaacagcagcataaaagcttttttgtatatgtgtgcatgtgtacacatgagcacagaactgatcatgcactacacattcacctactttactcattttacttttttattcactttactcatgttttttactcactttactcattttgcagacattggagcacctgctctgtattgaagtctaggtaaaaatgctgaacaaatcaaaaagaacttctcctgcactcagctgacagtaatgtggcaaagagagaaattacacaaattcttcaggatactgtgtagttttacttgacttttttccattcccttttaccctacaaccttcctccattcacagtgataaacacaagactccccagccctaaaggataattggggcaaaggaatcagaggagagtaatgtcaattcttggcttttaagttcaaaagctgtgtttcaaggagtgaagaaggaaggtcaaaaaatggaaagaatacttgctaagccagtttccttttggccaagggaagataaaaattatctctgggctgatggaaaacaagagtgggagttgaagtagatgagttagataccagcaagcgtctccaaagaggattcccatatcctgtcaacaccaaaccctcttgggctagcaccaagaggaagaggacactagagccctaggtaagtttggggattgaatgtagaagggatcgtgatccactctgcacctctgcatcttagatgtgaggatcttgcaggaattccccaccccactggaaatggaagcactgtgatgaatgtgtgagccagagttgtctgtgctcagaatggcaagggaggacagccagatgggccccaaaaaaggaaaaatctgcacaactaaagaagaaggtgtgcaggcatgggagtgggggcaggcagcagatggcagcacacgttgtaatgcttcacaaagcaggagaccaggctggctgccaatgctgcgacagtacaacatatgtgcaagtggatgctaactaaggactagacaatcttcctgatgtcatgaggctgtctatgcccccaggagttagagggagaataaagaacctatgtttacaatgtcaactttatttaatcacctaaaagggttggctgaattgacagtaaaacttccctgttctcagtggaatggggtctcaaaatatagcctaagttgaacttagttaaagttccattttttgaatacttttggaagtggatggaaaatacacatctgctacacatatgcatagttataattgtgctgtgttctctatatactgatgttgatatctatacccttggtttctcccctggactgcagatccacataatcaataaactatgtgatatcgccacttaaatgtgttctgagaatctcaaacttaatgtccaaacaaatatttgttattcttctttccttccttagtcttccccatcccgtaaatagcatggccagtcactcagttgcccaggtctaaaactctggtgtttttcttgattcctttttccacttacaaccacatccaatcccaaccaccagcaaacccagataaccctaactccaaaacacatctagactctgacaacgcattgccttctgtactgcccccatgtggacctagtcgcctctcacctgaactatgaagaacttctgaactggtttccctgcttctatcctgtctttcctctgtagatgctccatgcagcagtcggagtgacacttttcaaatggaactttaacatggccaattcctgtgctcaaccctccattattcttccttatacttcaaattaaaaaaaaaaattaccctttgccgtggcctacaaggctgtgttcctgcttgtctctctgctctcctcttacccattgctccttgctccctcctacccgaccccttgctgcccctgagtcagctcacacagctcctggccatttgcttgggcccttccctctgcctgggacaagcctgctctagaacccggcttggcttcctcctagttttgttgaagtcttagctcaaatgccacctatttagtaagggtttccctccagcatgtttgcatccctttctctctacctctcttggacatctttgtttggatttttggtactgatgccactggatatgcttatttgtttactgcctttcttctctagtgagctctaagctcctgcagggtgatctgtctttctggctgaccatgcatcctcagagcctggaacagtgcctggcatacagtaagtactcagtcagtccaggaaggagattgaggaggaaatgcttaaggtgctgtggtgagacaaaagacttagggcataatttcaatgggggagcctgggaaggtcttttgcaggcagaaaaatttaagcagggaacaaatggctagtgaggggttaggtacttggggatggagtacatctcacatggaggaaacaagagctgcaaagggcagggcagctgagagctgtacaccacgtactgcaacacgggcaggtacatggctgtatcacaggtcctctttataaagatcaaaccacttgttactgactccataaacactccatatccattgtgatatggaaagaagcttctatgaaatagactaacaacttttgaaatataattttaatgtttttatcacgtctaattacatgaataaggtgcaatgggcttcagcatccccatcccagatcactaaaggccttccctcacaaatggttttggctaaaactcaaccatatacaatggatatggaaacttagaagtatgtctgaaagtttattttgtgttgcatggaactagaaaaagagaaaagtgaaaacagtaacatagttataccctccctgctttgattgactgcacaaaacttttgctgccttcagcagttttacagtctaacacacttaggaggcacccccgccaaatgccggaaacctgaatctgctcttgaaatgtcagtgataaaaattaaaagaagagtagaagagtgagaccctaattgtggctaaatcatcagactatgaacataaaactaactaggatgacacaggaaaatagcacagcaaaggggaagaaaaacaccatctaaaaattgtgtgtctctgagatgacaccaagaatcacaaagcctgaggaattctgctttaatatccatattaaacaagtaatctgtttatcttctcatctcagcccatcctggccctttttccttactgccctaacctctctttgacctatagaaatctctttctcccaatttgtgaataagtcatggcatataaactgccaacctatcccttgatgagaatacccatttttatatttaattgtgtgtctgtgtgtgtggattagacatttattatatatccaggcactgtgctagatggtggggattaaaaagacaatacaacatgttcttatcttccatgatcctataatttagtggaaataactggtgaagtcttcattgtgcctgtgtcagccaagaatatttcattactaaataaaatagatgttcatttattctttcttttttttctttttttctttttttttttgagacagggtctcactctgtcacccaggctggagtgcagtggccgtgatctcggctaacttcaacctgtgtctcccaggttcaagcgattctcccacctcagcctcccgaatagccgggattccaggtgtccgccaccaagcctggctaatttttgtattttttgatggagatggggttttaccgtgttggccaggctggtcttgaactcctgacctcaagtgatctgcccgcctttggcctcccaaagcactgggattacaggcatgagccaccaatccattcattcttactggcatccaacctcattcattcttatttcatactcttatgtaaatatacaaatggaattacaataagggtatctgcaactaatttccacgctgattaaatgacagttttgtatcacaaaagaaagcactaatcaatcatttattcactcaacaaacatctcttgaagccacacagtcagacatgaaattacgagtgatcattccgtatatgatatgcagcttaaatgaaatgctaatgctgctgcaccagagtcgtgaagcagtaccaatctttatgttgcctctcactccagtgtgcttttgctcattttatttctgctcttggcaagatttaaataaaggctttttttctttgctctacaaatgtttgcagcagctatattacactgacttaacacagcattaactacagtacaaatacatactccctagattgcttttcgagaaaggaaaatgtttatgatctctatcaaacaaacactgaattcatcagtctgaaatttatttaaagtgtcagatgaatttgacaaaaatctatacctagaattcatttctgaacagcgtaggcttattactttgatttcgaagaaaaaaaataccctaaaaatgttctggctctctcagaatgtaaagttcaagttaaggcatgtatggctactatgggtttgcactgaattatgtgaagaaaaaaaaaaagcatttctgtcttggttgcttaactcagagtaaaatcattagtcccaattctgcaataaaacaaaatatcagtctaagtgaaaacaagtaagaagcatgggctgagaggattttacttttattaggctttactttatgacccaggcaccaacctgaggcagggcatagaaaaaacatttctagacagggacagggcaaatcagccaagaaaatgactaaatgctggagaaaacaagtcattgagctattttaaatctaattaatttgataaaatatgtttctatttttcccaacctaaaaataaatgattacaataatagaatcatgagtgcattgcttataatgtaaatgtcttttttttttttctattagaaaagctaaagaacatggtattcctggggatatttttctcccttggtggtttgccatcatgtgcgttacagctgggacaggccttacaaggactccaaatttctttctacaaatgaggagcccgtggtctggagaaacgaggcgagttacctatggttacaaagctagctggaggcagacacagaatgagaggacaggttgcctggctcacgtttgctctcttgttctctgtcattaagtgatggaaagggaccgaaatacttaacaacctacagaaatctattccactcacgatatgctccttgtcatccaatgatacagaacagattggatcatggatttttgcttcttgagtgttttggagttctgtagctaaacaggatgctgcagaaactgggaatgaggaatctcaagaacaaaactacacactgtaaagcgtgtagaatcattccaacggggttcaaaatattttgggggagcacaggtgacccccccgtctaacgcacaatgtttctgaggctggttccagagcagaccatgatgaagtggcacctgtagaacgtgtaggcagtagccactatggggcactgtgcaaccaaggaaatacacctgcaaaacactgagaaatccgggtcctccgtttgctaaaggtaggacctggcactacttaattaacctctcccatccccagttctcccaactgtaaaataagaagagtaattaactgctctgaacatctcacaaggtaattgtggggatcgatagagactgggtataaaaggtgatgtggagctaggaagagatattattatcattacatgcatgttctttcctcttacttgggaagacagcacagaagctacaaaacaatattatttctggaagtgtggtgcctggtgctgcctcagaacctctaaggaggtgtgtttaaaacgcaactacctgggttctatcccagactcactgaaacgaaatctgggtgggcatggcccatgatcctgtcatgtcaaaactttcctttggattgcatgtccctaggactgcactagaagggatccagggagtaaaagccagaggaggctgggaagatgggcaaccgcattccacagaaacaatgttcaacccactggctggaatctccaaactacccacagatgtctgcctgatcacaatcctgtaattcttgttacctctaccaaaaccaacctctctccctgcagccctggagactacaggcactgccagacacacacctgcaagcctatgcaagggttgttttcttaagcctcctgctctgatggcccttggtcttctcccctgttcctgcaacacttcataggtaactattcctccctgggtagaacctttccatgaccagtgattggcacattttactttcagcgtgtgatgtacaaatacttgaatgaaagacagaacatggaattcattatactcacaaaaatcttactatagcatttaacattattctttttgcaaaatgtattcacatttcccattcgagaaggcaaagataataagcatttgagtaacaaatacctggattcagatacatttccaacataagtttttttcatttattagctgtatcaacttgggcaggttattacacctcagatcagtttcttcaactggaagacagatgtaatatcatacaacctagcccgccttcaggaagattttaattgggctccacaggaaaggcaattaatgtatcgccaggcacagatgctcaaagaatcttcattctcttcttgtccttttcccttttcacactttctaatgggttctctaatagtctgcaatagccacagcttttaacaaatcttccaaaaggaactccgacagtaaatttgattcctactcagtagtgtgctattaaatgttttacaataatctctcagggagggggagtggaggaagaaccctgattgttagtgtttgcccattctatggtgtaaacgcttccactatagccaatttcaaactaccaatgggatgttactgaacggaactgggatgcgatgtgcaagagctcatcattgtatgagtatttccaccacacagatacaataaaagtaaataacttccgagagcgcagataatatgaaataaattgcaaaatgaaataaaagaatcagaaagtgatgagtgtgaagtatttgccatctttgcttttaaactggctcataaatctcctgaaaaggtacaagccaactccagcacactactgtatcttactccatcaagaaaactctgcccttagaagggtactaattgcaggcatttcagcctacctagagagctttatttatgcaggaccctttaaacagatgcagagagcacatgcttagagtttctacaggggtgaaatgtggctacaaaacagtatgtgtctacgtgatactgacgtgctgtacatgtgcatcagttctgctagggaagagccttgtctggggagaaagaaagctgtacagtgcttaacacatgaaaacacccggtcagcaggtaacagtaacaggtagtaagcaatagcaaaattcgttacacctcttctctccatctcatccttattacgaacatttatttatgtggcttaacttttaccttaggtccatcctcgttgtaagacactaagccatgatgtaacaatttttagggcccatgtcagacatgtgtgacactctcactttagacacaaggaaacaaaggtacagaggaggaaagcaagttgcccacacttaaagggatgtgggactggaattcaggccttatacttttataaaatggattagttctccaaagccttttggctactatgtttcatttgcttattcatttgtacactgttttcaagagataataaaatatatttgtgacttataaaattttgtttgcagcctgctcagttccagaggtgacatttaatgaccctgacttgcatttgcattaggttgtctttaccacaatagagccatcacattggaaaacttgctcagcagtagaagtggcaggaattaacttttattaaaggcttattaggtaccaagaatattagtaataaattataaagatggcttcatttaaacagaagaacaacctacgagttaggtaatattatggcctcaattttatgatgaagaaatgaagactccttgaggttaagaatccatcagaagtttctagggctggcttgctgggcatgtgactgtgcagtcatgtgggacccgacacccagaagagccacacttgttttaatgttctcctgccactggcctgaagttctcaataactctgtctttgactttgtgtgctatacctgaagtcagatgggagagagtggaacgatgaagcaggcatgggtcatatgtgtgccacatcctgtccatcgttccttgctgcccacttaaagttgtctaacattcatgatgcctcatgagcacaggactctggtgaggtcacaatgcttgggagttcagcaggactcaaaacgagtgcaaggtgagtatggtacctctacgacaagtggaggatcccacagctcccagaggccatgctttctgtcagaaccagaactagcttcaaacacaaaagtaaggcaattgtactttaagaaacacaaccgaccaaggcccctatcatgtcctttcttatttccttatattggccaaacacttgtgctccaaatggtgacacagaaggaaatccctgccttattcatcaggaagctgaaggtagaatgtgttggtaaaacacgcatgtatcaagaagtaaaataaaaacaacagaattagtttttggcagtgtttcctctgttctggtcagaaagaaatacataggaatgtaacagctatgaaatacaaattgtgtaacttcagtgattatgcaaacaagttaaatgcttttaaatttgcatttaaaactggcattgcacgagttaacaataacagaaaaaaacataccaataattacatttttaatttttctttacttggaacattaaaaatactgtgacaattcaagaggcaaggaagagaagggaaaggagggcagggaagcagtgggaaggaaagggcaaaacattttgttttagtaccttggagggcacttctttcctgttttttgaataaatggctccacattctaatttcgcacagggtcccacagccagccctggctgtcacacaacgtggaagcatcagagtcagtatctgaatccaaactgactccaaagctcctttgctttgaccccattttattcagccttttattttaaacaacacggctcttcagtttcagaaaatttttgtcatgattccactgttggcaatctggacatgtgacaattgtttatccctcttcctttttcttaagtttttcccctttctctgaatcatttcagctgtgctttctccattcattgaacaagtattcactctgtgccagggacatctaactctgttacccggtggtgcatcggcaaagcctatgattttggagacaacaaaggcgaagtcatttctaagaacctcagaaatcccaaatgacgaggtttatgcaacttcaaagtccttctgctttttttttcctcctaatacttgattacctctctaagcagaggctgcacttcatgcaggtctaatctttcagggcacagtgtggttaggaacccacccccagcccgacccccgccgccaaaatgagcactggttgtaagtaggcattcagtttcaaagagggtttgttccactgaacaccaactgtggattagaagcagcagattaaaattctgtttgcttgtgtcccgtggaggactcaaagtcaggggatttctatccaggactttctttcttttcttcctcaacctctccctccccccacaaaagccactgtctgggttgtaagttaaatcaatcataagtcatctcaaagaataaggtattattatataagaaggtaaggcaagagcgaaactaacaaacaaaaccctatgccacttacgctgcttaagaaagagccaaaaaatgtactagacatgacgccaattctatttcttttaattcttctgttgtgtcctaatgatactagccacaaatactacctttgagcccagcacagttgtgctggctggcaatttaaaatactgtttgtcaaaaggaaccagatcatttacgctcactttacaggggaaggaacggaagcctggaatacggttaatttttttcatggtttgttaaaacagaaggaaaagaaagaaggaaagaaaaaggtaactcatacaaatccccggcaaggtgcagggcctggaatttgagactaaatctgtggactccaaagccccagtctctcctcacaggctgccctctacagcttacaaagtgcattcatgcaccgcgcatctcagtgccatatggatgtcagattaaatgtccaatgctgacctcagttttactgaaaataaactcttcataggtcataaatttttagaaccggccataataaactaaatatctgtgtacaagtcccaaagcaaagatcgctgcaccggaagcctctagcagtgcttcaaacatgcttgctgctaatacttagaactgccgttatcagagacagagatgggagatgagaaagaaacagattgggagactagaaactgaagaatgccaaggagagaatccagtatgacaaaactgtcatcaatctaccatctgtgtagagtttgggggtttcagagacaacatcataggtcaacttgcttttcaaatgtctgaaattgtgcccccacatgtgtgaattgtggctagacagcatgaatcacggagtgcaatacaaaaaagaaaaagaaaaaaaaaccacttatgaaatgcatcattgagggagtgtcattacattctgctctaagctggtggtaagattcaaagtagactggtggtgggccattgctaggttgtaataaagccacatctatggtgaaaggagtttcttttatttaacaaacatctatggaagacatctgctaaccactggggatacaaaggcaaatgagatgagctcccatatcttaagaactggtggcaggggaggggtggtgggctttggaggggatttggggagtggtgaacagaatattccacaagtacaagacagatactccaggagaggaaggcctggaagggagctgcagactccctagaattcttcatttggaggggaggggcacctttcaaacaggtacaaccaatggggaaaggggtgtgggcctctggcagcttccttgtgcacagagcttgtcttcttccattgagatatttggacaaaaaccaaactagggctactctgtcaattttctgcagcaaactgtaacacatcttgtttcatcctttcatcttctcccgcaggaacttcaaaatatcgaccgccctttaaactcagggataactgctcccatcctaggaagcccgcaatttggaaatggggcaaagaggctccagctcccacccagtcagggagggcatgggctgactgtttacaaagtgcagacgccccctcctgctgctgcttttgctctctgggcagaagcagggccttcaaagctgtcagtcagacctttgagaacatgaaagaaccctggggagggaagaaagggtttgtttgtttttaagctcttctcattaagttgactgatagggaggctcacacacaacagtggggggcatccaagtctaatgtttaagcctagacagctccaaggggacacctgttggctgttctccctcgcacctgcccaggtggctgggcctccgactgtcctctctgcacctcaccccttcctgacaccaagcaggactgaacagagggccctgcccacaaggcacctgacctttgagccagggagacagccaatcctaaattgtggagactgcgatgaggctagccactgcgctgtgccactttccacttcagtggtgtgacggaccaacacaactaatgaaggtgacgtacctggggtctgtctgcaagatggccagtgagaggagggtgggaaagccagctctgtacaggcagtcacctgggggatggggggcgctacagtctgctgctttttgcacaggaatcatctgatacccacagaatgagattcttcccacccttcattggccagagagagtcctggaattgtgcagagcccccagcctgatgctagccttctttttcctggacaccaagagacagcctttcttcccaaaaatgaataaagatagttattttgatgtataaactgaatgtttaatagtaattcactaagagggtgaaaaacgtgaaaacttccagttagctcggatagtcatgaaatgtaaacaggtaaacccaggccacttcttcttgttagatccatattatttattaccagttttctaggaagccacaaaattgtgtttactttcattgcctgagagtacacgttctcaaggaatataaatcagttgaaaaagcaatctaacaaataaacaagcagaacaccaaactcattaccaaaggtgtgcccaggccaagttcatctcttctcccaaaagcttgagatcctttcaaatccagtgccaatatccaatgattatgggtttcctgaagagtgcaacattcttcaggttcacaggttggtttgggcacaggatgagggcttcctagacattaacattccggaatacagtcacagacctttctaaccacatccagtcatctaaaaacttctccaggacaacaatataattaaaaagtgcagagaaaccaaccagcaatgtaaaccctattaagatggcatagcacggctcataaggaaaatgaaaagggcttgggggtgtgcggggatctaagatcattaagcaaagtgaaagaattttaacagatttttaaatttaatatagtcatgccatgctaatgacagagacacattctgagaaatgcatccttgggcaatttcatcgttgtatgaaatcacagcatgtactcacaaaaaatctagatggtacagcctactgcacacctaggcaatgtggtatggcctattgctttgctcctaggctgcaaacgtgtacagcatgtcactgtactgcatactaggcaattgtgacacaatggtatttgtgtctaaacatatctaaacataggaaaagtacagtaaaaatatggtataaaagatttaaaaatggtacagctgtataggacacttatcataaatggaacttccatgactagaagttgctctgggtgagtcagtcagtggtgagtggatgtgaaggtcttaggacattactacttgctactgtagactttataaacactgttcacttaggcaaagtgtaagtttacatgaaatttacaaaaaaaatggttttctttcttcaataataaatcttagcttaagattagtaatttagcttagtaactttttaactgtataaactttttattttcttagaactttggactcttttgtaacacttagcttaaaacacaaacacattgtacagctgtacaaaatatctttatatttattctataagcatttttctatgcttaaattattttatttttcattttttaaatttttttgttaaaagctaagacacaaacccacaaattagcctaggcctacacagggtcatggtcatcaacatcactgtcttccacctcccacatcttgtcccactggaaggtcttcaggggcagtaacacgcatggaactgccatcacctatgaaagcaacgccttcttctggaatcctcctgaaggacctgcctggggctgttttacaggtaactttcttttttattaattagaaggaatacactctaaaagaacgatagaagtatagtacagtaaaatacacaaaccagtaacacatttattaccattactttattgtttataatcattatcaagtattatgccctgtatataattgtatgtgatagacttttctatgactggcatatagtaggtttgtttataccagcatcatcactaaaatacacgtaatgcagtaatgcacactgcagtacaaccttacaacagctacaagtctctaagagattggaattttgcagctccattataatctcaggagacccctgtgttatatgtcgtctgtcactgactgaatgttgtatgtggcacttgactgtatactatctgaaataacagcaatgctgaagtgctctaggaaccaacttaggttcctaatagaagatcaagttttcttctttgcctggtgcatgagtccagggccaaacctgagtttgtgcttatgttgtggaaatcaggaacagcctcaggcagtggtggggactgccaagctgacacagtcagaataacaaccactaacagtcagcatccatgaagtcactgaagtccttttaagttgcttatgaaggtgacttaaaatgatttccatggatgtgaggacatccacacttaggctcttctttcctcacttgtacgagaggtccctgtgtctaacgtaaatggagaagtgacatcatttattcaaatgccccacatacatccttttgttatttatttatttatttattattattattttgagatggagtttcgctctcgtcacccagggtggagtgcagtggcatgatctcggctcactgcactcccgggttcaagaggttctcctgcctcagcctcctgagtagctgggattacaggcgcccgccaccacacccagctgattttttgtatttttagtagagacaaggttccttttgttttaaacttcatgtgctttcattacatcctgtgaagttctatttaatactgaagatcacttaatgttcctaacttcaatcgctggtaatttttttttatttcgattctagtacaggttcagagtaaggaaaagagtccttttaattaactgacatgtgccaggcattcccttgattttagccttgcctttgggaggttgcaaaatttcaaaaaacaaaataaaactaaacaaaacgctcactcagaaggatgtgagtctgggaagaaattctgaaaatatacaaagttccacataaattctaatgaccccaaatgctcactaacccttcatctctctccgtagatgtccccagccctgtggccatctcctgcagggagcgatggcagaatgaggttgtggccatgcatctgatacacacaggtaggggacagcacagcagcttcctgggctttaagctaaaggtgtgtgttagtttctccatctgcaatggggttgggctaaacccaagatcaaggccctgcatttataattcttcatggacaactgatgttgtatactccccctggggcagaagtacctttttcaaatttcatagatgattcttgggcaggcagcataataacaaaacactgctgagcccattcgttctggaacggccttattatcacaccaggtgctgaaaatgtatatagttctaattgtaggatttgacaacatttatgaatccaagacaaagtgcttttataaattctccatggacagatccaacccaatatatttactaattatttactgattacacatgtccattagttccgaatgctttgctgaaggaagaaacaaagatgctgaatgctatttttaatcattttcaacagaaatgagaatttcaggttttctctgtgagattcacaagtggcacaaaaattatgaggttgaatggtttagcagtgatttcctaacattgctagtaaatgtgtttctccaaagtgattagtggcaactctgaagtataagacagtgtatgtgcagaatggcccatctgggccatggtctcttgtccttagagaatgttctgtttataaatagatcactagaatttgaggagctctattcatggagattcaacttgaagaaagagggaaaaaatccaacctactctcttttgttttagaaatcacatttagggagtggacagccatcctttcagtctaataggactcttagatccatccatttgacatagatttatgaagaacctccagggctcagtaccacacaacatgctcgatagctggcacacggagttctggaggctgcctgcaaggaacttacagtttagcagggatgggaagggagcaaagtcaattataacagagtagcaagtgtagcaacagagaaatgatgctgtgctgcaagtagggaccattaaatcatgttaggtgtgtgtgtgtcagaaaaggcttgctggtaagttaatgggagttggtggaagttaggggttgggaggcgggcagaaggagagggaaggaaccaagtccataataatcgggtcaaggagagatcctgaaggtagttgtggctaagaggggagtaggaaagtggagaccatgagcttggatccaagccagaagcacatgatgttctaaaaatggcagtgttcggtatgcaatggacgacgactggggaatctaaggagaagagaatgcagcacaatcgagcttaaggtttggaaggaggactcttggccaaagcggaaagggatgggtatgcaggaggggcaagagtgtatggagacatctgtaaaataaattctaatataaaatgctctgttagctataagcagtgcactgcttcccctcaatttttttcttaaagagtatgataaacaggtgatgctgaagcccaagaaacacttcaccctctagaaactgtatatgtcactgtttccataagggcagagactgtggacaagcacatgaagcataaacacatattttcaagccacttaaatagtgtgtgcccaagggcacattatagacaagccagcatttgcagcagcaggtagcagaggcagcttcctcttcaggaaacagacaccaaatcattagaaccttaacgctgtgtcaactttggctgccaaatatgcagctccataccaaatggtaccatttacatctggctctgtatctaagccaacttctttggctttaagaaaattctgaatttatacaatataatatgagtacatctgattttcattaggcagtctgcctgttctcctttttcacttttgaaatcacatttatatttcttattctcttccgttctactaaattttaagatatcactttactttttttgtttcttttttttttttttttgaaatggggtcccacccatttggtcatccagcctggaatgcagggtgtgatctcagctcactgcaacctccgcctcccaggatcaagcaatgcccccaacctcagcctccagagtaactgggaccacaggtgagtgccaccactcttggctaatttttgctatttttggtagagatggggtttcgccatgttgcccaggctggtcttgaactcctgagctcaggcaatccactcattttgtcctcccaaagtgctgggattacaggcgtgagccactgcacccagcccattccactttttctttatattcctttgaactttagtttttggtatcatggacacatctctcaaagctggtcagcacactccaagtacagaccagcaactgatggggtacgggaaaggcctggattgggtttttatatttacattcattgtttccaaattgcaatgcagaatttctgtataagaacaaaactacaaggaatctatatgactttaatcttccatgtcctgatgaacttttcctgatgagctagttctttaaaacatctcctaagagaatctaattatattatgtagaaaagcttctaaaactgaccatataggaagcttccatattataattgggatagaaatatatcatctagaaacaacagagattccttgggctaagagtcctatatcaatgtccacttgcaatattaaattttttccaaattcacaattcagaggctacaagttaaatgccaaataaaattaaactcagttagtagatttctttttttgtaaatagatgaggtctcgttctgtccccaggctgaaatgcactggaacaatcatagctcactgcaatcttgaactcctctaggctcaagagatcctcctgccttaacctcctgagaagctgagattaaaagtgcaagtcaccatgcctggacacaaatttcatttttaaagtgtgttttttttcatataaatattatatgtccagcattatttttaataaactggaatattttaaaatacatcttcaagatttagagtaaaatgtactggcttgtactacattttaaaatttacttttggtcttctggttatagtctactgaaggaagatctaaagcactgaacaaatggcaaaactaagctcttctgttatagcaatcctggggtttttataacaaaatgaacttcagacagcatgaaagtttcaatgatgaacaaatattgaacttttgtattttaatagcacaaccaatacttcattcctggttaactttaccttattttttaaaaaagataaattgtttaaaagttattttgtttaaactttaagtataaactggtgagcaggtgacacaaaactaatctactctgatataaatcagaatagtgagtacccattgggggacagtgaccagaagagggcatcaggaggcttctggggtcctggtaagaattgcttcttgatgtgctggttatataggtatattcaatttatgaaaattcatcaaaccatacgcatgctctgtgcaagttggcactggcaaaagatttaataattaattttttcatgtagcaattttctggttaaggtatacagctgaagaaaacaagacagatagggtaactgcataaaagccggagtaaacctgtgccttggaggtagcaggcgccacagcttcctccctccgcatgtggacagaagcagcacattggtgagaaagacatgtgcttagagaggcagaaaatgaggaagagaaacgttcaggactccaaagagtctatttagaggaaaaaaaaggtggtaggtgggggaaagtaaagatgacatgtttctttgtaccattttctcctcccacattccatttgacatcatgcagagatgttcatttgacatttctgggttgaagactatgaggggaatgcatcccatggaccagtggttactgactacaataccaccttcagaaagtttaggaaatcctcttatggccttctgtgattttcaagttggggatatagccaagatggcttcttgcagaccttcgatcccagaaggtggtttgggggcaatattccacctcagtcttttgtacctgaagttgatgaactctgacatgtgagattacatggagctgacaatgtcacatgaaagtaaatctggattaaaatattacatatacatgtatatacacacgatagaaggcctgcgagctccacaccttcgttgtgtgcaatgatgtcactcgcccaagcgtctgaacacatcagcacctatgagcttcttttggtaaaatttagtatctacctcccattctaccatcataaacaatggggcctgtgacttagtctctatttctcccccaccttagagactgtcagtaccaaatgaagaaaattttattttgaagtacacagttgaacatgccaagaggcttaaccacatctctataaaaatatttggttggcacctacacaagataaacaagagtgctcaaataccttactgcattcattaatccttattttctacccaccatatatacataaaacaaacaaacaaaaacaggtgtgagcaccttcctacaattctgttccctacaacctctccacacacacaaatctgaatgttacttaaaggagaaacaaaccaatcaatatgggtatgcctttcagttcagtgaggaacagttctaaggaacagccttgtgaccaaggtcctactgtctgggttgagcagggacctgaagggctgcaccctggtgcctggctggaggttgtgcccaccaccctgaaaattcagtggctattgcttaggtgctggatgcacacagtaattcccaaaccaaatctgtacgcccgtcacagttaaccctctgcatccgcaggttccacatccacagatgccacccaccacgactcaaaaacatttggaaaaacaaataaatacgaatacaacaataaaataccaataaaaatacagtataggctggcatagtggctcatgcctgtagtcccagcactttgggggttgaggcgggaggatcgctacagaccagaagttcaagaccagcctgggcaacagagtgagaccctgtctctccaaaaaattttaaaaagtaaccaggtgtggtggtgcccacctgtaatcccagttactcaggaggctgagtggggaggattgtctgagcccaagaaattgacgctgaggtgagccatgattgcaccactgtactccagcctaggcaacagagtgagaccctgattgtaaaagacaaagaccaggctgagcgtggtggcatgtgcctgtaatcccaacatttttggaggccaaggtaggaggatcacttgagtccaggaattcaagaccagcctggagagaacagtaagacccctatctctcaaatagaaataaaaaaacaaaaccagcgtaactgtttagatagaatctacattgtattaggtactataagtaacctagaaacaattgatttaaaatatacaggagaatctgcctaggttatgcaaagatactatgccattttatatcagggacttgagcatccatggattagggtatccatggagaatactggaaccaatcccctaaggatactgagggatgactatatttctacatcataaacccacctctcattttcaacacagtgtggtaagaacaagattgagctaattcgggcaattgaaagacagggatcgacatggagtaaaatgagtttgtttagttttacctgtaagacacacacattaagcacttgattatactcatgggcttccaaattataattgggatagatacacaccatctagaaacaaccaaggttccttaggccaggagtccttccattaccccttaagaggcacattgtgtaatacagtctaaagctttcctttcacccacttctggttctacatcgaataccgtgcttaacagtcatgagacaatactgaaaaaatgccaaacaaaaaaaattaaccctgcctcttctgtgtatgtatccaatggtgatatatggggtattagtgggatatgatgataatacagcatgatgtgttttaactctgtggggcaaagtgtagagtgaagcaagtaacaaatgtttagatttaacttacggaagcaatcacattattttaaagccatacctttctgacactttcctactactatcaattcaactttggaaactctcccacctcaaatagttaatgaaataacctacttaaaggcaccccatgaatgttattctaacatatcaagtattgactcaggccaattacttaattagttcaactttcccagctactaattttgaacatcaggcagaagaatgttttttaactaccctgtcactcagagggggtaagctgccctttaaacaacagaaattatagaccaattatatatatatctattatagaccaattatatacgtatctaatgtatataatagaaattatatattagaccaattatatattattatatagaccaattatatattattatatagaccaattatatattattatatatacatatagaccaactatatactattatacgtatagatcaattatatagacaaattatatactattatatatagataattaatctatatataatctataaactataatatatacattatacatatagacctatatatacatatagaccaattatatactattatacttacagaccaattatatactattatatatatacatatagaccaattacatactattatatacacatatagaccaattatatactattatagaccaattatatacatacctaatgtatataataaaattatagaccaattatatacatatctatacatatattgacatacttttaaaagaaaaccatattacacttgtctatttcccatttattcataaattatttaaaatttaccttagaaattagagcatataattttcttttaaaataactcttaggcttatggttttaattattttgcctatgtctatagtgattaaaagacactataattcagggcaattccaaatagtcacctgctttccagaaaaaagattgaataacctatagtatttggtgaacttctggctgacctaaaacatctcaagtggttcatctctgtcatcacagagaacagctaaccaatatgtaggattccagtcatcagcctggggccaggttccccgaaggacctgcctgagaagacaatctcaaaagttagtctcaacagtcaaatgcattctgcatttcaccaaagggaccaagggagtagaggttcttgcatgttgagcatgatgtctgctattgtcataaagaacatttacacaaacattcacattcacatatatgtacacacataagtatgttttccatatgtatcctatttataataaactaagagaaagtttaaatcttaaacatttttgttggtttctcacaagccatgtaatttggaagataaaattttcccagagataagccacataggaaaaagaatgttcttccttcagttggaagggctaggctcttgtcctgactttgttagtcaatagccatgaatcccaacaattaatgctgaagtatcctaattcaagttcccactcctgattgctgatgtaacaacacataatgcaggaatttattcctctggtacctacttgcaagtgtgtgaatgtgtctgtgtgtgtatgtgtgcacatgtgttcttttgaaagacattcctctttttcatatgaaaatttcttttatttatttctttattttctgagatagggtctcactctgtcacccaggctggagtgcaacagagtgatcatgactcactgcagcctcaaactccagggctcaggtgattctcccaactcagcctcctgagtagctgggactacaggtgcatgccctcacacctagctaatttttgaaaatttttttgtagttatgggggtcttgttatgttgcccaggctagtcttaaactcctgggctcaagcaatcgcctgcatcagcctcccaaagtgttgggattataggcactgcaccaggcccatacagagatttctaatggggtatagtttccctaattttaaaatataatttacatagcaagatccctcttctaacagtacaaacaaatccattcatttaatcctaaatgtacagttccattttgtaactgggttagctctatcatttagaaaacaaatcccatattaactgtacttttttctacccatttgaggtcagtggcacaattatgggtttttggcacatagcaatatacttacatttcagaaaagtcatcattacactttcaaagaagctacttttacattttacttctgaataatgaaagctattggattatctaagagacttaccctttcccatatttaatttaaagctaagtcattttagaaaccacaattaccaacatgcaagaacctctacttgaaaaatttgtagaatttgaacatggaaaaccaattgttttaaatttaataaagcatttttctctcgggctcaaacagtagaagcagcccagagtagaacttagtgtgaattataaacttctgaaaacaaagacttataatcaagatattgcagagtttttctttacagtgtattctctaatgctttagccaatgtatttttaaatgtcccaggagactactttttgaacttgctctccttaccaacccagtaactcaaagcagatggatcattttcttgaatcttagcctaaatttttccttggaaatttcacttgatatgacatgcttcgtatcagcccaaatttcattctaataatgactgcctggatattccacatttcatagcccatttttaagttgcagcttaaaaccttttctgcttccaggttctgatgaacacatgctttctgtatacatgggctccctgacatcctcttccatcatatacaatcttccccatccagcaggctcagcctgatttgaggacatgaaaactgatagtcttagttggtctctggccccacacaattacaggagttgtcattcttgttttcctctgttgaggggatctcagtctaatagcatgggttttggacacccagacacaggttcaaatcccagttctgccaaggcactttaccttcctgaggttcagtcttctcgcctgtaaaatgggcacaatgatacctcccaggattgtggctaaagtacactttgataatctgtgcaaagcaaatggcaggatgtagtacatcataagtgcaaattagttactattattattctttgaattactaccatctcctgaggctgcacaggaattagcttttaagtatgccacaacttacaattatcagttttgtggaatctcacaccagaagacatgtgggaaaggatttaatataagccttccttttccagccttggaaactgagctctgataaggctgtctttctccagtgctggtcgctgcagaagcactggccaatagctttcctttgctctctaagaaagtccagtgcaaaactacaaacctagccttcacatgcttctagctttgtaaagccactgcatgccttcaatttggacttcttccctagacaagaccacagagggcagcagaagccaggatggcacagaacagttccgtccagatagaagtcctccgcagtgggcagcatgcctctgatgtcatttccatacacagaacaattctcccaaccaaccagtaggccctgggtactgtgggataatcaggaacctgcaggtggcaaagtgaagataatagtcacaactgctgggaccctgctttcaccagggctaggaccaatgctggagctggaccagatcaccaactcctgcaaagccttaggactgcccaggtcatacttcatcccctttaaatgtatttcacctgtggactaggtagatgccaagtattttgaattgcaactgttcccctatcaattcaatgggaggggtgggaggtggctgggaccaagcaagggtaaatttcaaattttgtaaggggcataataaatccgtgtttctctaacactgatatcttcgcattgtgtacttaataacatttagaaagaaatttctcaaaagttggaaggagagctttcggaaaaatggtaggtatattaaactgaaaatgtggtaatccactaacagtggctggtcatctacagcccattcagtgtttggcattgatatcaaaaattggtgtaagaacattgaaaatttctgtgcaaatatgcatctgtgtttcccttccactttccaaaattagtatataattatatgcaattgttacttttatagtcatttgggaatttcatcccattttttttaagggatgagatttcagatttcaatgcttagaaaatcaaagcttaacatacacctgccatgagggtactatctgattcccttagacatttatgcatgctgaattaagtacttaatttaatttaagcaattaaattttaagatcatattacagaaaatccaggaaaagaaaaaactcaatcaatcaggaataacacaatacatttaaagagcaaatgcattaacaaagactgtccttattatcatgcataagatatttttattcaaagtctcacccatgaggtagcaatctgcaaactaattaagagcttcccagaggacaaatatctccaagtttttggaaaggaacctatcatttatttacctaagaaggagtggcagaagcctagaaatcagtttgtctttcagaaaagatttaatcatttgagaaatgcttggataaattctaaacctggagggtaaaatttcagtcagtatcagtataagcaatagaccagagcctcacacactgaaatcatctcagaaagaagagaaactcgggggtgggggggtggaacctccagaaacaagcacgtacaggaattttttcagcagtcccttcgctatttaatctttgctggctggattggccacaactccctagactcaacttatgtcttcaccccacagagtaaaccttttccctcttaattatcctcatcagaaactcaacacagataactgccctcttctgcataataaatcattcacatattttcaaatgttaaattgtctcaactttgaatcctctagtctaaaaatcctgaattttgtatccttgcttcctagatcctgtgcaccacatagcaaactcaccaaatgttggtccttgctctgacctcactctttccaggagtatccatccaaagcctctctaaactgtggagctcagtactccatataaagcagtgactcctatcacaatctctacaagacatttaactcaaaactccagaagctttcacagcaccaagcaaaaatgtaagatgctaccatttgtatctattgcggcaaaaattggatagagtgcctttttaactttgcagtaaaattcaaggcacttcacctattattttagactttcatcagttttgagcacaatatccattcacctttgccaacagtttcttttaatgcattagtacaaaattcctcaagtggtatataaaaattttggttgtcagttccagaaaaataatgggggaaggagagtgggtaaaaacaggttcaaggccacacatcagttttccttttaaaaaaagttttaaccctaaatttgcagcgcatatatatatatatatatatatatatatacatacacacacacacatatatacatatgtgtatgtatatacatatacatcatatatatatagcacttcactttattggaattcttccttggtcataaattatatttcaagttggcaaaaaatgttgatcagaatttcaaaaaagggaagcatcaaagtaaccagcatggggtttttcaagtgtgcagaaagttctctaaatacaaaatgtgcttccagcccaccaaagacccccctcacccaagcaggcagtcctcggcgaggagggtcagcatgcccctttatggtcagaacggcagtggtgcaaaagacaatgatttcaaccaaatatggtttgcctctcgccaaatttttcgcatgtccaataaaaataagttcacaaaaatccagccaagcattactttccccccaaaagtgcttctcagattacaaaacagctttgaaagttcagcctgacaaaacaaatatggtactaggaggagagacctggaaggcaatcacaaaaagtctcatttaaattcctggaaagcacagcttctccaaacacagctattcagctctttggaaggcagcacttgcgggagccattgagtttaacttcactcagtcccccaacacagaaccggcaaatccgaatgagatggacgtcacactccctactcaaaagaatgcatcaaatatccactccgtaacaccgcggaaagtaaacccaaaagcggagtttgccgcctgccaactacataagaattaacactcgggtatttaggattctaaagatccctactaccccaaacattatagccacagagaaccagaaatgaacagaacacactttaacctttaagaagtgcagttttgtacgggggttggctgaagaaagacaaaaatcttcactcccttccagagccaaaagagccaaaataaaagatcacctttactgagccacaggggcacaactgtatccgcccgtccccaaagcgcaagccgtcctcccgttcgcttctccagaatttcctgcttttccccaaaccaccttcaacattccccacacacgggtctcgctcctaaacacggagtgtaactccgcgcacagcagcgcggaggctgcagcgccaccaagaaaggcgtcgccaacccttacccagtgccctcccttaccagccttcttcccacgccgcgcctcgaagcgcacgacaccgtggtgctcggtgctccccctg

SEQ ID NO: 1620 - DNA, 85509 bp, Homo sapiens
cttctagacaaatgaaaacatgttttatttacaagaaaaaagtctgtacattgtgtatacataaaaatatacaaaaccaaaatagaaaatatccaagtgttaaaatgtgtacaaacacttttaaaatgcgactcctggaaaacttcaagctttaattagtttgaagagtacacatttcattttaaaaattatcatacaaaagaattcccaaagctgttaaaaaagttcactggtttccactggaagaattgtctaagtatttcatctagaataaaacaggatttgttataaatgttagattttaacaccaccaatgcaatttctttgtttccaatctacctagcaagaagactattttccatagaaccagtaaatgtttcttctaatctttgaaagccatgagctacagctaagcttcccttcaaagttcagtgttaaatcaggcttctgactaggataaaatattaaggtagtgttctaccttcatagtgccttttaaataattctgtcagtccattttaatgtagccaagatgtgcagagtatgagtgtgtgggaagcggttggcggaggactgaattttttttcttttaacagaaggacatataacatttgcttccttctctcaaaatattagtggttacataattaaaataaaatttattgtaaaggtttcagtcaaaaatattgatgaaaaagcaatataaaaccaaccatgtgtgtagatatgtatatacacaattatataactatatctacatgtacacttttcatactaagaactagatcaatgtctttaattccttaaatgtcattagctcaagtttgaacagaaacatattacattactttttttttaaccaaaaggcttcattcatttaataaaacaagaacttacattttatttccttgaacggacagagaaatacctttcatttatcaagtgtgtaaataatgcccatgtgacagaaacatgcataataatctcataagagaatatccagagataaaagacaagttgaaactcagggacattttacccaagcaattaatttccagatggagttgccttgatcagtcatgtaaccactgggtaagagttctaaactatcagaaagagttctaaactatcagaatcaaaacagacaatacaatagaacatacttggaagctacctggccaataggttcactcatgtctttctgataattcccctggtcccacctcactccctttctctgtctcttaccacagctaagcagaaattcaaccaagtaactgaccacatgtactgtgtgttgatctataagaaaaactggagagagaacttgaatcatggcatttgtgcgtatgaaattcaatcacatactggcactcatctaagactgatcccacttaaagcacccaaacgggacctacctaattaattcaggagatgtgttactgctcagaagagtcaatcagcagcgtaagtatgatctgtccagcagaattaactggctcatacacatgtaagagagtgacccagctactttgatttcctaattttgaaaacgctaatgattattttagcatttctttttttgcagatgctatggctacaatgactgaggactactggagagtccaggattgattaagtgtctggctgagagaccaagaggaccagacacatgggaagtgctgtttctcgaagctctgccttcaggcagacaaggaaagacctggtcgttcaaagatgtataaaagccctcccttgcccatccaagcctgatgcttacatgcaacttttaattgaccatcccttggtcctgagcacaaagttctctgtaagagcagctctataaggacatagtgagaaaggtcagctccctgggacgagcatcggtattccatgagaacaccaggtctgttaaaggttacccgtctgcctggtgtgactggctggagaaataaggtagggagaatctagatatggttgaattgtcattgctgctcaaaatttgtttctttgtaacaacaacaacaacaacaacaacaacaacaacaacaacaacaacaggtgaaattatcttgaaatacaaaagaacgtctgttggtcctgagagtgaaaaaaggaatccttaacagcttcagcttgcaccaagaggatttttttttatcagcttcccttcataagagaggatggaggattttggaagagacagaacctgggagaaattcagtgagctgccacttactgttaactactccacagaagaactatatgtttattggaattcagtaaatgtggcatgtaaggatttagtcaatgtctggcaaaatgctgccacttaggacccatttggctaatactagaagtagtcatcaagttaactgtaactgcccaacattttcttagaagccaaagaacttaaacttttatagaagaacgcccagtcagtactatattaatgtgtgtattacatttattgactgttgaacagagcctgattcccaagagtctttaaggccataataaatgcaaaaattgtaactaaatttcctttgtactcttcagtctttcttgtaacctcaatgaaactgaaagtactattttaaaagtacaatgactacgacaaaattccatttaaaaatctttaaagtgttgggttctgaggcttttgaacttgaatatttacactgaccccaataaattctcctctaaccaagttctcatgtcagccaagggggattatgctggatagtaaggatgtctacaagtaaatccacttgcaaaactataaaaggagcttcaggggcatttaatggtctggaagatctagaaagatccaaggagggtagggagtaatattcatccaccacagccacctcacccacattccagagttgctgaaattattacacacatgtaaacataaggacaagacaaagttttttcaagaaattagaaaggaatgaccgggcgcggtggtggctcacgcctataatcccatcactttgggaggccgaggcaggcagatcacaaggtcaggagatcgagaccaccctggctaacacggtgaaaccctgtctctactaaaaatacaaaaaattagctgggcgtggtggcgggtgcctgtagtccccagctactcaggaggctgaggcaggagaatggtgtgaacgtgggaggcagagctggcagtgaaccaagatcgcaccactgcactctagcctgggcgacagagcgagagactgtctcaaaaaaaaaaaaaaaaaagaaaagaaaagaaattagaaaggaacatggcttaaccatgtctatttagacataagttaatatataggacaaagttacctatcccttctcattgacttaataacaaaactctcaaaatgggcttttattggatattattgtgattaaaactttccaatttctccttcactattatagcaagctataggagatgtcttgttttccagctccatatctgctgaatagactaaccaaacagaagccttcagtctctgtaagccattcttgctcaagaaagtagtcctgagaacagtctagaagaaaccaatcctgaaacaaagaaaacttttccactaaactctcctgacattcatacattttgcaagggagaacgcatttaattaagctgctattgtcattgcaacaagtcttaactgtaccatggagatatgttttggttatacattgaaataatagcatgtttaattaaggtattacagaatgtttctgtttcactatattcatagcaaaaatttttcaatgtatcagtgacagttgagattaaagaaaaaatcaaccctgaatatagctaacatattgggatgaaaatttccctctagctgcctttccctctgaagcatctacatattttccttgttaataagcaatgctttcacataaattatttaattatatggctttgtcatgctgctgacataaaacatatctgcaaaagcaaggactggattcctaaatgtctgtaggaagatttagtgaagattcagtgctcatcactgtggagttcccactggctgataaaaacctgcaagaaacctgtataataaagacaggcgtgcatccctagaagcacagggtgatggctccaaaatctttccttctagtttggaaggagcaaggtgtctcccgtcttccccagcacagctgtgccaattgtcaagtgtgtcactgactatgcaaaagctgcagggtagatctgcaggtgaggaggtacaaggcagaaaagccagaaccggggagtgtccaggggcacctgcagccctgtgattctatgttacttgccagtgatgtgcctcctggtggatgtgatactaatgttcctggttgaaatactgcagggaaacaaagggcctcctctgtggtgctatatggaatttggctttttcttggacctttcaagatggatgttttctggttttagaactctgtcttgatgcacagaaagcaaagcattcagtgggcaatgggaggcagagatgaagaatgcaacggttggaaataaaagcctttgccaggatgtgctgggaattttttgctgttaaacacatctgagtgataatttcaatgtctgtcataaaacctaggatatttaatgatgaatgcatgtataactgacacactcgatgctgtaaatgatgtccctcaatttgaatgtttctaaacataaaccacttcatatggtcaggaacatcaccaaaacctgtcattgaaaccaaccctgatgaggggtactcatggcagaagaataagttgttaacatttctggaggtatcatacccatggtcatacatgtgttttctttctagctatccttggttttgcatctttcttgagccttatttttttaaaaaaaccatttctatgttcaaagcagtaatacatactcaatggcttagaaagagaaggattatcatgaccaccactaaattactgtttaaagactcaaaactacactgtctaaaatctatcttcaagtattcttttgtgactttgagtacaacagtagtaccttattgcacattgattcccaagaaaccctttttaagagtgtggaatgactggacttggtgcagggcagtgcaccgcctggaagccgggaagaaccaccttgcccttgcgatgcaaatccccctgcgtgcccatgttcaggcgctgcaccaggagcttctcatagagtagtgggtggtacgccccgagggtgcaggctgcgtcgtagtacagctcgtggtagtggcacagctccgtctgccgcacggatgggatatattcatacacgtgcacctctctgcacatggacatcattatgaggattcctgacatgaaaaccaaaaattagaacctaatgaacaactccatgtgagagggatgagttttttgggggaggggtggtggtgatgggatatgactgtggcaagagacacttacttttttgttgttgttgcatttgcaatgttataacttccattaagtggtgtgtatgcagttcatggagtatgggggcatattaaaatgtaacactatatatatatatatctattcgctcatttaatttatcactgtgggcctggtaaggagagatgaaaagaagtcagtgaacttgagggaaccacacgctagtgaaggacagatttgcaaccccccaaatcagagtttcctgtatcacattctatacacatgtcccatctggtttgcaatgatgggacagttatgttccaaagaaacaaatgccataaaaactaaattataaaatagttgcttgattataaattgactataatacagttgtttgaaaacttgtaacataaaactgtacaatggatcagctcttatactatagttgtctgaatggaaagaaatggagttaaagcgacagagtttaagattcatattaacaaaattatttttctcactgaactatcagtgttaaacttttaattttttaatgtttcaaataatcagctataacagctaatcatcactgagtacattttattctttttttttttttttgagacggagtctcactgtgttgctcaagctggagtgcagtggcgcgatctcactgcaagctcccccttccccgattcacgccattctcctgcctcagcctcccaagtagccgggactacaggcgcccaccaccacgcccggctaatattttgtatttttagtagagacagggtttcattgtgttagccaggatggtctcaatctcctgacctcctgctccccccacctcggcctctcaaagtgctgggattacaggcatgagccaccgcgccaggcctgagtacattttattctttatctagactaatggctttctttcttttctcaacaccaccatgccactattaacttgaaagttaaaaaaaaagacatctcttttctgaaagggatgtcccttgttataaaaaacataaagcagcacagttattcttgttatagccaatatttatctgaagatgacagtaatattccctaattaaccaaccatgtgtgcaacacaaaaatcccataccagaggagtcctgtataagggacactgggagagaagagagaaagggcctaattttgctgaggggttccagaaaggctgcccaaaggtggagaagtgtgaagctcaaggggctgcctggtggacaaggggtagaaggaaacaggagaggggatactgctccagagtcagcaaggatagcttgtgtagtagatgtcagagtcatgatatggtatcatagttgagagtaaaacacactcctaacaaagacaaggggattatgcacttcaaattctatgcagtcaagttgctctcaagagcgatggtcagaacctcaagttactgggtcaattcctcttgtttttctcccaggtccctctaccagtttccttccttcttccatggctgcctggctgctgcccctcccttagatcagcctaaagcactgtgattcaggcattcgggtggcaccaattgaggaaaaggaagcagtaccccccagatgctcgaaatgtctgcacccatggagaaacatgagtgcagtggtcaaaagtctgcctcctgattagtaatgactgctctcaaacattttttctcccctgtataaaatcatatacaaggaattcacatggtgaatgacatctgcccatggagaattaaattcttttatttccagtcacttgccgacatggtgaaatcccatctctactaaaaatacaaaaaactagctgggcatggtggcatgtgcctgtaatcttagctacttgagagactgaggcaggagaatcacttgagcctgggagttggaggatgcagtgagccaagattgcaccactggactccagcctgggcaacagagcaagactctgtctcaaaacaaaacaaaacaacccacaaaaaaaccttaaacaaacaagaagtgctctggtgtgaatgttctctggtggctgaagttttcccagagcctgtgtctgtggagctgaggacggcttcatgttttctaatcaggggctacagaccaagttgctgtgcactgcccagcattgggggctccccatctcctgggcatgacatctgctctgccagctctgcacaaggaatcacgctgaagggggtggacttcatcacgggcatcattaatcaatatatttattacaacactttgcttgcacatggcaggggggtggcttcaagagtgtcttttacacaaagtcactgtataacctagcagtggaactgtacccagaaaccacagttctttgctacttgggcatttctatgagctaataacacaatggcgtccgtaaggactggagtcagttgtgttggagttgtgacctttgcaactctggttcttaaactggatggttttcaaaagccaatcttatacttaggggagtatgttagctgtgcagttggtcctccccataaagcagtagtcctcaaagttcagcatggaaaagaatgacacaggcagcttgatcaaatgcaggttcctgggacttgtcttcatttccagaaattcaggttctattggtttgtgctggggtccaggaatctgaacttttaacaagcgttccctttaggtgaaaggccagttagagaaaagttccaacctatcacagaccaatgcttttgtaaaataccataatgaggaactacgagaaaaatgatcaactatttggatgccatggctatgtgaaattgctataaggtgtctaaatccttccattttctacacgaatctagttgtagaccagtaacacacgttcctggaccagtgctggtctactctccatgctttaaggaccaggttgttttaacacacatattttttgaaaactgctgaggaatccctaagttctctcataggtagcaagacattctgcatgttgacagctgatctagatttgaactgctaccaaatccaagtaactctggggagcttccctatacatccttgctatcctcttagactcaaagagctatcagatgcttgaatctgattgtttttccagagaaaaattttatccttgctgctagttaaccgttaaatcgtgttatctgctaaatatacaatatagattttgtcatagactatgcaaatagttatgctttcaatatatgtaaataggcacacttttagtattttcttatataagtactctatatttaaaaagaacttcttcagcttcagaaatagagggatttgtcagttagctcatggcagtccaaattgaaagccaatagatcctatgaaagtgggtgtttgtcctgagttttctgcacagttcttcctgatctttgcctatcagatagagatttagcaacaatgatttctccatcttgttttgtagtctcatgaattggtggcttcctgaaactatgaaccatggcttggagcatcctaaaattaaacagtagaatctaccctgagtgtttaggcggcagccagctgcagccactgatacggaattggtatggaggcatcttccaaaaaaaaggaaaaaaataatttaaaactcactgtggagtagggcgtgcagtggctcacgcctggaatcccagtactttgggaggtcaaggcaggtggatcactcaaacccaggagtttgacaccagcctggacaacatggtgaaaccccgtctctacaaaaatatacaaaatatcagccaggcatggtggctcgtgcctgtggtcgcagctactcaagaggctgaggtggcaggatcaccttagcccagaggttgaggctgcagtgagccatgattgtgccactgcactctcatgctcactgagcgacagagtggcatcctgtcaaaataaataaataaataataaaactagtaataataaaactgtgtaatgtgaaaggcagacaaggaggtttatggtgccaaagacgtagaatattctttaacattttaactttttttttcaggcagcatgatcaattcatttagcatatgcatacttagtcttttaattttctttaaggctgttgttatacataaatttgagtttagattcagactctgtcatataataaatagtgaaaattattagtattaaatttgattccatctacatatcaattttcctaagagttaataatagtacttagcaatacacaaacacctgaagaataaatttcttcatactttgcaaaagagaactaggtagatgtcaatgtttggacatacataacaatagctcttacatggttcagaatggggtaggtggggagtagatactgcaggcagacaggacggggacaggattagggaagaatagagtctttaagtgctgtttgaggcctcctcaattaaattcaacatctatcaagctgaccacggtactaatcattggcaatttagagcacctttctttaaaaaggtaaagatattaaataaaactaaagatttcacctttaaatttaaagacagtagaaggcccatgaccattcttaggatggcttgaagaaagtatcctaaacgtcatactgagaaaaatgtttatgaactaccaccagatctcttctgcaatgccccaatgctgagccttgtcattcacaaatgactaccaacagcacacagctctcaaatgaactctgagtcaccaccattaaggtcctgtgtcagttcccaacacacccctaggttcaatgattcaataggaagacccagaatctagcatagggttttactcacgatgatgatttatacaaaatgatacgaagcaaaatcaccacaaggaagaagtgtacagggtaaaaagtccaggggaaccaggtgcgagcttcaagaatccactcccagggagtggcacagggactgaattcccccagcaatgagttgtgaccactgctacgaactgaatgtgtctccatccccactcacaggttgagatccttcctaatccttaatgtgatggtattaggaagtgaggccttgggaagtgattaggtcacgtgagtggagccctcatgaatgggattagcgcctttgtaagaagagatgttgtggagatgatttctctctgcaataacaccatgtgtggaaccagcaagaaggctccgtctctgaatcaggaagagaggccaaactgaccagcgcctgctctctaacgtctcacctccagaaccatgagagagaaatttctgttgtttaacacatccagtctatggtatttcttatagcagccagaaataatggagacaacaacacaaatgaaattttgccaaccagggaagcttttgagagactcagtactcagtgtttctatttgaaactggtcatgtcagcagtctctgcctggcatgtactaaaattccagactctcggaaggaaagcaagtatccagcataaaccacatttcttgcataaacagcacacacatagtgaaccacgcttatcagttagaggggtgggaaccttcccaaaaaatccaagttcccagacatcagccaagggccagtcttataagcaggccttcctgaggataagcagtcaagctggcggtgttgtcttttctgcccggataccatatatgcacaaattcaaagtatcacattactttgtaatcatttccccatgccagactgatgtggggaatttacatctggttatgctaaaaatgttattgattctttttttatttcctctcttatgtctgctcaggactacataaaatgcaagaagaatacaaatcatctaataacatgcaattcagtaaaggacagcttttaaaaagcatttaagaaacttttatgttaagtaattttgtttaagaactacaaaaaattaacaactttatcactaatgaaagttttactgctttcaacatgaggctggactttttgataggcagatcaagatttagacacgttttaatgtattttttcaagccaatcaaatgggtatggggccagctgttttgaatctttaaacagtatgaatgttaagtttcttatatggccagttttttttttttttttgagatggagtctcactctgtcgtccaggctggagtgcagtcgcgtgatctcggctcactgcaagctctgatatggccaatttttacaaatgagcctatatgagggattcatttgaagaaaataagtattagtattttctaggcaattgtgactcaagaggcattcatttgctgaactgtatgcttttaaacatcatataacgcaagataattatcaaaccatttaaaaagcatttctactggttttgataaaatgtcatgttatatgattcagcataataagcagaatgggcacttatttatttgctccaaaacctgaataaaaggcaaactttaacacatgttcagattatcacaaattctagatgactgaggtttcctttatacatctttaattggcatatatagatatatttgatgtgttatcagagtctagtataatcatttagcatttagcttaattgtggttatgccaaaactatcttgttttccacttggcagaatatttaaaataacatcccaaatcattgagaaaaacaaaattttctccttgatgaaaatagcctttcattaaatagcaaaatgagctctggatataaaacagaacataatacaagtaacaggaaaactaccagtttaaatcaattctaataaacacttgaacataactcacacatgaagtaaattagcagtttctaagagtcaccaatagaacactgcagaacacttttccgaatgaggggtgagggtgaaaggctaagtgtattaaatatgccagactaacagaactctaggagctgttttgtggtttctccttaaattcaatcataaaatggaaaataatgacagctacacttgagattcttaaagagataaaagtgactttttaagtggtagttctagaaaatatttgtaactaaaagatggtttggaaatttgaacctgatgtaatttaagaagactctaccaccctaaacaaaatagtataatgcaagaataatactggaaggtcaatttttagctcatttacactgcattatttgttgttatcacacactcaggattcattatttacaggaaaatacaaaaagttgttcctaaccaacaaaactgtgacacatttgacacgatcctaaatatagatgttaagtagcttattattttgtgttaatgttctgagtttgggtgacacattaaaaaatgagattccaaaagccaatataaaatggaaaagaaagaagttatgatgtgtttttaagcctattattcttgtgcatctataaattggcctgaaattacagtgtttgcacctgtaagcttcagaaatattagttacaatattacgagtagtgtttgcgttcaaaaaaaaaaaaaaggcaaggtgggggtgttgctggcttctgcaataaaaagaattggcaattgtaccttaaaaaggagttccacgtctatgtgtatgttgggcagaggccctggctacaaggcctgtctgcctgttaacactcaggctgggagccggggtgggtgaggctggtgcctgctggtgtgcctggatgccctactgcatgcaggtggcaaacccatccagctgtgcatgaagaccccaggtgagatcactcacctataaaaatatgtcattacgtgggcaaaatagaagctacaggactccaagtaaattattccttatcctcagtcaggcacagtcaaaatgacttcattgcactgaataacaagataaaatctctagtatctgactagggatgaaagagagaaatgctcttcatatgtgaacaagtagctcccaatgggctgagtgtaaggaagctaatgagatggagaagttgttccaaagaaacgagtccttatggatcatctaaattaccctgattcatgttacatctttttagttttaaaaatacatgtgcagtccaataataggtgtatgaattcctttattgcttctctagagaaggagatagtacatgtaacacaatccaatatatctactagtgtactttcttctgtgaacccagaggacaaatatggagtctaattagaaactcaactacataattcttgggaaagcaatatgtcagctcttatcaataatcaccagaatgccataccctttgcactggcactaatactcctgggaatttatcttaaggaaatagtttaaagaaaagtctatatagtcacttactgcacataatttgtatgagtacatacatagagtaatgacttgtcaacataattgtttgataatatcaagcactctgaaacaaccagaatatcaacaactaaacaaaggcatatattatgatacacctgtttgatgtaattatatgatctctgtaatagcaaggaaaacaaaagtctattttcaccttgattataggtcttaatgaaagaacagtccttttctgtttgggaaagagtcttatttgacctattatacattttcagatgacacgcattacaataacagcaaatagtaaacattagttattgtgtttaggcacatgataattcaaagctaaaggtactatcagtatcttcattttacagatgaaggaactggggtttggagatgctaagtaacttgttcaaggtcatatagctactcagtggtagggccaagacttgattctggtctctgtagaatctaaggtcttagccacagtgcacacataaagtgacaggccaggagggtggccacccttctacatatgagaccagttaaatcaaaggtgagagtctataagatgacatcaatcacagcctcccattcattcatttgttttttcaatcagggaacaccatgcactgtgctgtgctgcttcacagtgagggagccttgttcattacaacaacgttaaaatctggatgtgctcaagatttggaagggtatacactaaaataaagtcaggatggcagtaccagaaaaggaggtggagttatttggtgtttttaaaattgtataaacatttagttatattactattttgcttctttttataaggactgcaaagttctaggagattatcccaaaagttgcaaagaaaaactaataaagtaaggcagagtcattctcttccttaaggtttggtgaaagctttggacacatacttatgtgaggataaatagtaattctaaacctcctcagccttacatacgttaataaaatgggatttgttaaaaagctagtcaggtttttactgaattccaagaaataatcttgatactaaaagtcaaaacatatttgcaaagttatggtttaagtgttttgaaaaataattatcaataattgatatgcaactttgactcaggtttccatgattaattgcagtaaatagtcaactctaataatgattcttcagaatattttgtgaggtggagttgctcagtaataacaaaaacctgatgttaaaaacacagaaaacaagatttaaaaatattaatttagaaatttgagagggctaacttcagtacacattagttttaaaaccttaataaggatatagggaggcagagcaagatggccgaatagaagcctccaccaattaattgtcctgccagcaggaacaccaaagtcaacaactatccacacaaaaaaagcatcttcgtaagaaccaaaaaccaggcgagtgatcacagtacctggttttaattttctatcactgaaaggagcactgaagagagtcggaaactcagtcttaccttgccaacaccgtgcctcctccatcccccagcagggaggagaatctgtgcacttgtggggagggaaagtgcagtgactgggagactttgcaatggaactcggggctgccctgttacagcagaaagcaacaccgggcagaactcagccagaacctatggaaggagcatttagaccagccctggccaaaggcaaatcatccatcccagtggtcacaacctgagttctggcaagcctcgccaccaggggctaaagtgctcctgtgtcctaaataaacatcaacggcagtctaggccacaaggacttccattcctgggcatgtcctagtgctgtgctgggctcagagccagtggacttggaggcatgtgacctggcgagacacaagctagggcagccaagggagtgcttgcaccactcttcccccaactccaggcagcacaggctgcacctctggaagagactccttccttccttatcaggagaggagagagaagagtaaagagaactttgtcttgcaacttggataccagctcagccacagtaggatagggcaccagatagagtcctgaggcccccattccaggccctagctcctggctgacatttctagacacatctgagccagaagggaacctgcttcatggagagaaggactcagtcctggcaggatccatcatctgctgactaaagagctgctgggtcttgaataattagcagtggtactcaggcagtactcactgtgggccttgggtgagactcagagccatgttggcttcaggtgacactcagcattttcccagtggtggtggctacagggagggactcccgcttgaaaaaaggaaaaggaggagtaaagggcactttgtcttgcagcaaaggtaccagcttgggcaaagtgggttagagcaccaagcaggctcctggggtgccagattccaggcgttggctctcacacagcacttcttgacctgccctgggccagaggggagccccctgccttgaaaggagaatcccaggtctggtagcatttaccataagctgactgaagagtccttgggccttaaatgtacattggtggaagccaggcaatactcactgtgagcctgggctagtagtggccatgggagacacccctctgctgtgaaaaggggaaagaacagtggggaggactctgtcttgtgccttgggtgccaggtcagctgcactaaatacaataccaggtagaatcctaagtttccgactctaggccctggctcccagatggcatctcaagacccacctggggccagggggaactcactagcctgaagggaaggacacaagctggctggcttcatcatttgctgattgtagagccctaggacattgagtgaacataggcagtagccaggcagtggttaccatggtccttaggtgagagccagtgctatgctggcttcaaaacttatccagtacagtcccagtgatggtggtcacagaggtgcttttgtccccccttccccactctaggcagctcagcacagagggaaagactctgtttgtttgagagaaagtgagggaagagaacaagtctctgactggcaatccagagaattcatctggatcttatccaagaccaccaaggcagtacctctacaagtctgcaagggccacagtgttactgggcttggggtgccccttaatgcagatacagctgaagtgaccaaaaacttagatcataataccatactcaactcctttcaaaaacctagaaagccttctcaaaaaggttagatacaaacaagcccagactgtgaagactacaataatacctaacacttgaatgcccagacaccagaaaacatccacaagcctcaaaaccatccaggaaaatgacctcatcaaacaaattaaatagggcatcagtgaccaatcccacagagacagagatatgtgacctttgaacagaaaattcaaaatagctgttttgaagaaactcagtgaaattcaagataacagaaagaagaaattcagaatcctatcagataaatttaacaaagagattgaaataatcaaatacaatcaggcagaaattccagagttgaaaaatgcaattgacataccaaggaatgcatcagggtctcttaatagcaaaattattcaagcagaagaaagaattcgtgagcttgaagacaagctatttgaaaatatatagtcagaagggacaaaagtaaaaagaataagaaagaataaagtacacctgcaggatctagaaaatagcctcaaaaggacaaacctaagagctatttgtcttaaagaggaggtagagcaagatataggggtagaaggtttattcaaagggataataacagaaaacttccaaaacctagagaaatataccaatattcaagtacaagattatagaacaccaagcagatttaacttgaaaaagaatacctcaagaaatttaataaccaaactaccaaaggtcaaggataaagaaaggatcctaaaagcagcaagagaaaaaaaaaacaaatattaataacatacaatggagctccaatatgtttggtagcagacttctcagtggaaaccttacaggccaggagagagtggcatgacatatttaaagtgcagaaggaaaaacaaatacacttttatcctagaatagtatatccagcaaaaatatccttcaaacataaaggagaaatgaagactttccaagacacacaaaaactgagcgatttcaacaaaactagatatatccaacaagaaatgataaagggaattcttcaatctgaaagaaaagaatgttaatgagcaataagaaatctgaaggtacaaaaggtactcactatattaagtacatagaatattataataattatagcctgtaaactattcatatcttgagtagaaagactgaaaaatgatcaaacataataactataacaacttttcaagatacagacattaaaaaaagatataaagagaaacaacaaaaacttaaaaagtgggaggacgacacaaatgtagaatttttattggttttctctttatttatgcaattggtttaaaataatgaattgaagatattatttgccaacctcatggtaacctcaaattgaaaaacacacaacaggtacacaaaaagtaaaaagcaagaaattaaaataccaccagagaaaatcactttcactaaaaggaagacaagaaggaaggaaagaagaaagaggagactgcaaaagaatcagaaaacaacaaaatggcaggagtaagtccttacttatcaatagtaacactgaatgtaaatggcctgaactctccagtcaaaagacacagagtggctgaatggataacaaaacaagacccaatgatctattgcctacaagaaacacacttcaccaataaagagacacatagactgaaaataaggagatagaaaaagacattccatgctaatggaacccacctcccaactaaaagcaggggtagctacacttgtatcagataaaatagacttccagccaaaaacctataaaaaaaagacaaagtaggtcattatataatgataaaggggtcaatttagcaagaagatatagcaattgtaaatatattttggacccaacactggagaactcagatccataaagcaaatattactagagctaaagagagagctagaccccaaaataataaaggctggagactttaacaccccactttcagcattggacaggtcatacagacagaaaatcaacaaagaaacattagacttaatctgtatcacagaccaaatggacctataattatttacaaaacatttcatccaatggctgcagaatacacattcttttcctcagcacctgggtaattctcaagggtagaccatatgttaggccacaaaacaagtcttaaaaaatttgaaaaaactgaaattgtatcaagtgtattctctgactaccatggaataaaactagaattaacaagaggaattttggaattaaaaagatgaattttggaaactatataaacacatgaaaataaaatggtatgttcctgaatgaccagtggtccagtgaaaaaatttagaaaaaaaatttaaaagttccttgaaacaaatgatagtgaaaacacaacataccaaaacctatgagataaagcaaaagtagtaccaagaggaaagtttatagctataagcatctacataaaaaagtagaacaacttcaagtaaacaaccaaatgatgtatctttaaaaagcagaaaagcaagagcaaaccaaaaccaaaattagtagaaacaatagagatcaagcaaaataaatgaaattgaaatgaagaaaatgatacaaaggtcaatggaacataaagttggctttttgaaaagataaacaaaattgaaaaatatttagccagataaagataaaaagaaagaagacccagataaataaagttagagatgaaaaaggagacataatacaactgatgtcacaaaaatccaaagggtcattagaggctactatgagcaactataatagtatatattaaattgtatatatattaatagtatataataaattggaaaacctagaaaaaattaatacattcctagacacatacaatctagtaagattgagttataaagaaatccaaaacctgaacagaccagtaacaattaatgagatcaaaactgtaataaagtttcccagcaaagaaaagtccaggattcaatggctttactgctgaattttaccaaacatttaaagaagaactaataccaatcttactcaaaccattctgaaaaataaaggaggagggaatacttccaacctcattctacaagccgtcctgataccaaaaccagacaaagacacatcaaaaaagaaaactatgggccaatatctttgatgaatattgattttaaaaaatcctcaataaaatactagtaaattgaattcaacgacacattaaaaaaccattcatcacaaccaagtgggatttatccctgggatgcaacgatggttcaacatatgcaaatcaatcaatgtgatacattaacaaaatgaaggacaaaaaacatataatcatttcaaccgatgctgaaaaagcatttgaaaaaattcaacatcatttcatgataaaaaccttcaaaatagtgggaataaaaggaacataattcaacacaataaaagccatatatgacagacccatagctagtttcatactgaatggagaaaaattgaaaacttttcctctaagatctggaatatggcaaggatgcccactttcatcactgttattcaacatagcactgaaagtcctagctagagcaatcagagaagagaaagaagtaaagggcatctaaattcgaatggaagcagtcaaatgatccttgtttgcagacaacatgatcttatatttgaaaaaacctaaagactccgccaaaaaactattagaactgataaacattcagtaaagttgcaggatacaaaatcaacatacaaaaatcagtagcatttctatatgccaacaatgaacaatctgaaaaagaaatcaagaaggtaatcccatttacaataactacaaataaaatacatgggaattaaccaaagaagtgaaagatctcgataatgaaaattataaaacatccatgaaagaagttgaagaggccacaaaaatatggaaatatattccatgttcatggattggaagaatcaatactgttcaaatgtccatactactcaaagcaatccacagattaaatacaatccctatcaaaataccaatgacattcttcacagaaacagaaaaaaaatcttaaaatttatatgtaatcacaaaagacccattcaatagaatgacccagagtagccaaaactatcctgagtgaaaagaacaaaactggggaaatcacatgacctgacttcaaattatactaggttggtacaaaagtaattgtggtttttgccatttttgccatgcagtttctccattaataagaatcttattaatattgaagtaagcttgtaatgaaagcatagtttaatttcatattaaaatgtatttatattatgtcaataatgtaattgttcgcatgttttagaattcatttattgtaaggaaaacagaatcattgttatctttgataaactttctatgtacgtaaattgcaaacttctgaaatcaggtgtttttccaacaataaaatacttttggtgaagaggttcttagagtttgctttcttcaatgctaggtcaatgtgttcttcaaattttgaaacttattgttctttctcttgaagtggaaaaggaagccctgttattttcagataaaacaggaagaatttatttggttgcaaactaagtatttctgtccaaatctgattttactaggaaatctgattttcttctccataggaaataatgcacagatcttacagcaccaaagaaaaagctcagccgtgcctatggggtactagatcaatgacaattctgatgtcacaatatctccaggcctactaaccaagaaacattcagactggtgcactgaacagaagttgtttctatactccttttccctttaacatttattgctttccttttcccagcagaaaacacacacacacacacacacacacacacacacacacacacacacagagagagagagagagagatcgagagagagagagagagaaagatttcctaatccaataaggcaagaacacacgatgtatgagccatcaaagagactactggtactgggctaggggttgctaatgaaagtgcaaaaagtatgttatgctttttgagaggaaggtgttggctgaatgtcttattccatttgggctgctgttccaaaatgcaataaactgggtggcttataaatgacaagaatttatttctcatagttttaggggcctgaaattccaagaacaatatgcagcagattcaatgtctcgtgaggacccacttactggttcattgatggccatctttctgctgtgtcttcacacagtggaagaggcaaatgagctgtctggggtctcttttataagggcactaatcctgtccatgagggcagctccaccttcatgacctaatcacctcccaatggtcccacctcctaataacatcaccttgagggttagaatttcaacatacaaattttacagggagaaacattcaagtcgaccacaccaaattgcatctgcccaaatgttagtgagagaatgccttcctgcaatcaatgacagttggaactttgcttgctttttgcaaacttataccccactaatcagtatattcaagaatctgggtccccacttgataggaacaaacacaaatgcacttttaagaaaaggatttacagttcacattgtaatgtatgtcatttcacaagaagttttaaggacaaaaactgagttcattagtaaagcaagtaaattttatagttatgtcttccaaagaaacaaaaagaataattgtatttgtagttaaaacatccaataatgctggaataggccaggcaaggtgactcatgcctgtaatcccagcactttgggaggccaaggtaggctgttcaggaggtcaggagatcgagaccatcctggctaacatggtgaaaccccgtctctactaagaatacaaaaaattagctgggcacggtggcacgcgcctgtagtcccagccactcgggggactgaggcaggagaattgcttgaacccaggaggcagaggttgcagtgagccgagaaggctccactgcactccagcctggatgacagagtgagagtccgtctcaaaacaaacaaacaaacagaaacatccaatactgctggaatataggatttaatgttacggaatttcaaaagatgaaaatatacaaaaatgttatatttttagtaatacattacattgttttaactaaatacaaataaaaataattatcccacttgggattaaagattgcaataagtacatgattagtagttattcaagattcctgtgtcctctactgagccaaatgcatatcaccttgctggtacctccatcagtacggagcctgtggactagacttctaaagttcttaagattccaaaaagctgaaagaatggttctcaaagcgtggccccaggaccaacagtgtcagtatcacttgagaacttgttccaaatgcaaattctcacaacctccggcaactcaaaaacactaggggtgggcccggtaatctggtttacaaaactgtgacagccaccctccaaactgactccataatgattcgtgcctgctattcatgcctttgtatagtttcctcccataacaatggtgctgacttgtgtataacaaagataatgtagcagatgtgttagcttatgacatcataaaaacattgggccttcctccttgctctttctcagatcccccgttctctggaagccagctgccatgttgtgaggatgcccaagcagtgctatggagagaggttcatgcagtaaggtctcttgtgctcagctatgcaagtgagtcatcttggaaacacattatccagcctgaatccagacagtttcattgtaaccttatgagacactgtgagccagaatcatccaaccaatcttctcccagattactgacccatggaaattgtgtgagagaataaatgcttattaatctttttagtatctaacttttgctttgcagcaatggtttactagcatacaaaccttttgtttgactctgacacatgctaaattttgaaaaacattgagctaaaacattcattcattcaccaagtaattattatttgtatctgctatgtaccaggctaacagcagaaatacaatgatgagcagaacagacactgaccattccttgatgcatccttttcttttccttcgttggacttatcatactttataatgattttatttatgtctgtcctgcaaattttgggtgggcaggacccttgtctggtttcttcaccaccaggtttctggggtccagtcctgtgtctggcacacaggaagtgtgcaattaatatccacatgacagtgacccttaccttcctttttcaccacctttcgcctatatgaaggattcaggcgccagtaacaaggccttgaattgcactaatagcactacatttaaggggctcagtaacttctccctgggaatctaactgccgctggataatctccatacaaagaaatgtctttcgtgttcaaaagagtcaacttttagagtctctctatttcaaacatgcagattcctaagcatgtataaagaaaatgtatgcagtggatgtgttagcctgttaaatgtatgcagtggatgtgttagtctgttcttgcactgctataataaaatacctgagactgcgtaaattataaaggaaagagatttaattggctcatagttctgcaagctgtacaggaagcacagtgctggcatctgcttctgaagaggcctcaggaagcttttactcatggtggaaggcaaagtcagagttggcacttcacatgttgaaagcaggggcaagagacagagtgggcgggaggtggtgccacatgctctcaaataaccaaatctgtagtcccagctacttgggaggctgaggcaggagaattgcttgaacctgggaggcagaggttgcagtgagctgagatcgtgccactgcactccagcctgagtaacacagcgagactccgtctcaaaaaaaaaaaaaaaaaaatcagaaaacaaccaaatctcacaagaactcactatcatgaagatagccccaagccatgaaggatctgtccccatgatccaaacacctcccaccaggcccaggtgaattgggaattacaattcaacatgagatctaggtggggacaaatatccaaactatgtcagagggtttagaaatataagtaatggcatgggagactataaggatgaacatatcagtaaaggtttcagccaaaaatattggaaaacaaaagcactatgaagccaaccatgtgtgcagctatgtgtatatacatgtatctaatgagcatatcagtataggaagtggggcacactgtttcacctccagtgcagccctttgtggatcagaacaatcggaggccagggacactgccagggtgatcttttgcgatggtgaccgtcctgctgaccggtgtacccagagctgaagatgggactgtgcaaactgaaatgatctaatcccttctaacagctcttcgatgagttctttcattcaggagctgacgttagaggttagagcacttggaaacaatgaggtgctgagacaacaagtcaataccttcttaacatgacctcagagcatgaagggggcatttggagaacactttttgatagcagaaaaaaaaccagtcattgatttttaaaattcttacagcagacagattgagatatgggtgacatcattttactgctatttaaggatgttggataagttataaaacagattctggctctcagcctatttatgatcaagatcaaagaagaggggcaaagactactgcagtctcgtgagtcatcagaaggtgctggagtttttctgagcagaactcatccaagctgtctccactgcccatccttggtgagggttctcacatgcttcaccatgacaaggcacaagggccacaaataaatttaacaacgccagaccacatcttctgttgcctcttctatcctcgcccacccccaacccttacccacagagcacagcctgcccagtgggaactgagggatttcttatcaacttgctgtttttctttcttttgtgactagcaaaacataacagtgctgtctacataacgttctgggacaatggaattgttctctctctgcactgtccaatatggcagccatcaggagcacacggtgactcagaatttgagattgggctagtgagattgagaaacaaaaggtttcctcttattcagtttgacataattgaaacataagtagccatattggtcagtacagtgttagaaaataataatgcttattagtatttccatttctcatctgtggatattcagggtcagaggattaactaacttgcccaaggtcagaaagctaggaaacagcagaggggaattcaaactcaacccaccctgcacaacctcaacttcttgcatcaaactgcagccccttcttcaggtcaaagaaggcttaaagataatcttcagcttctgaaactttaaattctcagtaaatagctttaaaaggaagctggctatatatggcatgatttcttttaacaaaaacaacataggaaagtactttttttcagttatgactatctaacttgaattttttaaaccccatgttgataataagtgtatctgacaggcccctctaactgtgctttaaaacttttgctctaatcaaatattagccacatgaattcatgagagggtgacaatatgaaaaagactttattaaacttctgtcacatcctattatgctgtctaggcattattctatcctgtttatcctttgctgacaaactagattatactttctttcctaaatcaacaagatcctatgaaaccacacaaaagataaagaacttaggatttcaaaagagtgatttggaaacaaagagtgtcaaaggcatgagtttaaaagggagaaaaaaagctgagcttaaggaaaataatatgcagtcatattgtaaattttgtttttaaattatatgtaaaatatttcacattattacaataccaaaacccactctaaaatctgcaagcttcaattcaggatacctgtgtgtcctgaattcataaccaaaccaatgttatctccacaaatctttcctttattcatggggaactactgtgcagcccaagaaaggaaaaggggtgtaaattcattaaaactggggaagagaacattacagttctttaaagacaaaaccaatatcctttggttcttgtataggttttaatattgccaaaagggtctaggatattccttaatattacccactcgggtaatatcaaagaaacaatggggtgataagctaaaacacagataaagaaatggggtaaaacccaaaaactctgaggatcaaagctagactggaaaacaatgtaggcccagtgtgatgctcttgttatataaaacccatctgtagatgaaagatggcatactcttcggttaagagagctaaatgaggtactggaactagtctcatcaaagcccgcacctactcataatcttgaaacacaacacactatcctgtggtcacagattcagctccacaaccaagcatggcataagctatgtgaacaggcatgggtggtggattcacgatgctgcacattcctggacatgcctccctcacttccctcaagaggcgggggtctatgttttgtcccctggaatcaagtgagccctgcagtaactctggccaatagaattgcacatgtgatgctgtaccagttactaggtgttggccttaagaaactggcagtggcagagaagaattcaaattcttgattttctgtgttttcagacattctccctaggatccataagctgccatttaagaagtctaattactttgagaccaccatgcaagaaagactatgtgcaggcacatggtcaactgtcccagctgagctgggcctttagccatccctgcaaagggactggatggatgtgggagtgaagtaatcccacaaagcagctgaatacaccagataacccccatggatgccatatagaacagaaagaactgcccagccaggcctgtcctgacccataaaaccatgagaaaaataaaacggttcttgcttttacaccttggaatttcagagtagtctgttacacgagtgttttttttttccttagttaacctaccttccctccaaagccacctgttaatggctcttactatacaggtggaacatgcctaatctgaataaccaaaagtttaaatgctccaaaatccaaaactttttgtgtgcctacatggcactcaaagcaaaggctcattgaagcattttggatttttggattagagatgctcaatcggttaaatatctgcaaatattctgaaatctgaaaaaaaaaaatccaaaatcagaaatacttctggttccaggcatttcagataaggtattttcaacctgtataacacgactgtatatttgttaaatattagatatcatcctgtctgccccccaatcattccaatttttaacataacacctaccaatgaaaccagaagatggtgggtttggttgaatcttctctttagtgttctcctggataatatcccagagctgccatataaatttaggatgaagaatgtaaaatggctgatttgggtttctctgacgatgctgaatatatggagtgaacaggttgtaatccggttttttgtaccactaaggaaaaaaaaatcaatgcagtcaagtagaaagaactaaactatgaaaggagacagggcatggctggttgatttgaggcagaggggccaggctggggctagaggatggggaaagatcatgactcatgacatctacagacacttcctcattgggatgaggggacaagaacaaagacagaccagggcgctagccctagcagatataatgctttgtgcttaagtaaaatgaggaaaagggactagatcacggatcagcatacttcttccacaaagggccagataatcaacaccttgggctttgcaggccatagagtcagtcgtctctactcaacggtaccatcgtagcacggaagcagtcatggacaataaatactgaatgggcgtgctgtgttctaaaaaaacactatttattaaaacaggtggtggctagatttcgcccatgggtgtagtttgttgacccctgggaactggatcagtgtatttcaaatatgagttttccaaatttcatctacagtaacagaaattgtatcgttgctgcttgggcctgagttggggctgggaagattaactaggattgattaacaaaggaactttctagggtgatggaaatattccagtttttcattgtggtggtagatacatgagtgtataaatttatcattcatcaaaaggtacatttatatttgcttacaccatgtatgttattgtatgaaaaatcaataaagatgttttctaaaaaggaagttttcagaagcatctcagctgtaaccatgacatggatttggagagagtagggagaagttcaactcatcaaactccctttaaacagacatcaggggtatataatgggtatatattaagatcacaggaaatattccactagtgaaatggcactgtcactttaaaagctttgagaatgactggaccagagtatctttcataaatgaagccccaagccatgtggcactggcaagggagcaagaggaatgtggggccagagggagagtcgctcctttaccctccctcctcttggggcctcacatggcagcaaaggccttacagaaagcggccttgtcactgggattttagcactgctgggtggccagctctgtgccctgggctgagctgcttctaacagaggaagaaataaggtccaatagctagaaactctcaagtctgttcacaaatagcaagagagctgtgagagcttaaaaccagggaacctcaggctggaaaggaagttgaaaagttcaaacacccatctgatgcttgattctcagcggagggtacatatgagaatcaaagagccctctcaaaaaatatacattgaggctatatatatcctccatttctggagatggggctctgacagattttgaaaaatactctccaggtgattttgacttgcactcctggtcaagaattgtaagtaatcatatgaggtaaatgtccagcctcagtctcaaggtcaacagtgaccaaaatgctccttctccaggagccgcttttatcttgggaggttacctctcacagaagcaaagatctttccctgacactcatcttaagaaggttgcatcctctctggtcttgactaaacaagtcaaagacgctcatttacagaactgacagcatctcttactaggctaaatactatccatcttttccagccctcactgataaacaagcatgctggcttttcatgaaaggtttcaccaaaagtagctggctgcttgtttagacaggcaatgatttaccagaatgtcccaaatataacctgtttgtgtttttatggctagcaataaacttgtttcagccctattgcataaaattcaacagatttagaagcagaggccaaagaggaacacactcaagaagagcctggaacaggccccatttaaataaaaatgagctgtggattcacaaagttgagattttcgtgccatcaccttcaatttatttcaaaaggtcttccaactacttgaaaggtaatgtagccctatcacaatgaaacaattctgagtttaatcagtcaaccctttagtgtaactagaaatttctgaatatttagatattctacatttcccccacccggctgccctgcccaccgattctgcacaaaagcactttggcattagatgactaatgctcacaagtgtgctattgtaactgggtatcaacgtggtgttcacaaacatgcattaaattgatattgatgggtactttcattgtctgtcaaagcttaatccttgccttgctcttatgattaattagtcaaagccattgtctgaccgttggggtgggcaaatccagggaaacacttaccaggttaagatttgcggaatatggggcagggtcccaggccaccaaaatgacgtctttatacagtgaactgtcaatgaagtgatggctggggttggtcagaatctgcaaacacacagaaaaaccatttcaaagccagggtttggtttttaaaaattgcattttaaaaagaggtgaaaattaaaaagaactggggcaaaaaaacaggtggctcagacgttgtattttcttctgggggagggagagaggcaggcgttgcatgcagaagcacttaaagaatgtttgaggaaattacttttttttaaaaaaaagcacaagttctgacattttcaccagcaatgtactcatgtctagtggtattgaatccagatcctgaacgatgcaactccctagctaattcaagccgcacaacctcttctacaattgccttcacatgtaatttggagacagagttgcaggtgtggatgaagtgagttcagaaggagcctccagggtgccagccacagccttccctctgtggccctacctagttctaaatgagttcttcaatctcagctgccaatcatctttttaaaattattatttcaggaaaaaacaacatattattttccctcagttttaagatactttttttttttaaccattattacgatgtacttttttccttctcatgttaaagtttcttagttagaatgtatgttacagatgatatgtattctaatttggtggcatttacctcctcctttgtaaaaagttgttattaaatgaatggcagattttacagtcaaatgacatctctgaattaaggaaatatggtaattgtttcttaccttgcggcaggctgcctggtgcagtgaactgtgcagaaagctaatcttttgttctgtaagcaactcaccataaatcactcatcacctcacttttttctacatattttgaaactccagaaattgttgtggtttgttctgaggataactttgctataaattttcaaggcattctcattaagaacgtgaagaaacgaggtattttcatttccaattaaacaattcctttccattttttcaaatttccaaatggcagactaaagttgcaaagatctcctatgaactcagattttatactttgcttttctcccctttatcctctgctttctttattgccatttcttctaaatttaacttttgtcagttcacaaaatgcaacatgctaagtctatgattataaatatatatatttctatttctactgatttttccttttaattttattcatttcctcctattcatgtcatgtctaaattcccatttctctgcagttttcttcattaatttctattaattataagattgatagaaataaacaagtaccacggtcataattaaccaggtaacttctcttcactcatccggttaaactcatttctcttcactcatccagttaaacctaagaaacatacatccatgaaaacactccatctgtcttacctgcgaattaatgatgcgtatggtggttttattcccaacatctttctcataaccacgtgtaggagcagagttaaatctcaaaaccgcatcatgagaatctaagggcacataagtgacaagcttacttttgttctctgtagaatcacataatctaggaaaaaatgttaaagcaaatctttcaatacctgaagctaattatacatcaccaataaagttaagatatgcccacatgattttcagagaatttactcttcactgagaatgagatcttggctggaggaaacatcaatatggatatatatagatgtaaaatctgttcaattatgggcgagactgtatgatctaagtgatatttagatacttgctaccttttcaacattcttacaagtgacatgcttgatgcagccattctcccaaagcttccaatacatcttgagggagactgtactggagcagataaagacactagaaagcaagggctgctttttggtgctggtgtatgcttaaaaagaaagccagccctgcaagggctgctttttggtgctggtgtatgcttaaaaagaaagccagtccttaagcagagattctgcatgtaatgttgaagaaagaaagaaagtcagccctgacttcgacgcagccttacatactgctgccgatggcaagaagacctgtgtgagagcaaccttaagagcattctgcattagcagcaatagcctgccagaccaccatagcccctgaggatgggtgagatggagagaccaccaatgccaccagctgccagggctcttatgttctataaccacacaccgtgcttcaccaaacttgaactatgaatgcaacgtaaatctacatctcacttcgttcaacttgacagcccgacttgcccaagttctctgaatgctgggctggaaggtcctggatgaaaacaaggtacccctatcctggaggctgacaaggaggtgaacagtgggaggcacaggaaagtgggttcacctgatttagcattgggactaggggatatgttccctttacagaaggcagcctataaacatacatgcgtcttgaaattcctagaaaccagcctgaagccagagtcagtgagcaagaaagcaattttctaagggccatctttagctttaaatatctcatgcagattccaagctcggcctggagcaaggacagtgcctgtctgtgagggagaggtgaaaagaagtatttctgtcatgcccaaggggagctgcatttatagtccccgagcccgcacaagtgcctaaggcagccgccttcttccctgagttcctgctatctgctcctttggagttgtcttcttgctccccaaatagcagaaactcaccatgcatgcccccactaaaacaatgtttaaaaaggtgccttcactgacaaaccctaaacttaaaaaaattcaaattccagctttagcaccaaaattaattcacttttggaacatgtgaatgcataaagcgtaggtggctgtgtcatcaaaaccctgcaatgttcttttaggggaaattttgcaggagttggcaaactatgaccttctggccaaatctgacctgccacttgttttagtaaatcaagttccaccataacacagacacactcactgtacatgctgtctataactgcagagttgagttgttgagacagagacagagatacagttcacaaaacaaaaaatatctactaccaggctctgtaaaaaagtctgccaatctctaggttcaaggggatctattctttgtgtaaatgatgccaaaatacatgaatgcctccaagttaaaaccagttctttacttcacaatttaaggatttgttcatactttattgaggtaatggatttcttatttatttttattgaataatgttttgtcaaaaaattcaaataatatttgaggtagaaaaactagattacccaaaacagtagactcttgaaatttattgataatccaaacactttttaggcagatggaatatatctactgatatttaccatactaaaaggtaaaacggaattttaaaatgtctattaatttattttaaaacagctttttttcaatttaaaaaacctctatattttcaaaaaccaaaagaatactgagaagactggcaccgtttttaatgtctgcaagtctctttaaggtctggttttttagaaagttggtttctcacatctgcttttgaattcaacttgttgcaatatgttgttttatttgaagtatatgaaggctcagacacactgttgaattgagagagctatttaaagaatccttccaaagaactgtgaatattcttctttgatacctaacaagactctacgagggctagtttcttagggttggttacaatttggaatctgaaacctatcaatgaactttttgtgctctgttacattaaaacttgtggtctatttttctcttaaaatggatctttcactcacgcataattgtataatattgtacaatgatcagctgaaaactatcagctaggcatagttatacataagttatatatatatataatatgttagtcagacattccaaatagtgatgcattttgttataaagagttgaaacactggctgggcatggtggctcaggcctgtaatcccaacactttgggaggaacaggtgggcggatcatctgaggttgggagttcgagaccagcctgaccaccatggagaaaccccgtctctactaaaaatacaaaaaaaaaaaaaaaaaaaaaaaattagctgggcgtggtggtgcatgcctgtaatcccagctactcgggaggctaaggtagaattgcttgaacccagggggcagaggttgcagtgagccaagattgcaccattacactacaacctgagcaacaggagcaaaattccatctcaaaaaaaaaaaaaaaaaagaattgaaacaccacattgattagtatcaccatggagttccccagtttttaaagtctggaaaacttccaagttcatggttcaaagcttgaattttatcattggcaacaaatactatcagttattttcctaaaagtgacaggctcgcttgattcctttttgagaatatatctgccaaatatccaagtctgaataattaacgtttcttttcaagttaaaattgtatttcatgaaaaaagtggctagttcggctcacagtgcaattacccaagggcttttcctttgtgaactggcacacataagtgcttttctcctatttccccatgtgccccactgaatctgaaaaacacgtgtattcaaaggttgagctttgggttctgctgccctgacttgtgctaagaagcccctgtctcatgcatcattcattgtgtttgtaccaccagtgcaaatgtcaacaactgaaaggaaaagaactctgagtatacttaccagaatagttttttctcatggaccctcgaaagggtcttgcaaaggctaagggtaagcttagatctcactgttcccactgctaagctagggaaaccctctggttgcagacagtgagaggagactccaccagcgaggtgactgcaggtgctgggagggaatcagccctaagccagagaggaagtgtgatgccagcaatcctcaatctcagttctctccaaaccacgctacccacccctcagacacagcctacccaagggcctcaagcggtgggtgcatttctattatttgactaataaatctgaattaattgcatcacccttgaaaacatcccagcatttaaatgcccattgtcttattgtggagctgtgctctaaaccatccaaggacttcacgaggcacagggcacagaaagataacgcagtgtaattcctttggaggtggtattagtctgcagagttaaaaggccacctgcatggagagggcagggaggcagggtcatgtaggcttgtggctaggcccagtgcaagccctctatgaacagccactgtgagcagcgtggggttgggatggaaggggagggtgcgctgagactgtctctcacacagacacgttctgtaaacgtacacctggctgtgcattccttgataatgcactgtgagaatagaagctgtccattcatatttagaaaaaaaggaataggtcagacagcaaatacaaggggaagaaagtcaagttccatttctggagaaggcatttccaggccagaaccatgctgtgttgtccttgagaatggagccagacaagtgcatccatggaaggaaaattaaagcccttcaaggagctgctgggccagcacccggtcaccgccctgccccaggccccattcaccacatcatccccctctcctacactgatgagaaaattcaaacagcaggagagcaagcctccagtcactagagaatggcctgcctgggattggacaaagcatcgctttgggagctccatcaccctgggagccctgtttctccccaggacctgtaaccctcacctcttgatgtacttcccttgcaccctcaagtccaggctctggagtgatctctctacagtgactatctgcaatggctgcacatcatgggcacagggctgagagctagtgtttctggagacccagactggggtttgaatccagactctgcacatgtgactggaggtaccttcatttccttatctgtaaaatgggaacaaagttatctatcacttagggttgtaaggtttacaacagttagcacataaaaagcactttgggttgggcacagtggctcacacctgtacttccagcactttgtgaggccgaggcgagcagatcacttgaggtcagaagttcaagaccagcctggccaacatcatgaaaccccatctctactaaaaacacaaaaattagccgggtatggtggcgcgtgcctgtaatcccagctactcgggaggctgacgcaggagaatagcttgagcctgggaagtggaggttgcagtgagccaagattgtgccactacactccagcctgtgcaacagcgggagactccatctcaaaaaagcaaaaaaacaaacaaacaaaaaaaacaagagcattttgaacagggccttgtctgtactatataagtggtacctgatttcaattaagtgaagtctaatattcatagagtggcttgcaagggcatccaggaagatgatctgccttccaagcctgcttctctcttctgtccctacgagcccatgtactccctgtagctctcaccacctgcacaacatgctgtttctcacttccatatgatgctgggccttcagcttggtctcctctccctggagcagtctttaccaatctcttctctctaccagccctcaggggagttaggaatccgttgtcatttctgccttgtcagcctacatatctctctgtccttctccaacccacaacactggaattgtctgtttaccactgaagtgtgccggtatggatagttgagcctgtgacctattcatttttgtgtctagcctaggatctggtggagagttggtgatcaataaataatgctaattggatgagtatatggactgctttcttctttcttgcttttttaaaaggtaacaggacatgtcaaatctcaagccctctccaccagtctatgcatcccacccccagtctctccctccatgtcccatttcccatgcacttgccagaattcgagtttcaggtacacagatcttggtttcccacatgaaggctattactggtggttcagagcagacctttctgctctgtaacatgtttccacatgaatgctagtagcactgcatagaagcaaattattattgcttatatgcatggatgaaaacagatcatcttataactctaggaaagaatgatccaggtttccaaaacaattagtttgtttttcaataacacattcacagtggaagtgtttacaactgctctacttttctaaccaaaaccaattccattgtgtgacccagttccaacagaagggtagggggatgggggctgcactgccagtggagcaaacaccagggggagcgaaagggcagccagtaagcaaacctgagactgactgggtctccctttgacgtcagcatggagagggctcctcctggcagaacataggtagggctgataagcagtgatcatctgagacacttcctagctctgccttcaatttttcataagatcgtgatctttggtaagtcttttgatcttcatttagccaattcacaagtagatgcttagcggccaacaagaatttcgctacaccatgcccccaatattctaagctgcctgaaggaatttgctgccagagtttgtttgtattctgcaagccattcataactatgtgggtttgcttgcatatattcaggtgaacaggaaggagcgaggtcggcacctggcatgtacactgctgatgctgagataccaacttatacaaatgaaactttttgtttatacaaattgagccatgctatggttacatgttcttaaaatagtagatacaaaatctgatccaaacaaccctagacaaaacaataaagagaattttaaagaaatttccaggcatgttcttcagttgtgattctacagttctaatcataaaggctcatgcaagtgcatgccaaataaattagatttggatactagaaattaacaaagatataactggcatttcaagtttcccagaaacatggacttctcagcgtctttcacgttctcttccaaattgtaaacagagtttacaagattctggtcagggatatttatgcagaaaaaaagaacgagggactgcccactgacatgcaagagcaatccagatcttcacctctgatgcagaggtgtttaaaacaaaaccaaaccggaagcaagttactgcctgcttcaagcataatacttaaattccttctccacattattaatattggctctcagaaatgagaaagaactgtggtgttatttcaccccggggacctctaaaccactgcttcttcttaataaattgcaggctgctctgctctggctttggctacaagcttatatgacacatggactgtgttattatgagcctgctgtaatgtcagcacagggacacaggtaccccagaccttgattccagactcactgtcttgttttttttaactttaaaaatatttctcattcagcctcatgcccaaggacttctgctgagctgagatctgggcttctgagcctgcctacagtggcttcaccctattccgagagaactctggaacataggccactcttcaaggacacagaacaactaatggatccgcttaaaatgaagacaacaaagattacttatttgcaaagagggagcaacactcccggaatgtcacttccagaccagttatgccctaacaacgcctactgtgagagtgtacaggacatgattgttttatatctggacttgaggctgacgctgtatttgactcacatttgttttactgctcctcgtacagaatcaagcacatattaggggctaaacacatatttgtcaaatgaatgagcctaaagggccaagctgcttgctgactggtctagcagtggaattagcctgggaagaaggggggttccgggagcaaagggatctgaaactgctgagggagagcccagctatggcaacacaagagcctgggtatctctggcaagacagggtgagagtctggggcaggtggggaaatgaatgtgatccagcgaggaaggggaattctgaggagagccaatgcaggcccatctggtgcagaacctacaccactctgcaggagggaaacgtatttgaaccctgccatggccccatcaatcaaaaaagattagaattggtattttacttgaaaactaggaagaaatagtgatggctaatgttgtgtgccatcttggctaggccacagtgcccagctggttggtcaaacactagtccagatgttgctgggaaggtgtttttaagatgtgattaacagttaaatcactagactttgagaaaagcagacgactctcaaaatgcaggtgcgcttcctcaagccaggtgaatgctttaagaacaaagactgaagtttcctaaaaaagaaacaattctgcctcaagacagcaacacagaaactctgcctgagtttcccatctgctgggctgcactacctatttcagacttgccagccttcacgatcatgagagtcaagtccttaaaataaatctgtctctgtatagacacatatcctcctggtgtgagtctctggagaaccctgactgatacaggagctgggaaacatgtgctccagggctcttgacagggatgtgaaggcagagcctggcagggagggaggaagcccaggtgttgcatgttatttaccatcttggagaaggtccctggtaggtgcactggcagtgccccaaaggttggatttgcgccaacagttgggaggccggaacttattctcccatgggaaagatgttcccaacagcagctgggctcttctcagagctcacagtaaccaatattatcttcatgcaccctgctctttggagctgacgccctgattgggcagcttctgctttcttgcctcctcctcttgttcccttcccatattcccactgcaggatgggttcaccgggctttcaggggccacagcctgggggcatatccatgcagactgcggtttctatgggatacgaagtctgaacagtgagaaggacgccgggggcaaagggcggcgctttccttccactgcctactggcatcagctatggggaggacccttcctgctccctagcattccccaaatccctgctctaagagtctcccgaagagtacttctgctgtgaccccaggcagactcattctgtgccagcaatgggaaagcacctgaagaatctccagctaatattaggaacacctggtgcggagaccccagcttgccccgtcagagatccagaggcgcgctcagaaagaaccggcccccagggacacactggctcaagacagggcgacctggtccccccgctgagacctacctatttcctcgcccaaggaagagttgaggattgcgcctgcagacatgacgacagcgcagctgcgcaggccgcgggggtgcagctggctcaggggcacggcgggcaccaggcgccgccagcccagcgcagaaaagggcgcctcggtgccgtccagcgtccgcacgcgcgcgcggctccgcagctggcacagcagctgtgccctgctcagcccggcctcccgcttcccgcggaagcgcaccccgtgcttgttggcggtcaggtaatccttcatcgccttctgcaggcgcgggttcagcattttggaagagacgttccccttccagagccggtacaggaaggccctggacatggaggagtacagcctgtcgccgtcgtcgccctcctccaacacgtggctccttctctgcctccggtgcctcttcttcacccgcctcctctggacctgtgcagccggaaaagccccctcccgtgggcctggctccccgggggaagggaatcccaatgtcccctgagtgtggctgtgccaccctggctgaccagcagcaaaaaagtagtcgtcatcctccgggtagaaagcactttgagattttctccccacctgggatgaaaaaaactctttatgttcaaacccatcttgggactgggcccatttctgcaggtctccaggccccgcatgaaaggaaccggctgggtgggcgcggggcagcgcctggcgtgcgtccaggcccccaggcggggagggctcatgtgcggcgcccatgatggcccgctgcttcccctgcaccggcaggagcctcctggtctccaggaaggagagggagctgggtacaggctcagcggggttgctgtcggtgaagtagatgaaaatcagcaaaaagaggagcccccaagcgaatattccgaaaagcattcgttgtctccattgcttcaagtgtggtttcatggcaggtctctgcggtcagcaccttgtgtcttaatgcagatgggtggcagaatgaacctgaaaaacagccagatggcagttagccaacatggggcatctgctcagatgctgctggggacattctatcttgagcagtgtttctgtaggtggtggggtggggttgtagaaggggcactagaaaccagaatcatccaggagttttagctaaatccaggtgtcatatctgtccccctccccgccccccacctcccaccaacctctgcaaaacaagggatctcaccatctcaggtgagtctttggagagaggcgatggatgggtgtatatttgcaaaatcctccccatgtgactcagggacacgtctgccttcccactttgatagacagtagtgcccctgcccacaagttccccctacttctgagatgataaaattccaatttgataaagcaaagccagagaggtaagcatggtttgccccttttgtctgcctatcagaccaccgaaagctcagagctcatagattttacagcagcgctgctgtgcacttctaaggagtgacaaccctatctgattcttcctgttctccccattctggaaggctgcctagaacataccagaagtccaccgatggcactgaataaagcaatgcttcagtgactgtgtctgtgggtgaatgttatttcagggtgcctgttgtcttcaacaatgtccccaagactaccctcctacttcacccttaccgtgaacttttggtgagataagagggaagtacattaaaacttgaaataggaggagagatggggagagagcttgctgattctagatgagactcagagaaagggtaacaaaaggggcagagatgaaaagtaagatacaatgaaagagaatgaacctctcctctgtacagcattgcaactaatatgtattgctgtgtgggaagcacacagcacttagtaccaaaggaaacacaaaaacattaataagaaatgctcctaacttcaggaacttaagcaaagtcctggaaagggaaaataacctaaggtatgtttgtggaataataactaagcttgctggaacttcaagctgagcactaaaccaagcacaggcagatattcaataaatattggctgggtaaatgatctgagcttgtgtttgtgtgtgcgttttgcagagggccttgtgtgtctgtggctatgatgggtgttttggtgggggtgctggaagaagaagcaagaccatttggggaaaacataattggaaagctatcctcttccagctgtggagggtctggagtgcctacctggatgtctggggcacatgctgtataaaaaatagggagagagtgaagttctgagagcaaaggagttatgcattggttccatgggctttcaggagattccttggtggcaagtaaggtagagaagagtgcagggaggcaacacagactgcaaggaagtcgttagtagaaatcagatactcagaaagtagggtgattctgaggggagggtctgccaggggaaatgtgtgacccccacgatccttccccagtacaggctgaccaatgccaaaacacaaaggcatgtagggcatggctgtaatacaatggttgtgttttcactaaaaaagataggaactgaaatcaaaatgaatgttcctacctcaatgtggtcaccttgggaagtcatacaatgtcgctggtgggaaaggacgtgctaaactaagaaaactacattccttttgtggctctatggcaggttaaaggtggacacagattctgtgaccctccacccagagagaggcagattctgtgtctccccctattaaataaggacaggctcaatgactgcttggactagtagaatatggctgtggtgatactatgccagttaccaggcccaggtctagcattttccactttctgcctctcaggacattcactctgggggaagccagacaccagtgaagacatatccctaagcttagcccagcatgcatcgaggaagcccaagctaggaaagtccacgtggaatgagagatacccagccagccccaagctgttccagccgtcccagccatcccagccatcccagcccaggcaccaaatgtgaagcgcgaagaagtcattctggatgtcccgtctgttgcacttcccgatgactccatctccagccaacatctgactgcaaccccatggaagaccggataggagagccggtctagcccagtcagtcaacggtgagtgataatgatagattgttgttctaaaccacgaagttattttttatttgttttgtttgagatgtgtatagatgtgtataaatacatttatatacctatatatgtatttgttttaaattttagattcaggggtacatgtgcaggtttgttacaggggcatattgcatgatgctgagtaaactcctacattttaaggtgatttgttacatcagaagatcactggaacaggttctaatggaaatgttaaataagttccagaaatcatcagtaacatatacaactatcttatacccataataattaaaaagaaaaattaagccaaaaagaagaagtcctaaaaatgcttccaacaactgcaacattttcagataagactctagcatctcagagggattctacaaaatgcaacattcgcttacatgtataaattgtggcttttaaactgtgtttactttattttgtattcacatgagagcaaggctatagattttatatacagtaatacatcaaacctacatagacagaatatactttaaccaagccggaaccacggatgccaagaagcgagcgtagaagaattaatacccgcagttagcttactatatatacaggtctgtggttagcacttgttctggattattttatttggtctttccagcatcgaattagataggaaatactgtcatatccattttctagatgagggaactgagtcccagagcaattaagtaacttgcccaggaccacagagctagcaagcagcagatattacatgcaaatccatctgcttcatcctatggctcacacctttcacagtaagttctgattccatctggtcataccaaccaaggctacattttctaaatttacactccccaaactatctgtggtgaagggtaatttttcccccaaattgtcactgtgtgatattttaatatttccatttctgaatgtcttggcattgtacaattgctataaaagtttctaaatgcctgctctcaagttctgtaaacatcttaccaggaactggtaatgaacagttgtggatgtgcattagtctgggcccacactttgagtagcaccttccacatgatctgtctaacctgtccacccagggacagtgctttgagctgtaatgaccaacataaaggtctagaaggtgtttctaatatttcaagaattctattaagaaattgcaaaattatccttaataacagttattctgttgcatcccattgggtgcactgcagtataattctgacacttgctactgggagttagtgtagaccccatgtgttaagggctcaggcctccaggagactgccctcgtttcacatgccagctgtgtggatttgcatgtaattatctgctgcttgctagctctgtggttctgggcaagttactcacaagttactcaaagccactcacacttttaactgttcaactaccaatccccagactctaggacacccttcaggttcgataatttgctaacatgactaacagaagtcaggaaagtactagatttatggctatagttttattgtaaaggatgcacacagggtgagatctaggggggatgcagttccaccctctttccctgtggaatctgagtgtatcaccctcccaacacatcagtgtgttcatgaaccagaagctccagtgaaccccagaatctagagttgttattagggttcccattagataggcatgattgattaaatcactggccatgtgagtgaacttaatctccagtgccactcttctccctggatgccgggcagcccaaagttcaaaaagtttgaaccctgtaatttctttttctctttctttttttttttttttttgagacagagtctcgctctgttgcccaggctgcagtgtgcggtggcacgatcttgtctcatggcaacctctgccaaccgggttcaagtgattctcctgcctcagcctcctgaaaccctgcaatttcatctgattgatctttctggtgatcagagcccaagctgaagctatctggggacaaagtgagttccctcattagcagaatgaaaacagtcctatcgctaaggaaattccaaaagttttagaagttccatgctgggaataccaaggctgcagcagctgatttaaaagacagtctttttgtttctgactggtagtcaccatttcctggtttccctgcactgagcaacagctctggtgggcaactaaaaaatgagaaatgcaggtttctgatttcagcatttgctccagaaaatgttttttaaaaacagaggcaaagatgagatgtgtgcacagtggtgggaagtgaaacaacaaaaacaaagctttgacctgttgggaggagctcaaaatctctggcctagagggcttggggctgagagccagtgcccccccacaccagataatctaatatgaccttggtttgacgagtcaagaagccgcaggaacttgagctgagaaagtgaacttgggaaatttcatggcaggattcaaattatcagatgtaaaattaaataattcaaaattaaaataattcaaacttaaagctattggaactcaaaattatcttgagccttgggaggaatgtggctatgtagcctgcgtcagacagctgcaacttctgcctttttgttcctgcaaataattagaaagaccaagcagcgccagagataagaccctctcagatcactgcacctcctcatggaataataaagtattcttgcttaaaatggaacaatctgtaaccaatcaaacagctgtggcatatatacctggtcttgtatggaaaatgctgtgattctgctggaacttctctgactctgcctatataatcgaaactttaacttctccgttttggaaacactgaccccattcatctgcagttggtgctttcccaggtggccagcctcaagctttgcgctcaaataaactctgtacttaatcatatttcctgaacctcattatttaaggttgacacagatgtaaactgaaaataaattcctaagcgcctcaactgacccaacagaccccctcatggccagatggaccccagagaaacatgaaaaactgaatttccagtcatgactggaagggaggtcagacaggcctccatatattccctctccctttgatatgtggacacaactgaccaggattaatattaacatagacatcataagctgaccaaactctttgtggcgataagatgccaaattccaacctgactctggtatagcatcacgtgacagttagaagaccctgaaggaaatcaaaatattttaccccaaaatatatttctttgacatatgttgaaatggccatgcaaagctgtcttttgtgggggaaatttgcattggtagagcatctccattaatgcagcctacctttccccttctaggcctttcctggacctaggagagattaaatgtgagtgtaacacctttaagttcccaaaagagacatgtaccatctatcctctctgaaggacactacctatgaggcgtcatctctataacaagaatcttggcttccacaacccctcttaactcaagcatttatttctattgacttcaagccttgagacaaagcttaactctttcaaccaactgccaatcagaaaatctttgaatgtacctacgacttataaacccgcatttcaaaatatcccaccactttaggctaaaccaatgcacacctttcatgtattgattaatgattttatctacaatgcctgtctccctaaagtgtgtaaaaccaacctgtgacccagttgcctcgggcacacgttctcaggacttcctaagaccataagcctgggccatggtcactcacattggctcaggtttaaatattttacagggcttttgtgtttttctctgcatcaacacagacatagcctccattatatgaaaacgcctagtttctacccagaagaaactacccttgtttgtcatggggagatgacatatgggaaaggaagggagaagaatgagaggatgtcagaggacacaaataaagagaagaagcacctggcaggatagagggggctgcgttggtgccaggaccctgtggcagagtttgctctctctgcccgctgtgctgggaagtagaaagaggcaggatttgtgaggctctctgagcatctttaaaggagtattacaatgcaaagaatgaagactcttcattaggtggagcttaagtggctcctaatgcacaagaataataggaaggagtggatttgctgcactgcctcaatttgtgattaggtctcaacttttaataatccaaaagcctccactgcagcctctggagctgcaaaccttctgctgccaattgagagaacattctccaaaatgattaagtctcaaggcaatgtcaaatcctctgctagcaaaatgctacagaaatcacgatctgcatcatgggtctcagtcatcagcatatctgtaacaaatccaggttagagagaggcaagggacatcatcaatgttacagccctggatcatcgttttccttgaaatgaccataagcctaataggaaggctcggctaagcaagagaaaacacatcttttcctctgatatagtatatctgaaatattataattatacaacttaaagaaagtcgtcggtaatactcactgccatatcccatcattagctggtgtgatataaatgacatcgggggatataagaggcccaccaggcaaatcatctgtccccaggcaccaatgggacagtgctccttaatcacaccttcacatgtgctttgtctacgatggtttaagtgactggggctgtcgagttcttgccagttttcccctgggaagagcactggcaagattatactcatactggattgggtgtgactttcttttcctttccactgcaattctaacattattacctggcaatgcaaaggtctgaattcccagtggatgttctctgcctatttggactacttttttctatttccattctttctccctgttctctgccctttctggccaggcctctagggaacttctatttttagaggcaaaatcaaaagtgcctcactgctggaaatcacggtgattgttccacttgcttaggaaggtcagtgcccacatcttaaatactaatgcccaaacaaagacacgagtcacatttcttagggatagttaaagtagcacaaaagagtgtttaaattctccttcaaattcttctgagagaaatgacattttccaaaaggcacaatttattacgagttgtcagataaaactatgaaatgtaaacgctgccacagaggaacattacactgcagcttaaggttaatgcagctaacttcttattttgttcaagggcaaagagaagttaattctaggtcttaccactttaacgatgtccctcttaagccttgtggttgacaagctttattgcccattttcttgactggagagtgtttttctttcttttttttttttttttcacattttgattgatgtgtctgctattaattgccagctggccaagttttctgtgggtctgagacacactcacgtcctttttttgtgtcaaagagttgtctggactaatgctaagtctaagtatttattttaatgttgaaataataaagaagatttagcatgtgagctgtggtgagatactcgtgtatcttaatggccttcagcagtcattttctttcgagaatcattttttctaaaattagctcccgtcacatatccaagaaaacatccagtctgcagcaaagaggaagatacctccctcagctggaattcttttatctcttaacacccttattggcactttttacaaatgggcccttctcttttctttgcttttggtaaatgtgagaaagtctccagactgctaaaggcagaacaccaaagaggcactcccttattcattatccctctagtttctgcccattcttaagctaatgtccagaagaacagaaagaaaaaggtcggccaggtcagcggagcctgtggtagcgggaggacatccccctctctaaggagtacagtcctgcgggattgccaagtccttgcctcctcagaagggcagcccccctgcaggcagtgccccctccttgtgatggcgctgtttgacaccagaatgcatggagcaatcccacctgctaggaagggcactgctagggctggccgacccagtgacctcgcttggttgaggcataagtttaaaacactggcggctgggcttccggataatgtaaaattcagatgtttgagtaacccacaatggggatgcctgtaaggttcccgaaggtggggactacatcttattcattcttgtattcccaccaaccaacatgggctggcctgtggaaggttcccagtaaatactcctgcaatcaatgaatgtctgaaattaagaaaataagtggggggaatgtactgcaatggcattgcctgaccaggggctgttggttggttcaggaggggaagggttcctcatttactgtgctgctcagcctggcagaggtgtctgggtggctccaggcaaaatcatggttaggctgttgtagggttaggcctgagtcattaacagcagtcgtggcaggagtcagggggctggtgggtgcacgagcagcgaaggtatcccaggctgccactggccaaatgcctgtgctgtgctgggcactgtatctagcacctcactcacattgtctcgattcctcgtctcagtttaatcttgacaacaaattccttagtaaacattatttgtctccttaggcctatgaaagctccgagtggttcccttctggtttactgtcccaaagcccctgtctttttttcactagaacacgaagccagaaaaaattgctggggtcaactcaagcaccagccttaaaattttaataagatttatttttccttttggccacaaagtactatgtctaatttcactccagctccctacatttagcagaacaagtgatcctctgacatccgtatctttgtttgctggagtaaatgatgttcccagttaggctttacaatccatactttcccatgccccgccttcgtcagagatagcttagtttttggacaactgccaggcggattttgcctaggcagaatgggctaccaatttactaacatttccaaagagactacaggtgttaggcccatggttgcaggggttttctacctcggtaggaaggcaaaacagttctgcctttgctgttgcatggtcccaggactgctgaataaatgacaagcaatatggattaaagtaagcctggaaggcttcaagcaagaggaggtccagagctggacgtcgaaggatgcacaggtatggaggagaatcagtgatttcaagccagtggaatgcctgggcccagtgtgccagggatgagaatgtgtatgctggacagactcatgtgagctggggctggacaagggtgagctgctcttagaagatgataccattatctttctgggtcaggtcattccagcagtacagggtttttgctcaagagacagggcagatgggaactagtttaaaaggcaaagattcacatatgtgagccactctgggcatctcccagttgaggaagggggaggtggaaatgattccagacgtctatcagtgattgtgcagagacacaacacaagctgcctactagttagggtctgctggcttccagaaacagcattcatctgctttggactcagtggcctgtttgttttacaataattagcattcaaatatttatacttcataccagaaatgtgccaaggctcatgactggagctgtaaattcgcttcagtcctgatggctaatactaagaagatggaagatgtatacctgccattgggacttgaaaggttaggtgaactcctaaaatgtgaagtgggctttgaggtaaaagcacaggtggccagcagatggcttttacaaggaggcttctgtaccagcagaggccacatttctttcagcgggtgttacagagtgagatagataatgccacctattctgaggagtaaaggccatgcacggttgaccagaaagccctgttggcacctgcataattttggataagccttaatttcggataagcctcagtttcatcaaatgtgagttgtaagatcatcactgctttatgagatgaatgaataaagtaatgtgcttagcactgtgcctggcccaaaaagagagcacaatatttttcagtccaagttttgaaattctgtaaaagtggaaaaggtggcataacacacatggatttcactctatattagtgtattgtattgtatgatataagcatatattatactaaataatttaatatctattacatacagtaatttaatttatatgttgcattatatgtattataatacaccatattggtgccatgtgtataaacttgatggtttcccaggaggcacctctctttaactgacaataaactaacacgccccggtttagataaacacgagtgtctgactcaagctaataagcacagaataaggcctgcctaaatagttgtgactgtcattagtgtacccatcattaagtaacctgagtgtttttacttgcaaaaatgttatttatggcttattttattgtataaagtggctaatgaagtattctctcatgttttcatgtttcatgtttctcaaatccttttttaaaaatataaataaatatactttaaggaattttttattattttttccaaaaaaaaaaaaagacctctctctagtgtctcagtcataaaaagtaaccctgtcagggactgaatacctgacaaatgtcttctaatgggttcactgtgttaatgagcttattataatttatgctgctataattcagcaaatatttattaagtctatcataaggtggcatatatagcacatgataccttgcccctggagaagtgacttcattcttgggaagtatttaaatgcttgagtaacaagcatgaacgaaaggatactatagattcaaattccagaatctctcttcagtccagaccagtgaggcctctcacaagaacccagggaagaaagggtgcttaggggcacccattcagaggactgcaaaggccccacatggcatttgtttctctctttggaaatggtgttttacgtggtaagagctacacttaaaaagataaagcaaagctaaatctcttagctccatctctgtgggtaaacttcctgtgtaacagttgagagaacaatagaggctgcaaaacaaacatacagaactaggccatttatgtaaaatgtttaaacacataatataaatcacctagtagctacctctgaggacggaggaaaggggtttggatgagtgagagaggggatgcctgcttcattactaaagtattccttccttataaagaaaaaattggaagtaaatatggcaaaatattaatatgtgttacatctaggtacataaactcttattatattagtttttctattttaccacatatttaaagtatttaataattttaaacaatgaaaatttataaaagtaaagttgtaataaaagttgtaaaaagttctaaaataagacaaatcatttatatttacatctctgtttccaaatcaatccccttaagtgacaattcttgctgatctggtaacacaaaacatacatctaacattttacacggaactccagatttagttaaagctttcttctggtcttgacatgaccagtcaagacaagaattactgaatgctataatgctttatgaaagcttcacagagtgctgagcttccggtggaacaacgattacaatcctgacttttactatccatgtaaacttggacaggtttctttacctctttgcaccttggctgcatcttctgtaaaatgaagagcatcccaacctcacagagttgtcatagaataacatattttaaaagagaaaatgcaaataaactataactcccataaacaatagatacgtaaaaatcccagctctgctgtgtgcctgcaggctgagctaagcactcatgtattccatcttggctcctaactgcctaggataatggcatctctcctctttccatgttgagggacaacccaagggtaacaaccctggcttctcactccaccttttaatccttcccacagaaaaggagtccccagtccactgagagacacggatcatggtgtgagtctctgtagacccaaactgtccctcaaatgggtttgttcaagatctagacttgagtgtggaagggaaaagggaggattggctacccaaattgttgctcatctccaggacaaaagcttcacctggctttttcactaatacccttgagattttaccctcctctgtttgacattcgtggcaccaactatggtgttgagcagttaccatttcagtttccttcacatcctatgattgaggagctatgatcaagcccattttatggatgagaaaaatgagtgacagcaaggtattaattacttaaaagcactgcttgttactgtgtggtgaagctaggacaggacctggtatctttgaaggcagtcaaaataaggacatttgacaatgacatctgctctcatcacctcccagtgttgttgaaaataaccaagaaaaaatgcattggcaagaacattttgaatttagatattctaccaatttgttcaattttcatgacatgaggaacagtcaatatttagatttaataatatgccacaggaatctgggtcaatttttggtttcataaaataagtgtaaatgaaaagatgatcctggtatacacaaaaatcaccttggcagatgcagaggtgccagtgaaagtcatagacaggtaagcatttttctgggcatgtgcagatggaagctgtttgctttgcaaggctttgtaaaggctgtggtagagtagtatcgacattacttaagttttatttttgaggatggaattttaagaccttattcaaagaaaatgccaagttgctaaggacctaacatcttgctttttatgatgggatacattatccatagaagtgactggaaaagccagccatgaggtgttgattttaatagaagacttgggctgagagaaactcattaatttttatattagaacacataatacggccaggcaccgtggctcatgcctgtaatcccagcactttgggaggccaaggtgggaggatcatctaaggtcaggagtttgagaccagcctggtcaacatgctgaaaccctgtctctaccaaaaaatacaaaaattagctgggtgtggtggcagatgcctgtaatctcagctactcgggaggctgaggcaggagaattgcttaaatccaggaggctgaggttgcagtgagctgagattgtgccactgcactccagcctgggcaacacagcaagaccccatctcaaaaacaaaacaaaacaaaaccaaaaaaaaccacacacatatacacacatgttctggagtcaaatataaaatcaacttgaatatttaatacaaaatatggcccttcaaagaaatttcttagtgtagggttttcagctctgccctctgatcatcttgacctgagtgttctctgtccgtagagtggcctctttgggcaggtgtgagcagcacggccgaaggaggttgtggggtgacactcaagaacaatgcctcgctgctgacaagaataacctacacacaggtcaggtgttttctctccagtctacttgtccagtgctcacttttcaatgccagtaagaaagatactactagattatgagcaatttctgaatattacaaaataatttttgaggtttctacctctgaggactagcttgctgtcacatcttcttcttaacaataaactccagtcatggccagtgagtcactgttcccttgtgaacagcagcataaaagcttttttgtatatgtgtgcatgtgtacacatgagcacagaactgatcatgcactacacattcacctactttactcattttacttttttattcactttactcatgttttttactcactttactcattttgcagacattggagcacctgctctgtattgaagtctaggtaaaaatgctgaacaaatcaaaaagaacttctcctgcactcagctgacagtaatgtggcaaagagagaaattacacaaattcttcaggatactgtgtagttttacttgacttttttccattcccttttaccctacaaccttcctccattcacagtgataaacacaagactccccagccctaaaggataattggggcaaaggaatcagaggagagtaatgtcaattcttggcttttaagttcaaaagctgtgtttcaaggagtgaagaaggaaggtcaaaaaatggaaagaatacttgctaagccagtttccttttggccaagggaagataaaaattatctctgggctgatggaaaacaagagtgggagttgaagtagatgagttagataccagcaagcgtctccaaagaggattcccatatcctgtcaacaccaaaccctcttgggctagcaccaagaggaagaggacactagagccctaggtaagtttggggattgaatgtagaagggatcgtgatccactctgcacctctgcatcttagatgtgaggatcttgcaggaattccccaccccactggaaatggaagcactgtgatgaatgtgtgagccagagttgtctgtgctcagaatggcaagggaggacagccagatgggccccaaaaaaggaaaaatctgcacaactaaagaagaaggtgtgcaggcatgggagtgggggcaggcagcagatggcagcacacgttgtaatgcttcacaaagcaggagaccaggctggctgccaatgctgcgacagtacaacatatgtgcaagtggatgctaactaaggactagacaatcttcctgatgtcatgaggctgtctatgcccccaggagttagagggagaataaagaacctatgtttacaatgtcaactttatttaatcacctaaaagggttggctgaattgacagtaaaacttccctgttctcagtggaatggggtctcaaaatatagcctaagttgaacttagttaaagttccattttttgaatacttttggaagtggatggaaaatacacatctgctacacatatgcatagttataattgtgctgtgttctctatatactgatgttgatatctatacccttggtttctcccctggactgcagatccacataatcaataaactatgtgatatcgccacttaaatgtgttctgagaatctcaaacttaatgtccaaacaaatatttgttattcttctttccttccttagtcttccccatcccgtaaatagcatggccagtcactcagttgcccaggtctaaaactctggtgtttttcttgattcctttttccacttacaaccacatccaatcccaaccaccagcaaacccagataaccctaactccaaaacacatctagactctgacaacgcattgccttctgtactgcccccatgtggacctagtcgcctctcacctgaactatgaagaacttctgaactggtttccctgcttctatcctgtctttcctctgtagatgctccatgcagcagtcggagtgacacttttcaaatggaactttaacatggccaattcctgtgctcaaccctccattattcttccttatacttcaaattaaaaaaaaaaattaccctttgccgtggcctacaaggctgtgttcctgcttgtctctctgctctcctcttacccattgctccttgctccctcctacccgaccccttgctgcccctgagtcagctcacacagctcctggccatttgcttgggcccttccctctgcctgggacaagcctgctctagaacccggcttggcttcctcctagttttgttgaagtcttagctcaaatgccacctatttagtaagggtttccctccagcatgtttgcatccctttctctctacctctcttggacatctttgtttggatttttggtactgatgccactggatatgcttatttgtttactgcctttcttctctagtgagctctaagctcctgcagggtgatctgtctttctggctgaccatgcatcctcagagcctggaacagtgcctggcatacagtaagtactcagtcagtccaggaaggagattgaggaggaaatgcttaaggtgctgtggtgagacaaaagacttagggcataatttcaatgggggagcctgggaaggtcttttgcaggcagaaaaatttaagcagggaacaaatggctagtgaggggttaggtacttggggatggagtacatctcacatggaggaaacaagagctgcaaagggcagggcagctgagagctgtacaccacgtactgcaacacgggcaggtacatggctgtatcacaggtcctctttataaagatcaaaccacttgttactgactccataaacactccatatccattgtgatatggaaagaagcttctatgaaatagactaacaacttttgaaatataattttaatgtttttatcacgtctaattacatgaataaggtgcaatgggcttcagcatccccatcccagatcactaaaggccttccctcacaaatggttttggctaaaactcaaccatatacaatggatatggaaacttagaagtatgtctgaaagtttattttgtgttgcatggaactagaaaaagagaaaagtgaaaacagtaacatagttataccctccctgctttgattgactgcacaaaacttttgctgccttcagcagttttacagtctaacacacttaggaggcacccccgccaaatgccggaaacctgaatctgctcttgaaatgtcagtgataaaaattaaaagaagagtagaagagtgagaccctaattgtggctaaatcatcagactatgaacataaaactaactaggatgacacaggaaaatagcacagcaaaggggaagaaaaacaccatctaaaaattgtgtgtctctgagatgacaccaagaatcacaaagcctgaggaattctgctttaatatccatattaaacaagtaatctgtttatcttctcatctcagcccatcctggccctttttccttactgccctaacctctctttgacctatagaaatctctttctcccaatttgtgaataagtcatggcatataaactgccaacctatcccttgatgagaatacccatttttatatttaattgtgtgtctgtgtgtgtggattagacatttattatatatccaggcactgtgctagatggtggggattaaaaagacaatacaacatgttcttatcttccatgatcctataatttagtggaaataactggtgaagtcttcattgtgcctgtgtcagccaagaatatttcattactaaataaaatagatgttcatttattctttcttttttttctttttttctttttttttttgagacagggtctcactctgtcacccaggctggagtgcagtggccgtgatctcggctaacttcaacctgtgtctcccaggttcaagcgattctcccacctcagcctcccgaatagccgggattccaggtgtccgccaccaagcctggctaatttttgtattttttgatggagatggggttttaccgtgttggccaggctggtcttgaactcctgacctcaagtgatctgcccgcctttggcctcccaaagcactgggattacaggcatgagccaccaatccattcattcttactggcatccaacctcattcattcttatttcatactcttatgtaaatatacaaatggaattacaataagggtatctgcaactaatttccacgctgattaaatgacagttttgtatcacaaaagaaagcactaatcaatcatttattcactcaacaaacatctcttgaagccacacagtcagacatgaaattacgagtgatcattccgtatatgatatgcagcttaaatgaaatgctaatgctgctgcaccagagtcgtgaagcagtaccaatctttatgttgcctctcactccagtgtgcttttgctcattttatttctgctcttggcaagatttaaataaaggctttttttctttgctctacaaatgtttgcagcagctatattacactgacttaacacagcattaactacagtacaaatacatactccctagattgcttttcgagaaaggaaaatgtttatgatctctatcaaacaaacactgaattcatcagtctgaaatttatttaaagtgtcagatgaatttgacaaaaatctatacctagaattcatttctgaacagcgtaggcttattactttgatttcgaagaaaaaaaataccctaaaaatgttctggctctctcagaatgtaaagttcaagttaaggcatgtatggctactatgggtttgcactgaattatgtgaagaaaaaaaaaaagcatttctgtcttggttgcttaactcagagtaaaatcattagtcccaattctgcaataaaacaaaatatcagtctaagtgaaaacaagtaagaagcatgggctgagaggattttacttttattaggctttactttatgacccaggcaccaacctgaggcagggcatagaaaaaacatttctagacagggacagggcaaatcagccaagaaaatgactaaatgctggagaaaacaagtcattgagctattttaaatctaattaatttgataaaatatgtttctatttttcccaacctaaaaataaatgattacaataatagaatcatgagtgcattgcttataatgtaaatgtcttttttttttttctattagaaaagctaaagaacatggtattcctggggatatttttctcccttggtggtttgccatcatgtgcgttacagctgggacaggccttacaaggactccaaatttctttctacaaatgaggagcccgtggtctggagaaacgaggcgagttacctatggttacaaagctagctggaggcagacacagaatgagaggacaggttgcctggctcacgtttgctctcttgttctctgtcattaagtgatggaaagggaccgaaatacttaacaacctacagaaatctattccactcacgatatgctccttgtcatccaatgatacagaacagattggatcatggatttttgcttcttgagtgttttggagttctgtagctaaacaggatgctgcagaaactgggaatgaggaatctcaagaacaaaactacacactgtaaagcgtgtagaatcattccaacggggttcaaaatattttgggggagcacaggtgacccccccgtctaacgcacaatgtttctgaggctggttccagagcagaccatgatgaagtggcacctgtagaacgtgtaggcagtagccactatggggcactgtgcaaccaaggaaatacacctgcaaaacactgagaaatccgggtcctccgtttgctaaaggtaggacctggcactacttaattaacctctcccatccccagttctcccaactgtaaaataagaagagtaattaactgctctgaacatctcacaaggtaattgtggggatcgatagagactgggtataaaaggtgatgtggagctaggaagagatattattatcattacatgcatgttctttcctcttacttgggaagacagcacagaagctacaaaacaatattatttctggaagtgtggtgcctggtgctgcctcagaacctctaaggaggtgtgtttaaaacgcaactacctgggttctatcccagactcactgaaacgaaatctgggtgggcatggcccatgatcctgtcatgtcaaaactttcctttggattgcatgtccctaggactgcactagaagggatccagggagtaaaagccagaggaggctgggaagatgggcaaccgcattccacagaaacaatgttcaacccactggctggaatctccaaactacccacagatgtctgcctgatcacaatcctgtaattcttgttacctctaccaaaaccaacctctctccctgcagccctggagactacaggcactgccagacacacacctgcaagcctatgcaagggttgttttcttaagcctcctgctctgatggcccttggtcttctcccctgttcctgcaacacttcataggtaactattcctccctgggtagaacctttccatgaccagtgattggcacattttactttcagcgtgtgatgtacaaatacttgaatgaaagacagaacatggaattcattatactcacaaaaatcttactatagcatttaacattattctttttgcaaaatgtattcacatttcccattcgagaaggcaaagataataagcatttgagtaacaaatacctggattcagatacatttccaacataagtttttttcatttattagctgtatcaacttgggcaggttattacacctcagatcagtttcttcaactggaagacagatgtaatatcatacaacctagcccgccttcaggaagattttaattgggctccacaggaaaggcaattaatgtatcgccaggcacagatgctcaaagaatcttcattctcttcttgtccttttcccttttcacactttctaatgggttctctaatagtctgcaatagccacagcttttaacaaatcttccaaaaggaactccgacagtaaatttgattcctactcagtagtgtgctattaaatgttttacaataatctctcagggagggggagtggaggaagaaccctgattgttagtgtttgcccattctatggtgtaaacgcttccactatagccaatttcaaactaccaatgggatgttactgaacggaactgggatgcgatgtgcaagagctcatcattgtatgagtatttccaccacacagatacaataaaagtaaataacttccgagagcgcagataatatgaaataaattgcaaaatgaaataaaagaatcagaaagtgatgagtgtgaagtatttgccatctttgcttttaaactggctcataaatctcctgaaaaggtacaagccaactccagcacactactgtatcttactccatcaagaaaactctgcccttagaagggtactaattgcaggcatttcagcctacctagagagctttatttatgcaggaccctttaaacagatgcagagagcacatgcttagagtttctacaggggtgaaatgtggctacaaaacagtatgtgtctacgtgatactgacgtgctgtacatgtgcatcagttctgctagggaagagccttgtctggggagaaagaaagctgtacagtgcttaacacatgaaaacacccggtcagcaggtaacagtaacaggtagtaagcaatagcaaaattcgttacacctcttctctccatctcatccttattacgaacatttatttatgtggcttaacttttaccttaggtccatcctcgttgtaagacactaagccatgatgtaacaatttttagggcccatgtcagacatgtgtgacactctcactttagacacaaggaaacaaaggtacagaggaggaaagcaagttgcccacacttaaagggatgtgggactggaattcaggccttatacttttataaaatggattagttctccaaagccttttggctactatgtttcatttgcttattcatttgtacactgttttcaagagataataaaatatatttgtgacttataaaattttgtttgcagcctgctcagttccagaggtgacatttaatgaccctgacttgcatttgcattaggttgtctttaccacaatagagccatcacattggaaaacttgctcagcagtagaagtggcaggaattaacttttattaaaggcttattaggtaccaagaatattagtaataaattataaagatggcttcatttaaacagaagaacaacctacgagttaggtaatattatggcctcaattttatgatgaagaaatgaagactccttgaggttaagaatccatcagaagtttctagggctggcttgctgggcatgtgactgtgcagtcatgtgggacccgacacccagaagagccacacttgttttaatgttctcctgccactggcctgaagttctcaataactctgtctttgactttgtgtgctatacctgaagtcagatgggagagagtggaacgatgaagcaggcatgggtcatatgtgtgccacatcctgtccatcgttccttgctgcccacttaaagttgtctaacattcatgatgcctcatgagcacaggactctggtgaggtcacaatgcttgggagttcagcaggactcaaaacgagtgcaaggtgagtatggtacctctacgacaagtggaggatcccacagctcccagaggccatgctttctgtcagaaccagaactagcttcaaacacaaaagtaaggcaattgtactttaagaaacacaaccgaccaaggcccctatcatgtcctttcttatttccttatattggccaaacacttgtgctccaaatggtgacacagaaggaaatccctgccttattcatcaggaagctgaaggtagaatgtgttggtaaaacacgcatgtatcaagaagtaaaataaaaacaacagaattagtttttggcagtgtttcctctgttctggtcagaaagaaatacataggaatgtaacagctatgaaatacaaattgtgtaacttcagtgattatgcaaacaagttaaatgcttttaaatttgcatttaaaactggcattgcacgagttaacaataacagaaaaaaacataccaataattacatttttaatttttctttacttggaacattaaaaatactgtgacaattcaagaggcaaggaagagaagggaaaggagggcagggaagcagtgggaaggaaagggcaaaacattttgttttagtaccttggagggcacttctttcctgttttttgaataaatggctccacattctaatttcgcacagggtcccacagccagccctggctgtcacacaacgtggaagcatcagagtcagtatctgaatccaaactgactccaaagctcctttgctttgaccccattttattcagccttttattttaaacaacacggctcttcagtttcagaaaatttttgtcatgattccactgttggcaatctggacatgtgacaattgtttatccctcttcctttttcttaagtttttcccctttctctgaatcatttcagctgtgctttctccattcattgaacaagtattcactctgtgccagggacatctaactctgttacccggtggtgcatcggcaaagcctatgattttggagacaacaaaggcgaagtcatttctaagaacctcagaaatcccaaatgacgaggtttatgcaacttcaaagtccttctgctttttttttcctcctaatacttgattacctctctaagcagaggctgcacttcatgcaggtctaatctttcagggcacagtgtggttaggaacccacccccagcccgacccccgccgccaaaatgagcactggttgtaagtaggcattcagtttcaaagagggtttgttccactgaacaccaactgtggattagaagcagcagattaaaattctgtttgcttgtgtcccgtggaggactcaaagtcaggggatttctatccaggactttctttcttttcttcctcaacctctccctccccccacaaaagccactgtctgggttgtaagttaaatcaatcataagtcatctcaaagaataaggtattattatataagaaggtaaggcaagagcgaaactaacaaacaaaaccctatgccacttacgctgcttaagaaagagccaaaaaatgtactagacatgacgccaattctatttcttttaattcttctgttgtgtcctaatgatactagccacaaatactacctttgagcccagcacagttgtgctggctggcaatttaaaatactgtttgtcaaaaggaaccagatcatttacgctcactttacaggggaaggaacggaagcctggaatacggttaatttttttcatggtttgttaaaacagaaggaaaagaaagaaggaaagaaaaaggtaactcatacaaatccccggcaaggtgcagggcctggaatttgagactaaatctgtggactccaaagccccagtctctcctcacaggctgccctctacagcttacaaagtgcattcatgcaccgcgcatctcagtgccatatggatgtcagattaaatgtccaatgctgacctcagttttactgaaaataaactcttcataggtcataaatttttagaaccggccataataaactaaatatctgtgtacaagtcccaaagcaaagatcgctgcaccggaagcctctagcagtgcttcaaacatgcttgctgctaatacttagaactgccgttatcagagacagagatgggagatgagaaagaaacagattgggagactagaaactgaagaatgccaaggagagaatccagtatgacaaaactgtcatcaatctaccatctgtgtagagtttgggggtttcagagacaacatcataggtcaacttgcttttcaaatgtctgaaattgtgcccccacatgtgtgaattgtggctagacagcatgaatcacggagtgcaatacaaaaaagaaaaagaaaaaaaaaccacttatgaaatgcatcattgagggagtgtcattacattctgctctaagctggtggtaagattcaaagtagactggtggtgggccattgctaggttgtaataaagccacatctatggtgaaaggagtttcttttatttaacaaacatctatggaagacatctgctaaccactggggatacaaaggcaaatgagatgagctcccatatcttaagaactggtggcaggggaggggtggtgggctttggaggggatttggggagtggtgaacagaatattccacaagtacaagacagatactccaggagaggaaggcctggaagggagctgcagactccctagaattcttcatttggaggggaggggcacctttcaaacaggtacaaccaatggggaaaggggtgtgggcctctggcagcttccttgtgcacagagcttgtcttcttccattgagatatttggacaaaaaccaaactagggctactctgtcaattttctgcagcaaactgtaacacatcttgtttcatcctttcatcttctcccgcaggaacttcaaaatatcgaccgccctttaaactcagggataactgctcccatcctaggaagcccgcaatttggaaatggggcaaagaggctccagctcccacccagtcagggagggcatgggctgactgtttacaaagtgcagacgccccctcctgctgctgcttttgctctctgggcagaagcagggccttcaaagctgtcagtcagacctttgagaacatgaaagaaccctggggagggaagaaagggtttgtttgtttttaagctcttctcattaagttgactgatagggaggctcacacacaacagtggggggcatccaagtctaatgtttaagcctagacagctccaaggggacacctgttggctgttctccctcgcacctgcccaggtggctgggcctccgactgtcctctctgcacctcaccccttcctgacaccaagcaggactgaacagagggccctgcccacaaggcacctgacctttgagccagggagacagccaatcctaaattgtggagactgcgatgaggctagccactgcgctgtgccactttccacttcagtggtgtgacggaccaacacaactaatgaaggtgacgtacctggggtctgtctgcaagatggccagtgagaggagggtgggaaagccagctctgtacaggcagtcacctgggggatggggggcgctacagtctgctgctttttgcacaggaatcatctgatacccacagaatgagattcttcccacccttcattggccagagagagtcctggaattgtgcagagcccccagcctgatgctagccttctttttcctggacaccaagagacagcctttcttcccaaaaatgaataaagatagttattttgatgtataaactgaatgtttaatagtaattcactaagagggtgaaaaacgtgaaaacttccagttagctcggatagtcatgaaatgtaaacaggtaaacccaggccacttcttcttgttagatccatattatttattaccagttttctaggaagccacaaaattgtgtttactttcattgcctgagagtacacgttctcaaggaatataaatcagttgaaaaagcaatctaacaaataaacaagcagaacaccaaactcattaccaaaggtgtgcccaggccaagttcatctcttctcccaaaagcttgagatcctttcaaatccagtgccaatatccaatgattatgggtttcctgaagagtgcaacattcttcaggttcacaggttggtttgggcacaggatgagggcttcctagacattaacattccggaatacagtcacagacctttctaaccacatccagtcatctaaaaacttctccaggacaacaatataattaaaaagtgcagagaaaccaaccagcaatgtaaaccctattaagatggcatagcacggctcataaggaaaatgaaaagggcttgggggtgtgcggggatctaagatcattaagcaaagtgaaagaattttaacagatttttaaatttaatatagtcatgccatgctaatgacagagacacattctgagaaatgcatccttgggcaatttcatcgttgtatgaaatcacagcatgtactcacaaaaaatctagatggtacagcctactgcacacctaggcaatgtggtatggcctattgctttgctcctaggctgcaaacgtgtacagcatgtcactgtactgcatactaggcaattgtgacacaatggtatttgtgtctaaacatatctaaacataggaaaagtacagtaaaaatatggtataaaagatttaaaaatggtacagctgtataggacacttatcataaatggaacttccatgactagaagttgctctgggtgagtcagtcagtggtgagtggatgtgaaggtcttaggacattactacttgctactgtagactttataaacactgttcacttaggcaaagtgtaagtttacatgaaatttacaaaaaaaatggttttctttcttcaataataaatcttagcttaagattagtaatttagcttagtaactttttaactgtataaactttttattttcttagaactttggactcttttgtaacacttagcttaaaacacaaacacattgtacagctgtacaaaatatctttatatttattctataagcatttttctatgcttaaattattttatttttcattttttaaatttttttgttaaaagctaagacacaaacccacaaattagcctaggcctacacagggtcatggtcatcaacatcactgtcttccacctcccacatcttgtcccactggaaggtcttcaggggcagtaacacgcatggaactgccatcacctatgaaagcaacgccttcttctggaatcctcctgaaggacctgcctggggctgttttacaggtaactttcttttttattaattagaaggaatacactctaaaagaacgatagaagtatagtacagtaaaatacacaaaccagtaacacatttattaccattactttattgtttataatcattatcaagtattatgccctgtatataattgtatgtgatagacttttctatgactggcatatagtaggtttgtttataccagcatcatcactaaaatacacgtaatgcagtaatgcacactgcagtacaaccttacaacagctacaagtctctaagagattggaattttgcagctccattataatctcaggagacccctgtgttatatgtcgtctgtcactgactgaatgttgtatgtggcacttgactgtatactatctgaaataacagcaatgctgaagtgctctaggaaccaacttaggttcctaatagaagatcaagttttcttctttgcctggtgcatgagtccagggccaaacctgagtttgtgcttatgttgtggaaatcaggaacagcctcaggcagtggtggggactgccaagctgacacagtcagaataacaaccactaacagtcagcatccatgaagtcactgaagtccttttaagttgcttatgaaggtgacttaaaatgatttccatggatgtgaggacatccacacttaggctcttctttcctcacttgtacgagaggtccctgtgtctaacgtaaatggagaagtgacatcatttattcaaatgccccacatacatccttttgttatttatttatttatttattattattattttgagatggagtttcgctctcgtcacccagggtggagtgcagtggcatgatctcggctcactgcactcccgggttcaagaggttctcctgcctcagcctcctgagtagctgggattacaggcgcccgccaccacacccagctgattttttgtatttttagtagagacaaggttccttttgttttaaacttcatgtgctttcattacatcctgtgaagttctatttaatactgaagatcacttaatgttcctaacttcaatcgctggtaatttttttttatttcgattctagtacaggttcagagtaaggaaaagagtccttttaattaactgacatgtgccaggcattcccttgattttagccttgcctttgggaggttgcaaaatttcaaaaaacaaaataaaactaaacaaaacgctcactcagaaggatgtgagtctgggaagaaattctgaaaatatacaaagttccacataaattctaatgaccccaaatgctcactaacccttcatctctctccgtagatgtccccagccctgtggccatctcctgcagggagcgatggcagaatgaggttgtggccatgcatctgatacacacaggtaggggacagcacagcagcttcctgggctttaagctaaaggtgtgtgttagtttctccatctgcaatggggttgggctaaacccaagatcaaggccctgcatttataattcttcatggacaactgatgttgtatactccccctggggcagaagtacctttttcaaatttcatagatgattcttgggcaggcagcataataacaaaacactgctgagcccattcgttctggaacggccttattatcacaccaggtgctgaaaatgtatatagttctaattgtaggatttgacaacatttatgaatccaagacaaagtgcttttataaattctccatggacagatccaacccaatatatttactaattatttactgattacacatgtccattagttccgaatgctttgctgaaggaagaaacaaagatgctgaatgctatttttaatcattttcaacagaaatgagaatttcaggttttctctgtgagattcacaagtggcacaaaaattatgaggttgaatggtttagcagtgatttcctaacattgctagtaaatgtgtttctccaaagtgattagtggcaactctgaagtataagacagtgtatgtgcagaatggcccatctgggccatggtctcttgtccttagagaatgttctgtttataaatagatcactagaatttgaggagctctattcatggagattcaacttgaagaaagagggaaaaaatccaacctactctcttttgttttagaaatcacatttagggagtggacagccatcctttcagtctaataggactcttagatccatccatttgacatagatttatgaagaacctccagggctcagtaccacacaacatgctcgatagctggcacacggagttctggaggctgcctgcaaggaacttacagtttagcagggatgggaagggagcaaagtcaattataacagagtagcaagtgtagcaacagagaaatgatgctgtgctgcaagtagggaccattaaatcatgttaggtgtgtgtgtgtcagaaaaggcttgctggtaagttaatgggagttggtggaagttaggggttgggaggcgggcagaaggagagggaaggaaccaagtccataataatcgggtcaaggagagatcctgaaggtagttgtggctaagaggggagtaggaaagtggagaccatgagcttggatccaagccagaagcacatgatgttctaaaaatggcagtgttcggtatgcaatggacgacgactggggaatctaaggagaagagaatgcagcacaatcgagcttaaggtttggaaggaggactcttggccaaagcggaaagggatgggtatgcaggaggggcaagagtgtatggagacatctgtaaaataaattctaatataaaatgctctgttagctataagcagtgcactgcttcccctcaatttttttcttaaagagtatgataaacaggtgatgctgaagcccaagaaacacttcaccctctagaaactgtatatgtcactgtttccataagggcagagactgtggacaagcacatgaagcataaacacatattttcaagccacttaaatagtgtgtgcccaagggcacattatagacaagccagcatttgcagcagcaggtagcagaggcagcttcctcttcaggaaacagacaccaaatcattagaaccttaacgctgtgtcaactttggctgccaaatatgcagctccataccaaatggtaccatttacatctggctctgtatctaagccaacttctttggctttaagaaaattctgaatttatacaatataatatgagtacatctgattttcattaggcagtctgcctgttctcctttttcacttttgaaatcacatttatatttcttattctcttccgttctactaaattttaagatatcactttactttttttgtttcttttttttttttttttgaaatggggtcccacccatttggtcatccagcctggaatgcagggtgtgatctcagctcactgcaacctccgcctcccaggatcaagcaatgcccccaacctcagcctccagagtaactgggaccacaggtgagtgccaccactcttggctaatttttgctatttttggtagagatggggtttcgccatgttgcccaggctggtcttgaactcctgagctcaggcaatccactcattttgtcctcccaaagtgctgggattacaggcgtgagccactgcacccagcccattccactttttctttatattcctttgaactttagtttttggtatcatggacacatctctcaaagctggtcagcacactccaagtacagaccagcaactgatggggtacgggaaaggcctggattgggtttttatatttacattcattgtttccaaattgcaatgcagaatttctgtataagaacaaaactacaaggaatctatatgactttaatcttccatgtcctgatgaacttttcctgatgagctagttctttaaaacatctcctaagagaatctaattatattatgtagaaaagcttctaaaactgaccatataggaagcttccatattataattgggatagaaatatatcatctagaaacaacagagattccttgggctaagagtcctatatcaatgtccacttgcaatattaaattttttccaaattcacaattcagaggctacaagttaaatgccaaataaaattaaactcagttagtagatttctttttttgtaaatagatgaggtctcgttctgtccccaggctgaaatgcactggaacaatcatagctcactgcaatcttgaactcctctaggctcaagagatcctcctgccttaacctcctgagaagctgagattaaaagtgcaagtcaccatgcctggacacaaatttcatttttaaagtgtgttttttttcatataaatattatatgtccagcattatttttaataaactggaatattttaaaatacatcttcaagatttagagtaaaatgtactggcttgtactacattttaaaatttacttttggtcttctggttatagtctactgaaggaagatctaaagcactgaacaaatggcaaaactaagctcttctgttatagcaatcctggggtttttataacaaaatgaacttcagacagcatgaaagtttcaatgatgaacaaatattgaacttttgtattttaatagcacaaccaatacttcattcctggttaactttaccttattttttaaaaaagataaattgtttaaaagttattttgtttaaactttaagtataaactggtgagcaggtgacacaaaactaatctactctgatataaatcagaatagtgagtacccattgggggacagtgaccagaagagggcatcaggaggcttctggggtcctggtaagaattgcttcttgatgtgctggttatataggtatattcaatttatgaaaattcatcaaaccatacgcatgctctgtgcaagttggcactggcaaaagatttaataattaattttttcatgtagcaattttctggttaaggtatacagctgaagaaaacaagacagatagggtaactgcataaaagccggagtaaacctgtgccttggaggtagcaggcgccacagcttcctccctccgcatgtggacagaagcagcacattggtgagaaagacatgtgcttagagaggcagaaaatgaggaagagaaacgttcaggactccaaagagtctatttagaggaaaaaaaaggtggtaggtgggggaaagtaaagatgacatgtttctttgtaccattttctcctcccacattccatttgacatcatgcagagatgttcatttgacatttctgggttgaagactatgaggggaatgcatcccatggaccagtggttactgactacaataccaccttcagaaagtttaggaaatcctcttatggccttctgtgattttcaagttggggatatagccaagatggcttcttgcagaccttcgatcccagaaggtggtttgggggcaatattccacctcagtcttttgtacctgaagttgatgaactctgacatgtgagattacatggagctgacaatgtcacatgaaagtaaatctggattaaaatattacatatacatgtatatacacacgatagaaggcctgcgagctccacaccttcgttgtgtgcaatgatgtcactcgcccaagcgtctgaacacatcagcacctatgagcttcttttggtaaaatttagtatctacctcccattctaccatcataaacaatggggcctgtgacttagtctctatttctcccccaccttagagactgtcagtaccaaatgaagaaaattttattttgaagtacacagttgaacatgccaagaggcttaaccacatctctataaaaatatttggttggcacctacacaagataaacaagagtgctcaaataccttactgcattcattaatccttattttctacccaccatatatacataaaacaaacaaacaaaaacaggtgtgagcaccttcctacaattctgttccctacaacctctccacacacacaaatctgaatgttacttaaaggagaaacaaaccaatcaatatgggtatgcctttcagttcagtgaggaacagttctaaggaacagccttgtgaccaaggtcctactgtctgggttgagcagggacctgaagggctgcaccctggtgcctggctggaggttgtgcccaccaccctgaaaattcagtggctattgcttaggtgctggatgcacacagtaattcccaaaccaaatctgtacgcccgtcacagttaaccctctgcatccgcaggttccacatccacagatgccacccaccacgactcaaaaacatttggaaaaacaaataaatacgaatacaacaataaaataccaataaaaatacagtataggctggcatagtggctcatgcctgtagtcccagcactttgggggttgaggcgggaggatcgctacagaccagaagttcaagaccagcctgggcaacagagtgagaccctgtctctccaaaaaattttaaaaagtaaccaggtgtggtggtgcccacctgtaatcccagttactcaggaggctgagtggggaggattgtctgagcccaagaaattgacgctgaggtgagccatgattgcaccactgtactccagcctaggcaacagagtgagaccctgattgtaaaagacaaagaccaggctgagcgtggtggcatgtgcctgtaatcccaacatttttggaggccaaggtaggaggatcacttgagtccaggaattcaagaccagcctggagagaacagtaagacccctatctctcaaatagaaataaaaaaacaaaaccagcgtaactgtttagatagaatctacattgtattaggtactataagtaacctagaaacaattgatttaaaatatacaggagaatctgcctaggttatgcaaagatactatgccattttatatcagggacttgagcatccatggattagggtatccatggagaatactggaaccaatcccctaaggatactgagggatgactatatttctacatcataaacccacctctcattttcaacacagtgtggtaagaacaagattgagctaattcgggcaattgaaagacagggatcgacatggagtaaaatgagtttgtttagttttacctgtaagacacacacattaagcacttgattatactcatgggcttccaaattataattgggatagatacacaccatctagaaacaaccaaggttccttaggccaggagtccttccattaccccttaagaggcacattgtgtaatacagtctaaagctttcctttcacccacttctggttctacatcgaataccgtgcttaacagtcatgagacaatactgaaaaaatgccaaacaaaaaaaattaaccctgcctcttctgtgtatgtatccaatggtgatatatggggtattagtgggatatgatgataatacagcatgatgtgttttaactctgtggggcaaagtgtagagtgaagcaagtaacaaatgtttagatttaacttacggaagcaatcacattattttaaagccatacctttctgacactttcctactactatcaattcaactttggaaactctcccacctcaaatagttaatgaaataacctacttaaaggcaccccatgaatgttattctaacatatcaagtattgactcaggccaattacttaattagttcaactttcccagctactaattttgaacatcaggcagaagaatgttttttaactaccctgtcactcagagggggtaagctgccctttaaacaacagaaattatagaccaattatatatatatctattatagaccaattatatacgtatctaatgtatataatagaaattatatattagaccaattatatattattatatagaccaattatatattattatatagaccaattatatattattatatatacatatagaccaactatatactattatacgtatagatcaattatatagacaaattatatactattatatatagataattaatctatatataatctataaactataatatatacattatacatatagacctatatatacatatagaccaattatatactattatacttacagaccaattatatactattatatatatacatatagaccaattacatactattatatacacatatagaccaattatatactattatagaccaattatatacatacctaatgtatataataaaattatagaccaattatatacatatctatacatatattgacatacttttaaaagaaaaccatattacacttgtctatttcccatttattcataaattatttaaaatttaccttagaaattagagcatataattttcttttaaaataactcttaggcttatggttttaattattttgcctatgtctatagtgattaaaagacactataattcagggcaattccaaatagtcacctgctttccagaaaaaagattgaataacctatagtatttggtgaacttctggctgacctaaaacatctcaagtggttcatctctgtcatcacagagaacagctaaccaatatgtaggattccagtcatcagcctggggccaggttccccgaaggacctgcctgagaagacaatctcaaaagttagtctcaacagtcaaatgcattctgcatttcaccaaagggaccaagggagtagaggttcttgcatgttgagcatgatgtctgctattgtcataaagaacatttacacaaacattcacattcacatatatgtacacacataagtatgttttccatatgtatcctatttataataaactaagagaaagtttaaatcttaaacatttttgttggtttctcacaagccatgtaatttggaagataaaattttcccagagataagccacataggaaaaagaatgttcttccttcagttggaagggctaggctcttgtcctgactttgttagtcaatagccatgaatcccaacaattaatgctgaagtatcctaattcaagttcccactcctgattgctgatgtaacaacacataatgcaggaatttattcctctggtacctacttgcaagtgtgtgaatgtgtctgtgtgtgtatgtgtgcacatgtgttcttttgaaagacattcctctttttcatatgaaaatttcttttatttatttctttattttctgagatagggtctcactctgtcacccaggctggagtgcaacagagtgatcatgactcactgcagcctcaaactccagggctcaggtgattctcccaactcagcctcctgagtagctgggactacaggtgcatgccctcacacctagctaatttttgaaaatttttttgtagttatgggggtcttgttatgttgcccaggctagtcttaaactcctgggctcaagcaatcgcctgcatcagcctcccaaagtgttgggattataggcactgcaccaggcccatacagagatttctaatggggtatagtttccctaattttaaaatataatttacatagcaagatccctcttctaacagtacaaacaaatccattcatttaatcctaaatgtacagttccattttgtaactgggttagctctatcatttagaaaacaaatcccatattaactgtacttttttctacccatttgaggtcagtggcacaattatgggtttttggcacatagcaatatacttacatttcagaaaagtcatcattacactttcaaagaagctacttttacattttacttctgaataatgaaagctattggattatctaagagacttaccctttcccatatttaatttaaagctaagtcattttagaaaccacaattaccaacatgcaagaacctctacttgaaaaatttgtagaatttgaacatggaaaaccaattgttttaaatttaataaagcatttttctctcgggctcaaacagtagaagcagcccagagtagaacttagtgtgaattataaacttctgaaaacaaagacttataatcaagatattgcagagtttttctttacagtgtattctctaatgctttagccaatgtatttttaaatgtcccaggagactactttttgaacttgctctccttaccaacccagtaactcaaagcagatggatcattttcttgaatcttagcctaaatttttccttggaaatttcacttgatatgacatgcttcgtatcagcccaaatttcattctaataatgactgcctggatattccacatttcatagcccatttttaagttgcagcttaaaaccttttctgcttccaggttctgatgaacacatgctttctgtatacatgggctccctgacatcctcttccatcatatacaatcttccccatccagcaggctcagcctgatttgaggacatgaaaactgatagtcttagttggtctctggccccacacaattacaggagttgtcattcttgttttcctctgttgaggggatctcagtctaatagcatgggttttggacacccagacacaggttcaaatcccagttctgccaaggcactttaccttcctgaggttcagtcttctcgcctgtaaaatgggcacaatgatacctcccaggattgtggctaaagtacactttgataatctgtgcaaagcaaatggcaggatgtagtacatcataagtgcaaattagttactattattattctttgaattactaccatctcctgaggctgcacaggaattagcttttaagtatgccacaacttacaattatcagttttgtggaatctcacaccagaagacatgtgggaaaggatttaatataagccttccttttccagccttggaaactgagctctgataaggctgtctttctccagtgctggtcgctgcagaagcactggccaatagctttcctttgctctctaagaaagtccagtgcaaaactacaaacctagccttcacatgcttctagctttgtaaagccactgcatgccttcaatttggacttcttccctagacaagaccacagagggcagcagaagccaggatggcacagaacagttccgtccagatagaagtcctccgcagtgggcagcatgcctctgatgtcatttccatacacagaacaattctcccaaccaaccagtaggccctgggtactgtgggataatcaggaacctgcaggtggcaaagtgaagataatagtcacaactgctgggaccctgctttcaccagggctaggaccaatgctggagctggaccagatcaccaactcctgcaaagccttaggactgcccaggtcatacttcatcccctttaaatgtatttcacctgtggactaggtagatgccaagtattttgaattgcaactgttcccctatcaattcaatgggaggggtgggaggtggctgggaccaagcaagggtaaatttcaaattttgtaaggggcataataaatccgtgtttctctaacactgatatcttcgcattgtgtacttaataacatttagaaagaaatttctcaaaagttggaaggagagctttcggaaaaatggtaggtatattaaactgaaaatgtggtaatccactaacagtggctggtcatctacagcccattcagtgtttggcattgatatcaaaaattggtgtaagaacattgaaaatttctgtgcaaatatgcatctgtgtttcccttccactttccaaaattagtatataattatatgcaattgttacttttatagtcatttgggaatttcatcccattttttttaagggatgagatttcagatttcaatgcttagaaaatcaaagcttaacatacacctgccatgagggtactatctgattcccttagacatttatgcatgctgaattaagtacttaatttaatttaagcaattaaattttaagatcatattacagaaaatccaggaaaagaaaaaactcaatcaatcaggaataacacaatacatttaaagagcaaatgcattaacaaagactgtccttattatcatgcataagatatttttattcaaagtctcacccatgaggtagcaatctgcaaactaattaagagcttcccagaggacaaatatctccaagtttttggaaaggaacctatcatttatttacctaagaaggagtggcagaagcctagaaatcagtttgtctttcagaaaagatttaatcatttgagaaatgcttggataaattctaaacctggagggtaaaatttcagtcagtatcagtataagcaatagaccagagcctcacacactgaaatcatctcagaaagaagagaaactcgggggtgggggggtggaacctccagaaacaagcacgtacaggaattttttcagcagtcccttcgctatttaatctttgctggctggattggccacaactccctagactcaacttatgtcttcaccccacagagtaaaccttttccctcttaattatcctcatcagaaactcaacacagataactgccctcttctgcataataaatcattcacatattttcaaatgttaaattgtctcaactttgaatcctctagtctaaaaatcctgaattttgtatccttgcttcctagatcctgtgcaccacatagcaaactcaccaaatgttggtccttgctctgacctcactctttccaggagtatccatccaaagcctctctaaactgtggagctcagtactccatataaagcagtgactcctatcacaatctctacaagacatttaactcaaaactccagaagctttcacagcaccaagcaaaaatgtaagatgctaccatttgtatctattgcggcaaaaattggatagagtgcctttttaactttgcagtaaaattcaaggcacttcacctattattttagactttcatcagttttgagcacaatatccattcacctttgccaacagtttcttttaatgcattagtacaaaattcctcaagtggtatataaaaattttggttgtcagttccagaaaaataatgggggaaggagagtgggtaaaaacaggttcaaggccacacatcagttttccttttaaaaaaagttttaaccctaaatttgcagcgcatatatatatatatatatatatatatatacatacacacacacacatatatacatatgtgtatgtatatacatatacatcatatatatatagcacttcactttattggaattcttccttggtcataaattatatttcaagttggcaaaaaatgttgatcagaatttcaaaaaagggaagcatcaaagtaaccagcatggggtttttcaagtgtgcagaaagttctctaaatacaaaatgtgcttccagcccaccaaagacccccctcacccaagcaggcagtcctcggcgaggagggtcagcatgcccctttatggtcagaacggcagtggtgcaaaagacaatgatttcaaccaaatatggtttgcctctcgccaaatttttcgcatgtccaataaaaataagttcacaaaaatccagccaagcattactttccccccaaaagtgcttctcagattacaaaacagctttgaaagttcagcctgacaaaacaaatatggtactaggaggagagacctggaaggcaatcacaaaaagtctcatttaaattcctggaaagcacagcttctccaaacacagctattcagctctttggaaggcagcacttgcgggagccattgagtttaacttcactcagtcccccaacacagaaccggcaaatccgaatgagatggacgtcacactccctactcaaaagaatgcatcaaatatccactccgtaacaccgcggaaagtaaacccaaaagcggagtttgccgcctgccaactacataagaattaacactcgggtatttaggattctaaagatccctactaccccaaacattatagccacagagaaccagaaatgaacagaacacactttaacctttaagaagtgcagttttgtacgggggttggctgaagaaagacaaaaatcttcactcccttccagagccaaaagagccaaaataaaagatcacctttactgagccacaggggcacaactgtatccgcccgtccccaaagcgcaagccgtcctcccgttcgcttctccagaatttcctgcttttccccaaaccaccttcaacattccccacacacgggtctcgctcctaaacacggagtgtaactccgcgcacagcagcgcggaggctgcagcgccaccaagaaaggcgtcgccaacccttacccagtgccctcccttaccagccttcttcccacgccgcgcctcgaagcgcacgacaccgtggtgctcggtgctccccctggcagcgcggcactggagtccaaggcgtgcgtgtcacattttattccccggcagccgctcgggtgcgcgcgctacgcgctcccacactcacgctggcgcccgctagagctgggaccctggccggggtccccgactcacgccgcggaacttgggggctgcagaaggcgagtgcgcggcgggagtcgtcctgccgcaggctcgagtcctcctcctgccaccgtggggtctcggagctgccccgcgctcccgtcccaggcggcctgcgggatcacctctccggggccagcgctgctccgcgccggcggcagctgcaagcgcgggcggcggggcacagcgggtggctcggcctcaaagccggcgggaggctacgctcagccccgcgctgcacgcctcattgtttcgggcagcgcggcggcggctcccgcggccagaggaaccgcggccccgagccccggggagaggcggcggttcccggcccacgcaccgaggctgcgccgcgccccgcccccgagctccgctcgccccagagccccctccctctccgcgatccctttcatccttcccgctccaggctcacctagctggcgggagccgggcactgggaagttgggctgccccctccccgcgcccccggcccggcagctcggcccgccggcgagcgcaggcggggcgctccctggctgcgcgcggatttctgcttgtcgcggagagtgactgcagacttgggctgcgtggggcggtgcggggcagcacggctgcctaaaaaggcgtgtttctccccggccgccgcctccatccagccctagttcttccgaaggttacctgcacagtacccgcctggcaccgcgcctggacacctccggggcactcgggtcccgggcggcggcaggaatgcaggaatgcgcacaggctgtgggcggccaggagggagtcccggcgcctgccccggcggaa

SEQ ID NO: 1621 - DNA, 41323 bp, Homo sapiens
atccagaccttttcttcagaacctttttattcatcatctaaccaacagaggtggttggctcgaactcaaactaaaatggcctcaaaaggcccacctcgttacgacatgacagggcaaaaccagaagtagggacagagtttagcctcagttctctgcagagaagaccaagcatgtatttacacacaggtgcctcattaagaactgattggcaatgttccaccagcacagacccagagtgtgcagaaatccgtgggggctctgtatatgtgtcattcagacaatccgccgattcctcagccataaacaagctcttgctttttgggaggagggtgatcagcatgttatcttgaatgatggcaccatttgtttactctggaactttgaaggggaggtgacaacttattttctcccctgaatctgagatgcagtggcctgtcagagtatctaaaaatgtgtcctggaagacaggtggtggtggttgccctaacagagagtttacagggtaattgtgttgggctctttcagtacttaatcctgctgtttttcagaaaccctttgcacctgggccccatggagccagcagggccccatggagcatcccacaggcctgtgagtgaagtgcctctcagagcagtcacccagggaagggaggagggcagggaacggggccaggggagatgcagggacagaaatcagcagaaacactccatgctggttctgactcgctccatctcgtgcaggaagctgtagaactgaggcaaggttaattctggggagagaaaattcagcttcagataaatgtttccaactccacagaatcatccaagaaaattaatttccacccggaggattttttttttcttttttggcttaatacatctaagcagctcttgatgggtaactgatcataataaagaactgagagacttgaatgcagaaggttctctgctccaaaggaaaaaaaaggggagtgagtgttcaaatggcacagctccatggcacaaagagatgaaagggtatcattcgggatgttcaatgtgacttctatggcaagagcttcttgctcgtcaaccttcttcttcaatcccagccattccgttcccaccctttccctttttcaaaacggctcttcaactgtgggggctccaacctgccagtggctttctaacactccttgtgccatctttcaggagaggaaaggcagtggaacagctactccacagctggcaatgactgtttttatagaagacatgatttgtggtgagcgtcaccagcccctgattgcagagaacacaaaaaaggtgaagaggctcaagtgggaattcagactcacctatatacacattttcggtttgatttcctttcttaaccaccaactttagctgatgaaagaaaaagaaataatttaaattaaaatgatgacaactgggcaaagaaattcttaaaaccctttgacttaattaagcttccaacctgagagtcatacaggagcagtctggatcatccaccaccgaaaattctaacaattcccatgattacaggaacaatcacgcatcaatgaataacactaggatctattcatctaaaagtaggcatgttagtgactacatctttagctggccacactgctctgagatatataaggtacttcagtaaaacatccatttaaatatccatttaacccaatgtagatataatttttaaccaagtcaaaaatctacccattttcaaggatcaggagaagacttacttgtaaaaatatacttcccactttctccaattcgctgctcccagatgtcactgtgacaaaaaaaaaaaaaaagagagagagagagagaaataacaagtgactgattgaggactgaccctgaagaccccagttttgcagctgtccagcagaagccatgtgggggcaagtatgagggcagcaaggtgtgcttttggaaagtcaacttatccagagccatgaaacagctactgaatgtggacagaatacaaaacagcagctgctgccccaacagtgctagggactaggtcatgccttccccatagtggctgtgtcacagcctctgcaccccaaccctgtaccacccaaataacccaggactggttgtaactagttacctccaaatttccactccatatctatgagctggttaatcatcagagtctgacctatggcccatcgagcaagggtgggagcattctgcttccactggaacaaaagcaaaagacaaagtcaattacaataggaaaatctccccctctccatcctgccctaaacattgcaatatttagcattgacacagatagtggggagggtgcagaagatagtggggagggtgcagaacgaagggctcagtctatatgcacatacctagggatggaggagggcacagagtggcagaccacaacattaatgttgtatttttcattccaagatttaatccatcttggaaaaaaaacagtgctgccatcatactggcccccacatggcttctactagacaattgcaagatggggtcttcagggtaagttctcaatcagtcacttgttatttttctctatttttgtcacagtgacatctgagagcagtgaattggagaaaggaggcatatatatgtgtatatatatacatacatatatatgtatatatatatgtgtgtgtgtatatatatatatatatatttttttttttctttgagatggagtctcgctctgttgcccaggctagagtgcagtggcatgatcttggctcgctgcaagctccacctcctgggttcacgccactctcctgcctcagcctcccaagtagctgggaccacaggcgcccaccaccatgcccagctaattttttatatttttagtagagatggggtttcaccatgttaggcaggatgatctcgatctcctgacctcgtgatccgcccgccttggcctcccaaagtgttgggattacaggcgtgagccaccgggcctggccagtaggaggtatatttttacaagtaagtcctctcctgatccatgaaaatgggcagatttttgactgggtcaaatcaggagaaatgattagagatacactgaatagtgctggttaaagctgtgtgtatgacatgcgcttgaagccagatgaaaaccttaggctggggaaatgatgatactgataggtggtttggccttacttggcatttcccattgttttctctcttcatgatataaaagcaaggggctggcggtggtggttcacgactgtaatcccagcactttcagaggctgaggcaggtggatcacctgaggtcgggagttcaagaccagcctgaccaacatggtgaaaccccgtctctactaaaaatgcaaaattagccaggcatggtggcacatgcctgtaatcccagctacttggaaggctggggcaggagaattgcttgaaccaaggaggtggaggttgcagtgagccgagattgtgccattgcactctagcctgggcaacgagagcgaaactctgtctcaaaaaaaaaaaaaaagaaagaaagaaagaaagaggtcgagcacagtagctcatgcctgtaatcccagcactttgggaggccaaggtgggtggatcacaatgtcaggagttcgagaccagcctggctaacacagcgaaaccccgtctctactaaaaatacaaaaaattagctgggcatggtggcatgtgcctgtagtcccagctactggggaggctgaggcagaagaatcacttgaacccgagaggcagaggttgtggtgagccgagatcacactgccactgcactccagcctggacagaatgcgactccatctcaaaaaaaaaaaaaagaaagaaaagcaagggatcttaatcagccattaaccttgattaagaggaattataccttttcagaaaagtaagtggctttctcctcactaagacctataagagaacagaaggagatattaacataataaaaagcctcagaagccagtcaccctgagcaaccctggccaatgacctacccagagttatgaaatccgcctggacctgcttggctgtgagactcttcttcaaagcacctgggaggcaggggagaaatcagttagaaaggcagaccagtgaattagtcggcaataagtatttaatgggcacaacctatgtgacctaaaggacaaaaggaacacccaaagactggccagctccaagatctcaatccagccatggggaaatagcatccgaaatgaccagaaaacaagaaagacagtacattttacaatttatttattttatttaaaaaatatatttatttttgccgggcacggtagctcaagcctgtaatcccagcactttgggaggccgaggcaggtggatcacgacatcaggagatcgagaccatcctggctaacatggtgaaaccctgtctctattaaaaatacaaaaaaaaaaaaaaaaattagccaggcatggtggcaggcacctatagtcccagctactcgggaggctgaggcaggagaatggcgtgaacccgggaggcggagcttgcagtgagccgagatcacgccactgcactccagcctgggcaacagagcgagactccgtctcaaaaaaaaaaaatatatatatatatacttatctcaaaatatatatatattttttgagacggagtctcgctctgttgcccaggctggagtgcagtggcgtgatctcggctcactgcaacctacacctcctgggttcaagtgattttcatgcctcagcctcctgaacagctgggactacaggcgtgcgccaccacaccaaaccaatttttgtatttttagtagagactgggttttaccatgttgaccaggctggtcttgaactattgacctcaagtgatctgctcaccttggcctcccaaagtgctaggattaaaggggtgagagccaccatgcctggcacatattttttttttaattgtacaacacaattatttatccctccaaccagtgtgagagaagtcagagacaacagaaaagacttcacggacttggggatggagcaactggtctgaggaatgagtaaggatacgaattcctggagcaagaggcaggggagtgtaatgtcaggttgggcacagggggcaaccacctagagctccacaatgcattatgtagccactattgcatgtggttatgcaaattttaattaaataaaatttaaaattccattcctcagtctcactagctatttcctgtgtcaaacagtcacacaaggccagtgaccattatactgaacactgaagattacagaccatttacatctgcaaagaaagttctattggatggcattgtcctaagaagttagctttcacacagtacaccaagatggactaaacagactaacctctacaattcacaagtcacttccagaggggctgtcaaaacttctcagaagccctaggaacacttccctgtggtggtcaccttgttttgctaggctccaattcctgaaaacaaagccagcaatctgggcttctcaatgtttaacctgcaggctacatccccagtcacaatttggcaaccactctcaaattttccactttttagttcaccagaaaatgactaattaaagaataggaagatgccaaccaccatcaagggaaggccctgaacctataccctaaacccaagtccccacccccaactcactccagaaaaacaatcctaaaggctgttgtaccggtaaaatcaaccatataaacaaagggaggaaatcttttatctccaaaatcagactgagcaaggaagccacacggaataaaaaaggcaagaccccgggaaaccttagccataaaggccctctgagaaggtggctacttcccagccaatccaaataactcctaactaccatgaatacagtgtcttagtttatatccaattcaaacccaatgctttatttgacaatccccaaacactgggctttattattgtaactttttttttttttttgagacagtgagacacggtttcactctatcgcccaggctggagtgcagttgggcaatctcagctcacctcctaccacaccggggtgggtgggtggggctcaagcaatcctcccacctcagcctcccacatagctgggactacaggcgtgtgccatgatgcccagctaattttttgaatttttgtagggacagggtcttgccatgttgcccaggctggtctcaaactcctgacctcaagcaatccacccaccttggcctcccaaagtgctgggattacagacatgagccaccatgcccagctattattttaacttagtttaccaggaaacattaagcatttttgggagaaaatttggcaaatgcagatagtcaagaattgcactgccaagaattcacccaaccaagctgcacccaaaagcacgctgagatatacaggggaagctctttagcaatgtggatagtagggatgaaaggtcatggagagaccaggcacggtggctcatgcctgtaatgccagcactttgggaggctgagggggtggatcacttgaggtcagtagttcgagaccagcctggccaacgtggcaaaaccccgtctctactaaaagtacaaaaattagccgggtgtggtggcatgcgcctgtagtcccagctacttgggaggctgagggtgcagtgagcagagacggcaccactgcattacagcctggcaacagagcaactctgtctcaaaaaaaaaaaaaaacaggctgggcgcctgttacaaaattagccaggagggtgaggcaggagaatcatctgagcctggcaggtggaggttgccgtgagccgagatctgccactgcactcaagcctgggcgacagagcgagactccgtctcaaaaacaaacgatgacaaaaacaacaaacaaaaacctcaggtcagaccatgctattttttctgctcaaaaccctctactatctcctatttcactcacagtaaaatccaaaggttgtacaacaccctgcatgctctggcctcctcttagaacccctaggctctctcccttgcttactgtgctatttttagaatatgccagacagctttctacccctggccatttgcccttgcagttctctgcacatagctcatcccttcgcttcattcagggttctgcctgactcttacctcctcagaaaggatccccgaccattctatttcacattttttctttttttacttttttttttttttaatctcattctgtcacccaggctggagtgcggtggtgtaatcacggctcattacagccttgacctcctgggcttaatggatcctcccacctcaggctcctaagtagctgggactacaggcatgctccacaatgcttgactaatttttaatttttttttctagagatagagtctcactatcttgccagctcaaactcccgcactcaagcaatactcccaccttggcctctcaaaatgctgggattacaggcatgagctgccaatcccagcctcattctaatttaaatagcactgccctttactcatactcgtataatgctgtgggatattctgcattgcatttataactacccaactttatgttatatatttattatcaatttttccactagaacaccagcttgataagaacaaagactaggctcattttgcctactgctgtgtcccaagctctgagagaaatgcctggcaaagtttattggttggcactcaataaaagcacgttgaatgcaagaatccttacaatggattgctatccaggcttaaaaaaaattatgtaaggccaagtgctgtcatcccagcactttgggaggctgaggtgggaggatacctgagcccaggggttcaagaccagtctgggcaatacagggagaccccatctctacaaaataaaaaaattagcaaggtatagtggcacaggcctgtggtcccagctactcaggaggctgaggtgggaggatggcttgagcccaggaggttgaggctacagtgaaccataattgcatcactgcactccagcctatgtaacagggtgagacctcatctcaaaaaaaaaaaaaaaaaaaatagatgtagctcagtagctgttgatggaccaatctgcataatataatgtcaagaaaaaaaggaaaggcacctataatcccagcactttgggaagctgaggtgagaggattgcttgaggctaggaatttgagactagcctgggcatcatagcaaaaccctgcctctacaaaaataaaaataaaaaattacttgggtgtggaggtgcacacctgtaatccagctgctcaggaggctaaaataggaggatcgcttgagcccagaagtttgaggctgcagtgagccatgatggcaccacttcactccagcctgggtgacagagcaagactctatctctaaaaataaataaataaaaataagtgttactttggccgggggtggtggctcacgcccataatcccagcactttgggaggctgaggcgggtggatcacttgaggtcaggagtttgagaccagcctggtcaacgtggtgaaaccccgtctccactaaaaatacaaaaattagctgggcgtggtggcacacgcctgtagtcccagctacttgggaggctgaggtaggagaatcgcttaaacctgggaggcagaggttgcagtgagccgagatcacaccactgcactccagcctggacgacggagtgagactctgtctaaaaaaaaaaaatgttacttaaaaaaaaaaaaaaaaggaaacagttaaaggaacaaggccacaacagtcagcaactgacagagccaagtggcttataggccagagggtccccacaccaagttctttctacaccaggtcattctcagacgctatcttggtgctgcggtatcaggcaatgccttgacagttgctgacaatgaagtcaacaaagctgcagggatggaagagcaagctctccatcctgaagttacctctggagggcagaggccagacttgaaacatggattggcatcatgctaggcctcaagctcttaacttctttttcagctttttcctgtggtgattcctttgtcctaagcaaatgccagccacaagacagacctgcaacatttgaccttatgtcagacagaatgaaaattgtgtggggcctcttggagggtggggtggggggagggatagcattaggaaaaatagttattccatgctgggcttaatacttaggtgatgggctgggcgtggtggctcgtgcctgtaatcccagcactttcggaggccgaggcgggtggatcacaaggtcaagagatcgagactgagggctgggcacgatggctcatgcctgtaatcccagcactttgggagtccgaggtgggcagatcatgaggtcaggagttcgagaccagcctgaccaacatgatgaaaccccatctctactaaaaatacaaaaattagccgggcgtggtggcaggcgcctgtaatcccagctactcaggaggctgagacaggagaattgcttgcacccgggaggcagaggttgcagtgagccgagatcgtgccattgcactccagcctgggccacagagcaagactccgtctcaaaaaaaaaaaaaaaaaaaaaaaaagagagagatcgagaccatcctggacaatgtagtgaaactccgtatctactaaaaagtataaaaattagctgggcatggtggcatgcatctgtagtcccagctacttaggaggctgaggcaggagaattgcttgaacccaggaggcagaggttgaagtgagccaagatcgcgccactgcactctagcctggtgacagagcaagattccgtctcaaattaaaaaaaaaaaaacctaggtgatgggttgacaggtgcagcaaaccaccatggcatactatgtaacaaatctgcacaccctgcacatgtaccccagacctttaaaaaaaaaaaaaagaaaattgtgtaaactccaacagctgcagtcagcagaacatgacacgtggggaaatttaagaacatccttcttcaaacacagataactttgagatggtcccttttttttttttgacacggagacttttttttttttttttttcgagacagagtctcactctgtcccccagactggaatgcagtggtgcaatcttggctcactgcaacctctgcctcccaggttcaagtgattctcctgcctcaccctcccaagcagctgggactataggcacgcaccaccatgcccggctaattttttgtatttttagtagagaccaggatggtctcgatctcctgacctcgtgatccgcctgccttggcttcccaaagtgctgggattacaggcgtgagccactgtgcccgtcctctttcttttttaatttcttttttttttttttttgagacagagtttcacttttgttgcccaggctggagcacaatggtgcaatctcagctcactgcaacctccgcctcccaggtgcaagagattctcctgtctcagcctcccaagtagctgggattacaggcatgtgccaccatgcctggctatttttttttgtatttagtagagatgggctttcaccacgttagtcaggctggttgtgaactcctgacctcaggtgatccacccgcctcggcttcctaaagtgctgggactacaggcgtgcgccaatgcgcctggcaacaggcaccaattttcaccagaactgctgccttagccaaaccctcaaagctgtcaaacaatatgaaggacaaaacaaagggaagtgagggtgacgacttcagttttgccaagacggttggaaaaacagcaaacattgttcttattcagtgtacaaatgggagcccaaggaatggacacaggcttggtgaaaactcctggaagcagatgggagaggatggagagctgctttcatccagtcagtactgaccctgaaggctgaccagctgaagccaccctgtgaggctcacagagaacagaggtccgtagtcacacacgcacatttactgagcactgccatgtgcctgcactgtgctagatgctgggaaacatcaatgaactgaacagacaacaatctctgcccttatgaggcttccattctactggcaggagaaagaccacagcaataacgtaaaacataagccatacagggtataagaagggggaggctgggcatggtggctcacgcctgtaatcttagcactttgggaggccgaggcaggtggatctcaaggtcaggagttcaagaccagcctggccaacatggtgaaaccccatctctactaaaatacaaaaattagctgagcgtggtggtgagcgcctgtaatcgcagctacttgggaggctgaggcaggagaatcgcttgaacccaggaggtggaggctgcagtgagccgagatcgtgccactgcactccagcctgggcaatagagtgtgactctgtcttaaaaacaaaaacaaaaaaacccccaaaaaagaagggggaaagtgccatggagaaaaatagtagggtggtgcatgaggctggcggtcctggggaatttagttcaatgtttgattaaatgccacttatgactacatttcattgctgattattcttttttgtgtgtatgttgctaaaaagaactcgttggggagtggggaaggggagttacctccttttcataaaaaaataaaataaaataaaaatcagttacggatcacccacaggggccagatatcttgctaagtattaaaataaaaatagggccgggcacggtggttgtaatcccagcactttgggaggccgaggcaagcggatcacctgaggtcaggagttcgagaccagcctggccaatatggtgaaaccccgtctctactaataatacaaaaaattaaggccaggcacggtggctcatacctgtagtcccagcaccttgggaggctgagatgggcagatcacgagggcaggagttcgaggccagcctggccaatacggtgaaacctcgtctctactaaaaatacaaaaattagccgggcacggtggtgcatggctgtagtcccagctactcaggcggctaaggtagaataatcgcttgaacctgggaggtggaggttgtagtgagccgagatcgtaccactgcactccagcctgggcaacagagtgagactccatctcaaacaacaacaacaacaacaacaacaacaacaaaaattagccaggtgtagtgcgcatgcctgtaatcccagctactcaggaggttgagaggcaggagaatcgcttgaacccaggaggcagtggttgcagtgagccgagactgcaccactgcactccagcctgggcaacggagtgggactctgtctcaaaaaaataaaaataaaaataaataaataaataaataaataaatgaaataaaaataggtgaccaagcagggtggctgagcctggggagatcgaggctgcagtaagcagagattgtgccactgcactccagcctgggcaacacagccagacctagtctcaaaaaataataataataataataaaaaaacaggcagccaggctaggtggctcatgcctatatcccagcactctgggaggctgaggcaggtggactgcttgaactcaggagttcaagaccagcctaggaaacatggcaaaaccctgtctctaccaaaaatacaaaaattagccgggagtggtggcatgcacttgtggtcccagctactcgggaggctgaggtgggaggctcactgaagctcaggaagtcaaggatacagtgagcagagactgtgccactgcactccagcctgggcaacacagccggacccagtctcaaaaaaacaaacaaaaagaataaaataaaataaaaaaacaggcggccaggcgtgatggctcatgcctatatctcagcactttgggaggctgaggcaggtggactgcttgaactcaggagttcaagaccagcctaggaaacatggcgaaaccctgtctctaccaaaaatacaaaaatcagccaggagtggtggcatccacctgtggtcccagctactcgggaggctgaggtcggaggcttactggagctcaggtagacaaggctgcagtgaactgtgatcatgccactgaactccaacctgggtgacagagcgagattctgtctcaaaaaaaataaattaatcaaaaataaataaattaataaattaattaaaaacaggcttaaatagtggccctactgccaagttatctgtaatctcagctaggagataacacataataataatgacaatcataatattagcagcagtgtgctaccacttagtgaagtgagcaccttattacatttattatctttatccttataataaaagtatgagtctactattagttctcaggtaccattgggtctcagagctgttaaatccctggtgagtaagcaagcacagaagggccacccagcagccacgtgctggactggagtcctatctagatcctgatgggaacccattccaaacaaacaaaatacaggagacaatggggaaattaatactgaccttgtattttccttttagatatgataatggcattgtagtttgataagggggaaattcctttttttcttttagagatagacaactaggtattcaggaataaagtatgtctgatattgcctttaacataatccagtttgggccgggcgcagtggctcacacctgtaatcccagcactttgggaggccgaggcgggcggatcacgaggtcaggagatctagaccatcctggctaacacggtgaaaccctgtctctactaaaaatacaaaaaattagccaggcgtggtggcaggcgcctgtagtcccagctacttgggaggctgaggcaggagaatggcgtgaacccgggaggcggagcttgcagtgagccaagatcgtgccactgcactccagcctgggtgacagagtgagactccgtctcaaaaacaaaaaaaacaaaacataatccagtttgcactgggcatgttgcccacacctgtaatcccagctactcagcagactgaggtgggaggactgcttgaggccaggagtttgagactagcccaagcaacaaagcaagacccccacatctctaaaactaaactaaactaaagtaatccagttcagagagcagtaaggagccatgggtggggtccacatgaatcaatctggccatgggttagtaacttttttttttttttcataatatggactctagctctgtcgtccaggccagagcgcagtgtcaggaactctgctccccgcctcccgggttcagcctccaatgtagctgggactacaggtgcccaccaacatgctcgactaattttttgtatttgtagtagagatgtggtttcaccgtatcagccagaatggtcttgatctcctgacctcgtgatccacatgcctcggcctcccaaagtgctgggattacaggtgtgagccaccgtgcccagcccgggttaataacttttgaaggattttctttggtttgttttttagagacagggtcttcctccgttgtgcaaactggagggcagtggtgtaatcatggctcactgcagcctggactcctgggctcaaggtatcttcctgtctcagcctctgaagtagttgagactacaggtgtgcaccaccatgcccagttaattttttttttttttttttttttaagacagagtctcactctgtcacccaggctggagtgcagtggtgtaatcccagctcactgcaacatctgcctcccaggttcaagtgattttcatgcctcatcctcccaagtagctgggattacaggcatgtgccaccacgcccagttcatttttgtatttttagtagagacagggttttgccatgttggccaggctggtctcaaactcttgacctcaagcgatccgcccacctcagcctcccaaagtgctgggattacaggcgtgagccaccatacctggccaattttttttattttttgtagaggtagtgtctcattatgttgcccaggctgttcttcaactcctggcctcaagagattctccccctttgacttcccaaagtgctgagattacaggcatgagtcattgtgcctggctgaagtcaggtgtttcaaagaattacatactaaatagtacaagaaaaacattttttaaaaaaggcaaaaaaggccaggtacagtggctcatgcttgtaatctcagcactttgtcaggagtttgagaccaccctggctgacatggtaaaaccccctcttgaccaaaaaagaaaaaaaaaaagagcctggcgtggtagtgtgtgcctgtaatcccagctactcaggaagctgaggcaggagaatcatttgaacccaggaggtggaggttgcagcgagccgagatcgtgccactgcactcgagcctcggcgacagagcgagactgcctctcaaaaaaaaaaaaaaatcaataaaataaaaaggggagccgggtgcggtggctcacgcctgtaatcccagcactttgggaggctgaggcgggcagatcacaaggtcaggagatcgagaccatcctggctaacacggtgaaaccccgtctctactaaaaatacaaaaaattggccgggcgtggtggcgggcgcctgtggtcccagctactcgggaggttgagccaggagaatggcgtgaacccgggaggcagagcttgcagtgaaccgagtttgcgccactgcactccagcctgggctacagagcgaaactccatctaaaaaaaaaaggggggccggacgcagtggctcacgcctgtaatcacagcactttgagaggccaaggcgggtggactgcctgagctcaggagttcgagaccagcctgggcaacacagtgaaaccccgtttctactaaaatacaaaaaatcagctgggcgtgacggcatgggcctgtaatcccagctacttgggaggctgagacaggagaatcgcttgaactcaggaggcggaggttgcagtgagcagagactgtgccattgcactccagcctgggtgacagagcgagactctgtctcaaataaatacattaataaaataaaataaaatgccaaaaaagatcagtactttacaaagcttttacttgactctccccctgccaaaaaaaaaaaaagaaaccaaaaagttccatcattaactgtgcttcacagatactggttaagcaagtttctttactgtaggacttttcagaacctgagatgtgtcaatgtgtgcttgaatctccagggttccaaggctggggttgcggggagagtatttctgactctggacacaccaatttgaggaagactgatctggtggtttcttaaggccacttcagctctaacaaactgtacttctacaataagagcttcttgcacaggcaggaccaggtcaaaggaagaggacactgatgagggcctggaggctcttacgttgcagattagattaggaaaggccttgaatgccaaactgaggcctacagacttcattacgcaaggtaaacagttgagagaagcaggatgatccaagttgtgctgtagttaagtgtgctccagggcaaactggagtctggatgggagaatggaggtggagatgtaactgccataactaggcatgtagggctaagaaactgttctgggatggcagcctttgggactagaaagaagggatgcacaaggacaaaggataagaaggggacaggaaggccgggagcagtggctcacacctgtaatcccagcactttgggaggccaaggtggggtggatcacctgaggtcaggagttcgagaccagcctggccaacaaggtgaaaccccgtctctaataaaaatacaaaaaattagccaggcatggtggcgggtgcctgtaatcccagctactcaggaggctgaggcaggagaattgcttgaacctgggaggcggagctggcagtgagccaagatggcacctttgcactccagactgggcaacaagagcaaaactccatctaaaaaaaaaatataataaaataataaaacttaggaggctttgggacattaactagcccagacatacattcacatactcattattaggtaaaagttttatcccataatttgacataaaggaataggactgaacactagcagctctatcaataaataaaggccataacagcctggcacagtaacatgcctataatcccagctacttgggaggttaagacaggagaatcatttcagccaaggacttccagaccagcctgggcaacatagcaagaccctggctcaacaaaagcctcaacaaaacaaaggttacagttgagcaagcactgtgttaagtactttacaggcattcatctcttcattcctaacaccgcaataagctgctattattattctacttttcagaaaagaaactgaggttctacaaggctgatttgtccagaaccaaatggctacattcagtgatgggaccaaaactcaaatcagagtgagcctgaaaagcccatctcttcactggtatgctgagttcctcaattttctctgtatctatagaaaatgatctgctatacgccgggcacagtggctcacgcctataatcccatcactttgggaggctgaggtgggcagatcaattgagatcaggagttcgagaccagcctggccaacatggtgaaaccccgtctgtactaaaaatacaaaaattagccgggcatggtggcacatgcctgtaatcccagctactcgggaggctgaggcaggagaatcgcttgaacccgggaagcagagattgcagtgagccgagatcgagccattgcactccagcctgggagacaagagtgaaactccgtctcagaaaaagaaaaagaaagaaaaatatagactaggccgggcatggtggttcatgcctgtaatcccagcattttgggaggccaaggcagacagatcgcttgagcccaagaatcaagaccagccagggcaacatggtaaaacctcgtctctacaaaaaatacaaaaattagccaggtgtgttggtgcaccgtagtcccagctactcaggaggctgaagcagaagaatcacttaagccctggagttggaggttgcagtgagctatgagaatcagtctgggtgggaccttgtcccaaaataaataaatacataaaaagaaggaaaatacagactcaacatcccctgggagggtcacagcatctcctaaattctattcaattcgctctgcacgtactgagcacctgctttatgccattaccttgcttctaactatggcttaggaaagaacaagactcgcccctgagtttgaggaactatctattagagccatgagacagatacatcagatacaaacaaatcagcaggaacaatagaaacctgtaaattagtactgaccaaaatgatagttacagataaaaaacatatctcagatgctggaaggggaggttactgtgaactcaagcgatttgggaaggctttctgaggcagcacagggttgcagctcaaggctgaaggcaatctaacaggatacagtggggggccaagtgcggtggctcatgcctgtaatcccagcactttcaaactccaaggcaggaggactgcttgggcccaggatcgctggagaccagcctgggcaacataggaagatcctgactctatttattttttaaataataggccgggcacagtggctcacatctataatctcaggactttgggaggccaaggcaggcggatcacctgaggtcaggagttcaagaccagccaggccagcatggtgaaaccccatctctactaaaagtacaaaaaattgctgggcaggacggcttacgcctgtaatcccagcactttgggaggctgaggtgggcggatcacttggggtcaaaagttcaagaccagcctggccaacatggcaaaactccatctctactaaaaataaaaaaatcagctgagcacagtggctcatgcctgtaatcccagcactttgggaggccaaggcaggcagataacctgaggtcaggagttcgagaccagcctgaccaacatggagaaacatcatctctactaaaaatacaaaaaacaaacaaacaaaaaattaggcgggcgtggtggtgggtgcctgtaatgccagctactcgggaggctaaggcaggagaattgcttgaatccgggagatggaggtttgcagtgagctgaaatcatgctactgcgctccagcctgggcgacagagcaagacgttgtctcaaaaaaaaaaaaaaattagccgagtgtggtggcatgcatctgtagtcccagctatttgggaggctgaggcaggagaatcgcttgaacccgggaggtggaggttgcagtgagccgagatcacgtcactgcactccagcctgggcaacagagtgagaatccatctcataaataataaaaataaaaatacaactacaaaaaattagccaggtgtggtggtgcatgcctgtagttccagctactcgggaggctgaggaaggagaattgcttgaaccttgtcgacggaatttgcagtgagccgagatcttgcccctgtactccagcctgggtgacaagagcaaaactctgtctcgaaaaaaaaaaaaaaaaaaaaaaaggatacactgtggtggggtgaggaagacagggaagactggggacagggacactagacagaggtctcctgaaaattagtgcccataacaggtgtttggtagacaggtctcagccctcagacaaacccatttccaaagatgaaggccagagaatgagaataatgatttatcgttctggccgggtgtgatggctcatgcctgtaatcccagcgctgtgggaggcgtggccggcagatcacctgaggtcaggagttcaagaccagcctggccaacatggtgaaacttggtctctactaaaaatacaaaaattagccaggcatggtggtgggcgcctgcaatcccagctacccagaaggctgagtcagaagaatcacttgaacccgggaggtggaggttgcagtgagccgagatcgtgccactgcactccagcctgggtgacagagtgagactcaggaaaaaaaaaaaaaagacttggccgagcccagtggctcacacctgtaatcccagcactttgggaggctgaggcgggtggatcacgaggtcaagagatcgagaccatcctggctaacacggtgaaaccccatctctactaaaaaatacaaaaaattagccgggcgtggtggtgggcacctgtagtcccagctactcgggaggctgaggcagaatggcgtgaacctggtaggcagagcttgcagtgagctgagatcacgccactgcactccagcctgggtgacagagcaagactccatctcaaaaataaataaataaataaataaataaataataataataataataataaagacttgtgatcctctccctctccctctccctctccgtctccctctccctctccctctccctccctctccgtctccgtctccgtctccgtctccctctccctctccccacggtctccctctcatgcggagccgaagctggactgtactgctgccatctcggctcactgcaacctccctgcctgattctcctgcctcagcctgccgagtgcctgcgattgcaggcacgcgccgccacgcctgactggttttggtggagacggggtttcgctgtgttggccgggccggtctccagcccctaaccgcgagtgatccgccaacctcggcctcccgaggtgccgggattgcagacggagtctggttcactcagtgctcaatggtgcccaggctggagtgcagtggcgtgatctcggctcactacaacctccacctcccagccgcctgccttggcctcccaaagtgccgagattgcagcctctgcccggccgccaccccgtctgggaagtgaggagtgtctctgcctggccgcccatcgtctgggatgtgaggagcccctctgcccggccgcccagtctgggaagtgaggagcgtctccgcccggccgccatcccatctaggaagtgaggagcgcctcttcccagccgccatcacatctaggaagtgaggagcgtctctgcctggccgcccatcgtctgagatgtggggagcgcctctgccccaccgccccatctgggatgtgaggagcgcctctgcccggccgagaccccgtctgggaggtgaggagcgtctctgcccggccgccccgtctgagaagtgaggagaccctctgcctggcaaccaccccgtctgagaagtgaggagcccctccgcccggcagctgccccgtctgagaagtgaggagcctctccgcccagcagccaccccatctgggaagtgaggagcatctccgcccggcagccaccctgtccgggagggaggtgagggggggtcagccccccgcccggccagccgccccatccgggagggaggtggggggtcagccccccgcccggccagccgtgccatccgggagggaggtgggggggtcagccccccgcccggccagccgcccggtccgggaggtgaggggcgcctctgcccggccgcccctactgggaagtgaggagcccctctgcctggccagccgccccgtccgggagggaggtggggggtcagccccccgaccggccagccgccccgtccgggagggaggtgggggggtcagccccccgcccggccagccgccccgcccaggaggtgaggggcgcctctgcccggccgcccctactgggaagtgaggagcccctctgcccggccaccaccccgtctgggaggtgtgcccaacagctcattgagaacgggccaggatgacaatggcggctttgtggaatagaaaggcgggaaaggtggggaaaagattgagaaatcggatggttgccgtgtctgtgtagaaagaagtagacatgggagacttttcattttgttctgcactaagaaaaattcctctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaatttaaaaaaaaaaaaaaaaaaaaaaagacttgtggttctgcactttaggcaccatgttggtcaggctggtctcaaaatactcacatttgtgagtaagaagaggttgtaaggatgttcactgtggcattgtttgtaagggtgagatatgggaacaacagaaatatccaacaacaggatatagattaactaaaaggagatatattcagtctatgggatattatatccatctaaagaatgaaggtgatgtggaaagagctccatgatataccaggtatgatgaaaaaatgtgagttccaggacactttttatggtttgctaccatttatgaaaaacaaagctacatgaatatgttcattagtgtacataaaaatataaaaggccatagtccaaaattatattgtgattatctctagggacaaaagtaggaggagagtaaaagaggatttttacttttgactctctatagctctatactgtgttttgtttttttttttttttgagacggagtgttgctccgtcgcccaggctggagtgcagtggcacggtctcagctcactgcaaactccgcctcccgggatcacgccattctcctgcctcagcctcctgagtagctgagactacaggtgccagccaccacacccggctaattttttgtatttttagtagagacagggtttcaccgtgttagccaggatggtctcgatctcctgacctcgtgatccgcccatcttggcctcccaaagtgctgggattacaggcgtgagccaccacacctggccgctctgtactgtttttgaaagtttaaaatgaaaatttattcctgctggtgaaatggctcacacctgtaatcctaacactctgggaggctgaggcgggcagatcgcttgagctcgggaatttgaaaccagcctggccagcatggcaaaaccccatctctacaaataataataataataatacaaaaaatagccaggcatggtggtgcatgtctgtagtcccagctactccggaggctgatacgggaggatcacttaagcccgggaggcggaggttgcagtaagctgagatcatgccactgcactccagtgtgggcaacagagcaaaagcctgtctcaaaaaaaaaaaaaaaaaaaaaaagtattcctatataaaaagactttggctgagtacagtggctcatgtctgtaatccagcactttggggagccaaggcgggtggatcacgaggtcaggagttcaagaccaccagcctggccaaaacagtgaaaccccatctctactaaaaattcaaaaattagctgggcatggtggcgcttgcctgtgcctgtaatcccagctactcgggaggctgaggcaggagaatcacttgaacctgggaggcagaggttgcagtgagccaagattctgcactgcactccagcctaggtgacagagcgagactccgtctcaaaaaaacaaacaaaagacttcaagcccaggcacagggactcactcctgtaatcctaacactttgggagactgaggtgggtggatcacctaaggtcaggagtttgagaccagcctgtccaacatggtgaaaccctgtctctactaaaaatacaaaaaattagctgggtgtggtggcgggcacttgtaatcccagttacttgggaggctgaggcaggagaatcacttgaacccaggaagtggaggttgcggtgagccaagaccacgccattgcactccagcctgggcaaaaagattgaaactctgtctcaaaagcaaaacaaaacaaaaaaaccctcaaattcttatcaagtcatgacagcaaagaaggcaagaatcacaaaaacacgaggctcagaaaatttcagttgaaaatctctggaatattctggttcaagcccccagaacctcaggagcacaatacagggcaaaggaaagaaccttcactaagatataggaaagtgctgaacagaagcaaacaaattaaacccccaacttctaatacacttgaactgaacctgggcatggtggcttatacctgtaatcctagcactttgggaggccaaggcaggaggacagcttgagctaggagtttgagactagcctgggtaacatagagagactctatctctacacacaaaaaacattagccaggcagggtggtgcacacctgtggtcccagctacttgggggttgaggcgggaggatcacttgagcctaggagtttgaggctgaagtgtgctatgattgcaccactgtattccagcttgggcaacagagcaagaccctgtcaaaaaaaaaaaaatgctccatttaaaaaaattattagattcaggccgggtacggtggctcacgcctgtaatcccagcactatgggaggctgaggcagacagatcatgaggtcaagggatcatgaccatcttggccaacatggtctctactaaaaataaaaaaattagctgggcgtggtggtgcgtgcctgtaatcccagctactcgggaagctgagtaggagaatcacttgaactcggatggcagaggttacagtgagctaagattgcaccactgcacttcagcctggcgacagagaaagattctgtctcaaaaaaaaaaaaaaaaaaagtattagattcaagggacattgtcaaattgctataaaaggttccaaatgcttattctcaatttctgtccttattatagagaggacaagaggacattctgaggacataacccaagatgcacactgaactttccagctgtgctgcaccacagcacactactattcaactatactatgttcacctgttacgtgggctccctccagagacagagtcccacccacgtctggctcattaccaaacgctctggcttggcccacggagcatgcttcaatgactccatggactaaaggaatgttcaagttaatgtctctggccacagctgctaagagaggttactcaccatttggaaccagaaggaggcttttcacgatgcttctgagggagccaagactgatctgattggtggtggcaaattcagagagctgagccagaaatctttccacctgcagagagagaacagtgaaaacccgggccttcactttctaagcatctcagggagcacggacccactccctaacacagaatgttttatttacctcttttggctcagttaggaagtggaaaagcacctctgtcagggctgagaactgctgtgaagaaaacaacacagaacatcagtacaatttctactactgggtcagcatgccccaccccaggcaactgcatagccttgagagggaagaacagtaacagccaggtgttatgcctgttctgatcatcctatagttacaaatgttcacaatacccaccaccagtgtcaatatacctgtgtcgctacatcatctgaaaaacacgtttattgggatacttagcagacatgtattgagagactgtaagcatatgcactcagatgcacacatatatctctaggacacagacacacacagacagacatacacacacacacacacacacacgcacgcacaagggggaaatcatcagaaaattaaaagcggttaccactttggatgatttttattttcttctgttttacctatccatattttctttcttttctttttttttctttccctgagacagggtctctctgtcacccaggctggaatgcagtgatgcaatctcggctcactgcaacctctgcctcctgggctcaagcaatcctcccacctcagcctccagagtagctgggactacaggcacatgccaccatacccgactaattttttttttaatgtagagacagggtctcactttgttgcccaggatggtctcaaactcctgggctcaagtgatctacccacgtcagcctcccaaagtgctggaattataggcataagccatgcacctggcctcatattttcttgggttccccccacccataaacatctcgttacttgtgtaagacaacaataaactgtaacactttattatacacctagaacagactcttacagttttgtgtgtcttaatcttttctctttactggtaatgtgttgttaggaactgaatgtttgtgtctccccaaaattcatatattgaagccctaacttccattgtgacaatatttgaagacagggcctgttagatgataaaggttaaatgaggtcataagagtgagatgctagccccatagggctgggggcgcttattttgattttttttttttttttttttagatggagtctcactctgttgcccaggctggagtgcagtggtgtgatgttggctcactgcaacctccaccttctgagttcaagcaattctcctgcctcagcctcccgagcagctgggattacaggtgcctgccaccacacctggataatttttgtatttttagtagagacgggtttcaccatattggccaggctggtctcgaactcctcacctcaagtgatccacctgcctcagcctcccaaagtgctgggattataggtatgacccaccgtgcctagcctagggctggggcccttataagaagaggaagaggccaggtgcagtggctcacgcctgtaatcccagcattttgggagaccaagatgggaggattgcttgaggctgtgagtttgagatctgcctgggcaacacagcaagaccccacctcttaaaaaaaaaaaaaaggaaggagggagtcatctacaagccaggaatcacactggctggcacttgatcttgtacttccgagcaagcagaactgttagaaataaatgtctgggctgggcatagtggctcacacctgtaatcccagcactttgggaggctgaagtgagtggatcacgaggtcaggagtttgagaccagcctggccagcatagtgaaaccccgtctctactaaaacaaaaaacaaaaaaaaattagccaggcgtggtggcgtgtacttgtaatcccagctacttgggaggctgtggcaggagactcacttgaatccaggaggcaggggttgcagtgagctgtgatcatgccactgtacaccagcctggacgacagattgagactctgtctcaaaaaaaagaaagaaagaaatgtctgctgttggagccaaccagtctatgatattttgccttaacaaaataccagctgcccaggtattttgttatggcagcctgagctgactgagacacagatcattactttatcatgtccctccctggcctgagctgactgagacacagatcattactttctcatgtccctccctggcctgagctgactgagacacagatcattactttctcatgtccctccctgtgaacagtgtgtatgggctggacgcggtggctcacgcatgtaatcccagcactttcagaggctgaggttggcggatcatttgaggtcgggagttcaagaccagcctgaccaacatggtgaaaccccgtctctactaagaatacaaaaattagccaggcgtggtggtgcgtgcctgtaatcctagctactcaggaggctgaggcagaagaattgcttgaacctgggaggcggaggttgcagtgagtggagatcatgccactgcactccagcctgggtgacagagcgagactccgtttcaaaaaacaacaacaacaacaacaacaacaaaaagcccactgtgtatggcatagtggggaaaaccaggatgccagggtttaaaagacccagttcaatcagtgttctccgttgactactcttgtgaatttggtcaagccgtttagcatctgtgtcccagtccccacgaggaaaacaaaggtaagaatacacagcttccaatactaacagtaacacatgcagagcctctagcacagagccaggctggacgctaaacaaatggtagctacagttagagtcataattagagtcactataccatttgatccaccttctagaagcaatatataaaaaaagaaaaagattataggcagatacttcagcttaaaacccccaaagttgtatgtgtagtatgttaaatgcacctatcccttctgctatgacacattaaactctacacatctgtcaggactctgtattattttattcaaaaatgtattctattttaaaagaaaacgaaactgggtgtggtggctcatgcctgtaatcccagcactctgggaggccaaagtgagaggattgcttgaggccaggagttcgagaccagcttgggcaatctgcataaaaaaatttaaaaattagccaggcaaggtggcatgctcctgtagtcctagctactcaggaggctgaggcaggaggattgcttcagcccaggcattccaagctgcagtgagtcatgatcacaccactgaactccagcctgagtgacagaacaagatcctagctcaaaaaataaaaataaaaaataaaaataaattagtcaagcatggtggtatgcacctgtagttctagctactctggaggctgaggtggaaggattgcttgagcccaggagcttgaggctgcagcaaactatgattgcgccactgcaatccagcctgagcgacagtgcaagaatgtgttattgatccctcgtccctatctctcccttcccaagccctccttatcctccaaagccctgccaagaaaccatgacactcccaacaagaaagggacctacccagattctcaacttctgaggctccctggggccacctacaattttcaactctgataaggaacacaaacatgtcttagaagagaagtttccttatatggcattgcagcttcacagcaacttaaatactgtaagtgcacagtatttgctgaataaatctttcctaaacactccccgcaatgctttgcctttgcaattgcataggtgcctccctctggaatgctcacccacccatggctatctatgcatgcatctcaaaatcttaaggattctccccagtaaacttaggaagagatgcacaaggtcattccagactagagaaatgcaaatcagtaaaaccagaatatactatttttcacttatcagatctgcaaacccaaaagtttgactaggacaccagtgctggtgaaagtacaaggaagcagacaggttcctgcatgactgataataggatacactggggtgacctttctaggggcaatttcacaatgtgcatctaacttgtatttttttgaggcagagtctggctctgtcgcccagactggagtgcagtggcgcaatcacggctcgctggagcctccaacctcttgggttcaaagcaatcctcccacctcagtctgctgagtagctgagattacaggcacatgccaccacatccacattgggctaatttttttatattttgtagagacagggtctcacaatgttgccccagctcatctggaactcctgggctcaagcaatcctcctgcctcaccctccctaagaactgggattataggtttgaccaaccacacccaaccggcatcaaatttttaaagtgattatacccctcgacctagtaattccattccatgaagtatatcctttaggtatgttccaaaaagtaaatgttttggcaagtcacagtggctcatgcctgtaatgccagcactttgggaggctgaggcaggaggaccgcttgatcccaggagacaagcattatgttcaggcaacatagtgagagcccatctctacaaatcataataatacatttaaatttaaaaagaaaaaaagaggcctggcaccatggctcaagcctgtaatcccagcactttgggaggcggaggtgggtggatcacgaggtcatgagatctagaccatcctggctaacacggtgaaaccctgtctctaaaccctctactaaaaatacaaaaaaattagccggtcttggaagtgggcgcctgtagtcccagctactcgggaggctgaggcaggagaatggcatgaacctgggaggtggagcttgcagtgagccgagatcgcgccactgcactccagcctgggcgacagagtgagattccatctcaaaaaaaaagaaaaaagaaggtcggacgcggtggctcacatctgtaatcccagcactttggtggctgaggcgggcggatcacctgaggtcaggagtttgagatcagcctggccaacatggcgaaaccccgtctctactaaaaatacaaaaattagctgggcatggtggcgggcgcctgtaatcccagcagaattacttcaacccaggaggcggaggctacagcaagctgagattgtgccactgcactccagcctgggcaacagagtaagactccatctcaaaaaaaaagaatgcagtagatctatttgtattgaagggagaaaataggatacattgctcagtttaaaaaacaacaacaaaacaggccacgcgcggtggctcacgcctgtaatcccagcactttgggaggttgaggcggggggataaccagaggttaggagtttgagaccagcctggccaacttagccaaacaaaccccgtctctactaaaaattcaaaaatggcctggagcggtggctcacgcctgtaatcccagcactttgggaggccgaggcgggcagatcacctgaggtcaggagtttgagaccagcctagctaacatggtgaaaccccatctcgactaaagaaacaaaaaattagccgagtgtggtggcacgtgcctataatcccagctacttgggaggctgaggcagaattgcttgaacctgggaggtggaggttgcagtgagccgagattgcaccattgcactccaacctgggcgacagggcaagactccatctcaaaaaaaaaaaaaaaaaaattagccaggcgtggtggtgtgcgtctataatcccagctactcaggaggctgaggcaggagaattgcttgaacctgggaggcagaggttgcagtgagccgagattgcacgattgcactccagcctgggcggagtggaactccttctcaaaaaaaaaaaagaaggccgggtgcggtggctcacacctgtaatcccaatacttagggaggccgaggcgcgcagatcatgaggtcaggagacagagaccatcctggctacggtgaaaccccatctctactaaaaataaaaaataaaaaaattagccaagcgtggtagggggcgcctatagtcccagctacaggggaggctgaggcaggagaatggtgtgaacctggaaggcagagcttgtggtgagcccagatcacaccactgcactccagcctgggcaacagagcgagactccgtcacaaaaaaaaaaaaaaaaaagtgccgtgcctcacgcttgtaatcccagcactttgggaggccaaggcgggtggatcacaaggtcaggagttcaagaccagcctggccaagatggtgaaaccccgtctctactaaaaatacaaaaattagccgggcatggtggcatgcgcctgtaatcccagctactcgggaggctgaggcagagaattgcttgaacccgggaggtggaggttgcagtgagcccagatcatgccactgcactccagcctgggtgacagagcttgactccgtctcaaaaccaaccaaaaaaaaaccccagcaagatgaagaaaaaatatatacagaatgaaccattttctatatatatataaaaattcaaagccagaaatgggaggatcacttgagcctagatgttcaagatcaccataggcagcatagtaagacctcatctctaaaaaataaaaataaggccaggcacagcggctcacgcctgtaatcccagcacttcgggaggccgaggatggcagatcacctaaggtcaggagttcaagaccatcctggccaacataatgaaaccccatgtctactaaaaatacaaaaattagccaggtgtggtggtagctgtagtcccagctactcgggaggctgaggcaggaggatggcttaaacccaggaggcaaaggttgcagtgagccaagattgtaccattgcagtccagcttgggcaacacagtgagactccatctcaaaaataaaataaaataaaaataagaaaacatgcccaggcacggtggctcatgcctgtaatcctagcactttgcgagtctgaggaaggtggatcacctttggtcaggagttcaagaccagactggcaaacatggtgaaaccccattctactaaaaacataaaaaattagctgggcataatggtgagcacctgtaatcccagctacttgggaggctgaggcaggagaactgcttgaacccgggaggcagaggttgcagtgagccaagattgcgccattgcactccagcctgggcaacagcgcgagactcaaaaaaaaaaaaattttttttaaaggatactcatatatatgctggcaaattaagacttttatttctataaaaataactaagaaactattttttgtttgttttttgagacagagtctctctgtgtcacccaggctggagtgcagtggtgcgatcatggctcactgcaacctccgcctcctgggtacaagtgattatcctcctcagcctcctgagtagctgggattataagcgtgcactaccatgcccggctaatttttgtatttttagtggagacagggtttcaccatgttggccagactggtcttagactgctggcctgaagtgatccacctgcctcggcttcccaaagtggttggattacaggcgtgagccactgtgaccagctataagaaactattaaaatgatttctggagataagaaaaataaacattttatttttaagagatgggggtctcactctttcaggctggagtacagtgggtgatcatcatagctcactgcagcttccaactcctaggctcctgcctcagcctcctgggttgctctgggattacagacatgctgtaccatacctagcttatttcactttgatatctttgtatactgtttgaatttcctgtctattactttcatttccagcttggtaagaggactgtgggccacttgcttgtattatcctttatatttttctgagtttactctcattctaaaatgattaacttaaaatcctgcctattctcagactccacattgcctgggactggccacgggcatcaaagggcacatctatgtgcaatttggtactatctgcttcttcattttatgacctgctgtagaagatcacaacttccccaggacaaaaggccttgaccatcaaatattcctaagtcctaccaggtttagtggctatttggtttatgtaggcattcaggtaaacacccaccgaatgagcaataaatgttaaagacaaggttcacacaatgattcgttttactacttgaggcctacaccttagaattcaaaataaattcagctaacagagtgggtacttggagaagtctgattatccaacaaaagacagagaaatgggccaaacgactcaggtaagttgcttattaggagaaaggtttaaggtttctgtattaacaataaaggtagctgggcctggtggctcacacctgtaatcccagcactttgggaggctgaggccggcggatcacaaggtcaggcgattgagaccatcctggctaacacggtgaaaccccgtctctactaaaaatacaaaaaattagccaggcatggtggcacatgcctgtaatcccagctactcaggagcctgaggcaggagaatcgcttgaacccaggaggcagaggttgcagtgagctgagatcatgccactgcacttcagcctgggtgatacagcgagactctgactcaaacaaacaaacaaacaaacaacaacaacaaaaaaaaccaataaaggtaaaggtttacagtatgtttcaaggttagaaaatgagtcagttcctgggggtgatggctcacacctgtaatcccagcaatttgggaagccacagtgggtatatcacttgagcccgaagttctagaccagcctgggcaacatggcacaaccccatttcttcaaaaattacaaaaattagccagagctgggcaccatggctcatgcctataatcccagcactttaggaggctgaggcaggtggatcacctaaggtcaggagttcgagagtagcctgaccaacatggtgaaaccccgtctctactaaaaatacaaaaaattagccaggcgtagtggcgggcacctgtagtcccagccactctggaggctgaggcaggagaatggtgtgaacccaggaggcagagcttgcagtgagccgagatcgcgccactgcattccagcctgggtgacagagcgagactccatctcaaaaaaaaagaaatatatacatatacatatatataaagtttagctgggtgtgagggagggcacctgtaatctcagctactcgggaggctgaggcaggagaattgcttgaacctgggagacagaggttgcagtgagccgagatcgtgccattgcactccagcctgggcaacagagcaagactccgtctcaaaaaaaaaagataagccaggcacggtggtacatgcctatagtcccagctactagaaaggctgaggtaggaggatcacttgagcctgggaggtcgaggctgcactccagcctgggtgatagaatgagaccctgtctcaaatttaaaaaaacgaaagaaagaaaagaaaatgagtcaactctgggtgtaatggctcacacctataatcccagcactttgggaggctgaggtgggaggatcccttaaggccaggaggcccagaccaacctaggcaacaaacagtgaccgtgttgctataaaaaaaattaaaaaataaaaaattagcctggtgtggtggcacatgcctgtggttccagctactcaagaggctgaggcaggaggactccttgagcccaggagttcaagactgcagtgagccattattgtaacactgctctccagccttggcaacagagtgaggtcctgtcttaaaaaaaaaaaaagaaaatgagtcaagtgctgatctcaaaggaagtggtttgtattttctacgaataccaagctggaggtaattttacagatcatacaatccagtatcttaaaaaaaaaaaaaagaaaaaaactttgttagtagcagaatctttttttattctccaaatggatatcttccagagaacactgatacattaacaagtaaaagctaagctaccaccataggctttgaagccaaacacgtgatcctaaattcctggctccatcacttcctggctgcctgacattatttatttattttcttgagacagggtcgcattttctgacccaggctggagtgcaatgccatggtcatagctcactgcagcctcaaacttctgggcttaagggattctcctgcctcagccacttaagtagctagaactacaggcacataccaccactctcagctaatttttaaaacttttggccaggtacggtggctcacgcctataatcccaacactttgggaggccgaggtgggcaggttacaaggtcaggagttggagaccagcttagccaacatggtgaaacctcatctctattaagaatacaaacatgagccgggcatggtggtgcacgcctgtagtcccagctacttgggaggctgaggcaggagaatcacttgaacctaggaggcggaggttgcagtaagccaagatcatgccattgcactacagcctgggcaatattgagactatctcaaaggaaaaaaaatgttttcctagagatggggtcttgctatgttgctcaggctagtcttgaactcctggcctcaagtgatccccctacctctacctcccaaagtgcttgattacaggcatgagccaccttgcctggctttctgcatgattttatttacttatttatttgaaacagggtctggtctgttctctgggctggagtgcagtggcataatcatagctaaccgcagcctccaatttctgactcaagtgatcctcccacctaagcctctggagtagctgggactacaggtgtgtgccaccatgcctggctaattttttatcttattgtagagatggagtcttgctacgttgcttaggctagtcttgaactcctgtctacatgactttaaacaggtcaatttatttctctgaaccatctttcttaactgtaaaatgggaataataatagtgccttccttttagagttgttatgcatacatttaaaatggtgcctggccacatggtgcatgctcaatatattaatatcgtataatagctatgttcatttcactgctctgtgattcagtttcttcgtctgtaaaatgtgaataataataagtggctgggtgcagtggctcatgcctgtaattccatcaccttgggaggccaagatggatcaccagagaccatgagttcaagacaagcctagacaacatagggagaccctgtctcaatttaaaataataacagcaactacctataaaagtgattgcaaggactcaattagttaacatacataagctgggcgcggtgtctcacgcctgtaatcccagcactttgggaggctgaggcgggcggatcacgaggtcaggagataaagaccatcctcactaaagcggtgaaaccccatctctactaaaaatacaaaaaattagcagggagtagtggcgggtgcctgtactcccagctactcggaaggctgaggcaggagaatggcgtgaacccgggaggtggagcttgcagtgagtcgagattgcaccactgtactccagcctcggtgacagagcaaggctctgtatcaaaaaaaaaaaaaaaaaaaatacataaaagcacttagatccctattgtccagtggccacttgccacataagcgcttgaaaagggctaatctgaccaggggtggtggctcactcctgtaatcccagcactttggggggccaaggtgggtggatcacttgaggtcaggagttcgagactaccctgaccaacatggcgaaagcccatctctactaaaaatacaagaaaaaattagatgggcatggtggtgaacacctgtaatctcagctacttgagtggctgcagcatgagactcacttgaaccctgtaggcggaggtttcagtgagccgagatcacatccccgcactctagcctgggcaacaaagcgagactgtctttaaaaagaaaagggctggccggatgcggtggctcacacctgtaatcccaaaactttgggaggccgaggtgggcagatcatgaagtcaggagatcgagaccatcctggctaacacggtgaaaccccatctctattaaaaatataaaaaatcagccgggcatggtcgcaggcacctgtagtcccagctacttgggaggctgaggcaggaaaatggcgtgaacccgggaggcggagcttgcagtgagccgagatcacgccactgcactccagcctgggcaacagggccagacactgtctcaaaaaaaaaagaaaagggctaaactactttaagatgtgccgtaagtataaaacaccagatttagaaaactttgtaccaaaaagtaaaatgtcattgatatttgtatatgggtaagatattgaaaaatattttgatattgtggatttaagcatgcatggcattttgatcaatgatggaccatatataaaatgatggtcccataacattataatggaggtaaaagatccctgttacctagtgattgtcacagaaatccgcgcccagccatgtttgtgttttaagctatgtgttactacaaaagagccaaaaagtttaacaaaaccagcctgggcaacatggcaaaactctgtctttacaaaaaatacaaaaattagccaggtatggtggcgcgtgcctatagtcccagctatttgggaggctgaggtggaaggattgcttgaacccaggagatcaaggctacagtgagcaatgggtgacagagcgagaccctgcctcaaaaaaaaaaaaaaaaaggtaagcattcatgaagtaaaaagttacagttggcagggtgcatggcttacgcctgtaatcccagcactttgggaggttgaggcaggcagatcacttgaggtcaggagttcgtgaccagcctggccaacatggtgaaacgctgtctctactaaaaatacaaaaattagccaggcatggtggtgcacgcctgtagtcccagctacttgggagcctgaggcaaaagaatcacttgagcccaggaggtgaagtttgcagtgagccaagatcacgccactgcactccagcctgggtgacagaggaagactccgtctaaaacaaacaaacaaacaaaaaaaactgacagtaggctaaggtcaacttatcaaaaacagaaaaaaaaaaatttttttttagggatgggggtctcactatgctgcccaggctggagtgcaatggctattcacaggtggaatcaccatgcactacagccttgaaatcctgggctcaagtgatcctcctgtctcagcctcccaagtagctgggactactgtggtagctgtgccaccgtacccaactagaaagttgttttttttttttttgagatgaagtctcactctattgcccaggctggaatgcagtggtgcaatcgcagcttactgcaacctccacctctcaggttcaggcgattctcctgccttagcctccagagtagccgggactacaagtgcccgccactacacccagctaatttttgtatttttagtagagacagggtttcatcatgttggccaggatggtctcgatctcctgaccttgtgatccgcccaccttggcctcccaaagtcctagggtaggtgtgagccaccgtgcccggcctattttttatcttttatactgtatttgtactgtaccttttctatttagatttgtctaaacacacaaatatttaccattatagtccagttgcctatggtattcagtacagtcacatgctgtataggtttgtagcctaggagcaatgcgctataccatatatcctagggtgcagtaggtttgtgtaaataaactctaggatgcttgcataagatgaactcagggctgggcacagtggctcacgcctgtaatcccaacactctgggaggctgaggtgggcagatcacctgaggtcaggtgttcaagaccagcctggccaacatggtcaaaccccatctctactaaaaatacaaaaattagctgggcatggtggcgtgtgcctgtagtcccagttactcgggagactgagacagagaactggttgaacctgggaggcggaggttgcagtgacccgagatcgcgccactgcactccagcctgggtgacagaatgagactacgtctcaaaaaaaaaaaattaatttccatttctatttaatttttaaatgtggctactacaaaatgcaaagttagaaatgtggcttgcaaatttttctattgcatagctcaagcttagaaccttcctgtcgttacaagttctaagtttggtttttatctcgcaagcagcactactgtgtgggaagttgtggggggtatggagatgaaagaagaggggcgctacctcctgggaagtgacaacctagcgggggaaatagatgtatcttcccagtgggggtgagaagtgtcattctcacctatttcagcagccttggtggtatgaaaaggcatcccaaccagcacagaagcaggatgcctccaagactgccttggttggcacctgcagcctgaagggggagaaaaaggctttgctagctcccctaccatcgaggatgaagacccccactgtacacagtgtataaggtttctttccatgtgaatcccagtgactctccttaactgggtggaggtggaaggtgtcatcagccttgtcccagatcgagcccctcaggcccacagagccccagtggggcctggctattactgacactcatgtcacactgagatgtaagacggcagcccaggccaagcttccccgggccccctcagattctcgggccctcccactcccctcaggcttcctcggcctccctgccaaacatctatctccctttggaccccactgctccccaaaactccccacgcccttagtctgttccttcagttccccaaactccttcagcctcatctagactcccctccgtccctcttctaggaccccaaaagctctcctcggccccaggaccccgcagaggtcccgtagtcccatctctgagaccccacaaagcctttcggacccctcaggtggcccttaggcctccggagatcccttggctccccacactctcctcagaccccagctcaccttagcctcgccccgaacccacctcacacaccccaaacgcccacaagacgccgctctgtctagtctctcccaactcccgcgcacccccggacgtcccccccaccccaggcccggatcctggaatcacctgggccccgcgccccacgccccgccgccgggcccacctgcgcgcccagctggttcagctgctgcatgtcgccgcccacggcctccggcaccgggtcctcagtgcagtgcaggcggcccatggcgcgcgccccagccccgcaggttccaccgccgccgccgccctgctcagcttcctcctccgctgccgctgccaccgctgccggcctctccgcgcatccacaaccgcactttcgccacggccgtcgcagcgcactcctcccccggccgccctgggctgtccggagccggggagccctcgcagggccgcggacacgcgcggccgccgggctccggggaggggcaggggcggcgccggcaccggcagacgcgaggtttcctgccagctctcccgctgagtgacctttgggtacggcgcttggcctctctgaacctcagtttcaccatctgagaaaatgatggctggggtagctccttaaatgagttaagcctccagaaatgtttaacgcagagaccggcacacaagaggtcttcaatcaatggctagctgctattatcatcatcactgttactatgcactccagagatatttatggcagcctactcgatgccagacactggggacagggaagggaacaaagcaggccagagtgtctctcggagagctgacatcagagtagagactaggtctcaaccttggaagggcatcagcatcaccccagcatcacctggtattgcc

SEQ ID NO: 1622 - DNA, 41323 bp, Homo sapiens; identical to SEQ ID NO: 1621

SEQ ID NO: 1623 - DNA, 79108 bp, Homo sapiens
taaggaaatagctttctgaggtttctttaaaaaccatcctgaaatgcacacagctgatgaagccacgtgacagtgtataaagcagtttaaagatcttaataaacgaggccctcataggccccttgcttgggcccactgcatggtgaaccatgtgcagaaatgtcttcccagctgtgatggtttcacattgtcatcgtcgtccccccgggaggttggagcatcaggggcctggactcactggactctcccctctcagaggtgcggaactatatctgtgacgaatgtggacaaaccttcaagcagcggaagcaccttctcgtccaccaaatgcgacattcgggagccaagcctttgcagtaagtgtgagtcaggaccccctcccagggctgtggccctcgcaccttcttatctgcctctgtcccccaggtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctggtgtgcagtggcaggtcccgtcagaagagatgaggctcctgggacaggtcagcgtcaggggcagcctgctgtctgctctggagggcggcgctcacctctgggtcgcagtccccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacatggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagaggcagtccccatgataggcccattggtcctggggttgaccagtgagccagtaaattatcttattgctttaaacaagtttgtgcttaatctgtcccaactaaaatggagcttataaacttacttagcaaggaacctcaaggagggctcgttcttaaccatttgcaagatgcctctgaaaagagcggccctccgcatttgtgcctcagcagcgtgtttcttaccactctctgtcaactgaaagagtgccagccaggatatcttcctcttctctaaacactcgaggattgctgcacaaacgtggaaagcctttggcaggtctgtggtgctctgtaaaccgcaggagaccaaccctgagaatggccgacctggtgctcccatgggtaggagggtacagccctcagcacagaagagggcatttcctctttgcttattgtaagtcttaaaactggtgacagttttacctatagaaggtaatactgggcctctggacagaagaggctcaggtaggaggccagggacttcgagcacccacaccaaggctgctgcaccacgtcctcaaataagacattaaaagaaaggcccacaggccggatgcagtggctcatgcctgtaatcccaacactttgggaggccgaggtcggcggatcactgaggccagttcaagaccagcctggcaatatggtgaaaccccgtctctactaaaaatacaaaaattagccgggtgtgacagactcacgcctgtaatcccagctactcgggaggctgatgcaggagaattgcttgaacccaggaggctgaggttgcagtgagctgagatcacaccactgcactccagcctgggtgacagagtgagacccccatctcaaaaaaaaaaaaaaaaaacccacggcctgggagttctcactcacacttccgcaaacacaaggagctcctgagctagtctggaaaccctgacttggaagctggctgcctggtgcccctgcctggcccacagtgggagaggacaccttggctggtaaggtctgacttacatttgaggtcagatgtgacgacagcaggcccatcaaggagaagaagaaaaggaaaaccaatagctgtaaataaaaacgtgcacttattattacattaaaattacctgtgctgtcattctaaataaggctgacacattcctctttaattgaaattttttacatctaggccataaatcctttaagtggatcttagaaaactttccaatcacttctagagagacagcttaattgagaattaattactactggctgggtcatttcacacttgcctttaaacaaagctagaaacagtttgaaaaagtgacaagagccagaaagagaagactgctgcggtctccttggctgtgcgcagtcccaactcagcatcatctccctgcaaggcctcctgtcagaagtgtttgtaaaatccttgaagataagcccacaggctccagcctaaagtagggcctgactgggcagggtctctgtggacactcctcgctgcacactagggtcctaaggccctggagccactaaaatcccttctaacaaaactacacaagaaacctgaagacgtactcagaagaacccctgcagggtggttataatcaccaaaaccctgggcgctgctgtcgatccagctttgagctggtgtaagttgtgtgctgacatggcacctatgcgttgcggatctcgggctgggcacagagggctgctgcctccagctctcttgtgggatgcttgtttctgttcctgttctgcacacaccacccttggctccctgcacagagagctgtgtgggtgtcactggtcttgtgggggcagtcaggctttccagggtgcagcaaccaggtgggcagtgggtctgagtcgaacatggtccctggcctggaattcaagagcagcctctcccactcctttccctatgcctatggctgcagacggtcccatccttgctgcctcttgtccccagcaccccaggtctgagctgtctcactgcaagcttatctggggctgtccctcagcacatgaatcaaggctactgcagcatgaacacagaaggcaccacttgaaggctgacagcatttacgctgggctgtgatgaggataaaaataagctgaagaaacgcacttcaagcctgggcaacacagtgagacccccatctcttttaatttttactttaaacaaattttttttttttgagacaagtctcgctctgtcacccagactgcagggcagtggcgtgatcttggctcactgcagcctctgccccctgggttcaagtgatcctcctgcctcagcctcctgagtagctttacaggctatgggattgtaggtgcgcaccaccacacccgactaatttttgtgtttttagtagagacagggtttcaccatgttgcccaagctggtctcaaactcctgacaccaagtgatccgcctgcctcggcctccctaagtgttgggattacaggcatgagccaccatgcctggactacagacccccatctcagaaaaaattacaaaattagccgggcatggtggcacacacctgtagtctgagctactccagaggctgaggtaagaggatggcttgagcccagaagaggctgcagtgagctgactgcaccactgcactccagcctgggcgacagtgagaccctgtctcaactacatacaaccatttaaaaaactgaaattattatttttactagtaaacttgatagtcaaagtcttactccaagccagctgggcgtggtggctcacgcctgtaatcccagcactttgggaggccaaggcgggaggatcacggggtcaggagatcgagaccatcctggctaacacagtgaaaccccgtctctactaaaaatacaaaaaaaaaaaaaaaaaaaaaaagtcttgctccaagccacatatttgtctttagaaaaacagttcatcagacaagcccagagaaatagcactgattgaaaccaagcttgcgagaaaataaatcagtaaaagaatttcctatcttgcctcctctctctcgcagtccagcttctttagctgcttcctgatgttttcttccctgacttgttgaatcgcaaagtgcagtgcagcagctgagagccagtccgggttgggtgctggggaggcagcctcaggggagaggaaactgggacagagagaacggggtcattgcagggccttacaaccatacaaccacgccatagaaaccaagtccttattcccacctgtcacctttggggcctgcctttccatcagaggacagagaagggtttcaggaccatcagaaactaggtctgcatcccccaggtccacgtgagagtgtgggcaggtgctggtgctgcccccacagcatcctggcgttctgagagctgctgactgagcaggcagctggcctggtcctgtctaccttgccctgtgctcttgggccccagctgcctacattttggaagaagaggcctcattttcctcagttgcccatgcctggccctgtggatcaggcattccctcctacaacagagaacaaaggactgcctggctctggccccagtgtggtgtctgagttttctggctggttaaaaaattggtaggaaattaatgaaacaatgctgtggtttaagagactttaaataagctgggcatgacggttcacatctgcaatcatagcacttcaggaggatcgcttaagcccagcagtttgagatctgcctgggcaacacagtgagactcaatctcaaataaacaaaaacgaggcagggcgtggtggttcacgcctgtaatcccagcactttgggaggctgaggcaggcagatcacctgaggtcgggagttcgagaccagcctgaccaacgtggagaaaccctgtctctactaaaaatacaaaattagccaggcatggtggctcacgcctgtaatcccagctactcaggagactgaggcaggaggatcgcttgaacctgggaggcggaggtcatggtgagccgagatcgtgccatctcactctagggtgggtgacaagagtgaaactctgtctcaaacaaaacaaaacaaaaaacaaaacttcagacaatctgatctgtgtttgtagaattagaactggaggtgtgacctgctttctccttttttgagatggagtttctctctcattgcccatgctggactacaatggcatgatctcggctcactgcaacctccacctcctgggttcaagcaattctcctgcctcagcctcctgagtagctgggactacaggcgcacactatcacacccagctcatttctgtattttcagtagagattgtttcacatgttggccaggctggtctcaaactcctgacctcaggtgatccacctgccttggcctcccaaagtgctgggattacaggtgtgcgccaccgcgccggggccctcttctcttctttcagcagacggcgagcagccaaaccctgaggggacccggtgtggcatcagtgattcaaaactagtcacaaagtaaggtgttctccaaggaggcaggatgggtactagcagtgccctctgacgaccccttaagaacacggcacccacattcagcaggtggagtggctgtcagctctgtggtcctcagaagggtgtgtgagcctggattgcgccaggagcttgatggtttgcaaggacccgtgaatatctgactggggtcgacaggtcagggtaggctgagaatctgcatccctgaggtccccatgacactgaccctaccagcacgcggtgcactctaggagcccacattagatttaagaggaaggggagcaggtgcaaaggaatcactcgagctcctcactcagacgggagcctgggagaggccgttcctcactcagacgagacactggcagaggctgtttttttttttgttttttttctggacagagtcttgctctattggccgttggagtgatctcggctcactggaaactccacctcctgggttcaactgattctcctgcctcggcctccccagtagttgggattacaggcgcccaccaccacgagaactcggttcttttctccctgctcacacgagaggctgcccacaccgcttctctcaagcaagccagggtgtttaggagatgaccttgagcaggtcccgaagtgcatctgggcgggcacaccccatctcaccacccacacgtactcgctggcaaactgccggccttcttgtagcttctgcagttcccggggcagcgggctctggcagtgtctcctccaccggcagagcagcacaggctccaggctcggccaccacacctatggagagagcaccagcacacagatgagggtggctgagatggacacacctccgctgccccagccatgacaagcccccagtgctcctacaggccactacaggcccacactcgccctgcgctctggaactccaaagccagtattttttacgtcaattaaggctcaaagcagttccatgaggcatttattacccacactcatggaagacgtggaatttggagaaggaagagcctggcctaacgcaacagtgaagggaccacactcccctgagctgggaacgaaacagtgaagggaccacagtcccctgagctgggaatgaaacagtgaagggaccacactcctctgagctgggaacaaaacagtgaagggaccacactcctctgagctgggaacaaaacagtgaagggaccacactcctctgagctgggaacgaaacagtgaagggaccacactgccctgagctgggaacgaaacagtgaagggaccacactcctctgagctgggaacaaaacagtgaagggaccacactgccctgagctgggaacgaaacagtgaagggaccacactcctctgagctgggaacaaaacagtgaagggaccacactgccctgagctgggaacaaaacagtgaagggaccacactcctctgagctgggaacaaaacagtgaagggaccacactgccctgagctgggaacgaaacagtgaagggaccacactcctctgagctgggaacgaaacagtgaagagaccacactgccctgagctgggaatgcctggtccttggatgccctcagctgagaggtggcgttctaaacaccgaagagttcatttctcacgaattccaccaactgagctacaactcggtgcaaatgcagcctgcttggggagctccctggggaacatgccgtgctgcggagaaaaaggccctcctgtccctgatgaccgagaaggaagggcgacagctgtggtcttcaggactaagtgagccgccagggaagtgagggaaatgctgccctcctcccactctcgggaccctgggctgctaggggagcctgctgagctctggcgggagctgaggtgaagtctctgctccgaagtcccaagaaagcatagtcaggcgcaagtgggccacagtcatgctctcgtgacggggcacaggcagccaccgtacagcctccagccagtgcacaacccaagaccgtgaacaaacaagccctgcacccctgtggacatgaaggtgcccgtggggtctgagtggggtccacaggggagaagtcctgcgggtgccatggtgacggcggtgggggcagggacggttctgggaactcaggatgtgcggccctcatctgctatgagctggcatctttaactgtggcttccatgtctcctgatgcattttccctgagatggtaacacccgtgatggagacgtgctgcagagatgccagaggcagctgtggagtctcccactcatccccaaaacaaaacaccaaacaagacagctgacccaccagagcagaggtcaaaattaaggggcatttcgtctggcacttggccagtatgaagtcgaccatcagggaggggtctctgctccgcagacaggcgttcaggaggccctgcaggagagaacgcagcaggaggtcagcggtttgtgaggacccacaactagtagagtgaaggaactcacaggaagctgacaggaggatccacccacggcgttctgagaaggccacgagaggggctgagggagcatctcaccctgaagaagtgggcagtgatgtcctgtgtcagggcacctccgtgggagcagaagtttctctgcaaaagagttcaaggcaggtaagaaaagcccacaggaagagaggcgagaccaacatgcagagtggctgctgtggattcagttttgagaaaaacactcgctaaggcttggcgtggccaccatggatggtgctcctgggctgaccgggcctggcgccctggctgtgctgtcctgaaacttaacggcttccctgggcggccagatcctgcagcccaccagctctggcccaaacagtcttgtaggctccaggaagaagccagggaggcacaagcagccgcagggaaggggacgcacccggagcgtagaactgtggtgaggacgacactaataccaagggccaaccatcctctggtcccttcactaaccaagtgctgtctatggtgttttcctgtctgtcggctgtcacgtgccaactgagagctttctgaaaaacagccattcataagaattcaaaggagaccatagtgattttctgaaagcttttgctagtctcacgtcctctgctttccttgtcacattttgaagtgctgcacaaggccgggctcacacctgtaatcccagcactttgggaggccaaggcgggtggatcacgaggtcaggagttcaagaccagactgaccaacatggtaaaacgtcatctctactaaaaatacaaaacttagccggtcatggcggcaggcacctgtagtcccagctactcaggaggctgaggcaggagaatcgcttgaacctgggaggcggaggttgcagggtgagccaagatttcactgctgcactccagcctgggcgacagagcaagactctgtctcaaaaaataaataaataaataaataaataaaaatataaaatgctgcacagctggcatggaacctgaattccatctctcacatttgtgcatcttcaaaaacaagaaaaaggccttcgggagcagaagctgctctctgtagagtgggaggggctggtatccgtctccccagctctgaccaactgggtccctacgctgcccgtccccacagcgagtgtcacttctttttatttgagacaagagtttcgctctgtcacccaggctggagtgtagtggtgggatcttggctcagtgcaactctgcctcctgggctcaattactcctcctgacccagcctctcaagtaggtgggagtacaggcgtgcaccaccatacccagctaatttttctattttttgtagaaacagggttttgtcatgttgcccaggctggtctcgaactcctgggctcaagtgatcccccacctttccagagtgctgggattacgggcgtgagccaccgcacccagcctgctggttaagatcaccctgcaactcacgctgggcagtgtctaaaatggaagataactgggctgcctggcaggcaacagcggtagtcagatcaccacaaggctttttttacacatgaagcatgttgagattagaaataaatgaaccgaggtgcgtggcacacaaaatggtctgtacgattccatgtgtcaaaatcattaaaacttgagggaaactaaaggaactcaaacttgggagaaggcaacctacagctggtttggtgatgtgctggtcgccgtcctggctgtgggtggggtcctccctcacatggcattccagacactgttccctatttgactttgaaccctttcctcagtaattcacacggtcagtacacgcatggaggctgcaagagctgctgttagcgccacaggcactgacagatcggacggacacgtgcacacggggcacctaccatctcagagttgaccaagtggaagaactgctcgcatctggcagtgatgggctgttctgcctggaagctgctgccgcagaggacagacgaaggcaggcggaggaggatcctggaaagaaggggctgtattggtggcgacagcacagcgtacactctgctccttcccaagggctcagactctcagagcagcaaccaccaccctgaaacccagggccactgttggaaccagagccttggcctgtgtccctctgtcccatccaaagcctgcactctgagcccacctcccctatactgtgtttggcccactgcattcaaaatgtgttaccaaacaaacaacttttaacagttacataataaccaacaacttctgacagttacacgataaccaagtggatgacgcaccagtctgtctagtgaagcaattccctatgactgtaaaattaaatgactccacgctgcttcttataaatgcagccgccgtgggcatttctgaacacttttccctactttcacaagagctccttctgcgacgtccctccacgtctgagcaggaaggttttgttgttgttgttgagacagagtctcgctctgttgcccaggctggtgtgcaatggcgtgatctcggctcactgaaacctctgcctcccaggttcacaccactctcctgcctcagtctcccgagtagctgggattacaggtgcccgccaccacacctagctaaatttttttgtattttttttgtatttttagtagacatggcgtttcgccatgttggtcaggctggtctcaaactcctgacctcaggtgatccactcacctcagcctcccaaaatgctaggattacaggcatgaaccacctcgcttggctggaaggttttaatcaaaagtactttcaaccctccagatcctcttctccgtggcatgtgccacagaaatggacaggcttggggtggggacacacagacaagtaagtaacgggaaacaaactcactacaaagaacctctaggaccgtcatgagatgctgccctgcccaggtggtgctgccctgcccaggtggtagtaggtgttaccgtttgtacattagcagctccctctgtctctgaaggctggcagccacgctccacccgcttgtcagagcctggagccgtctgcggaaaatctcaaagaggaagtgctcctgggaaggggtgtggccgagaggcactatgaggtcttgctgcagctccaggtcagctaccatctcctgaaaaagagcagtatgctggcacaggaaggcctcggggctcactgcccagccagtcggggacccagacgtcaggggtcagggagaggtctccacagtggacagggcaagaaggaacaagtggggcaagctatttcaattggaaatcactttgaaattgcaaatatagaacagtgcaggccgggtgctgtggctcacgtctgtaatgccagcactttgggaggccgaggcaggcagattccttgagcccaggagttacagtactacttatcaactacttatcaattaagaaaaaacagctgggcgtggtggctcatgcctgtaatcccagcactttgggaggccaaggcaggaggatcacgaggtcaggagatggagaccatcctggctaacatggtgaaaccctgtcgctactaaaaaatacaaaaaaattagctgggcatggtggcgggtgcctgtagtcccagcgactcaggcggctgaggcaggagaatggcgtgaacccgggaggtggagcttgcagtgagcccagatcgcaccactgcacttcagactgggcaacagagtgagactccgtctcaaaaaaaaacaaacaaaaaaaaacagccaggtatggtggctcacgcctgtaatcccagaactttgggaggccaagacagatggattacctgaggtcaggagtccaagaccagcctggccaacaaaattagccatacaaaaattagctgggtgtggtggcaggcgcctgtaatcccagctaatcaggaggcagaggcaggagaatagtttgaacccgggaggtagaggctgcagtgagccaagatcccgccactgcactccagagcaagactctgtctcaaaaacaaacagacaaaacaaaacaaaacaacaacaaaaaaaaacagcaggaggacactcatgtgcccttcacccagattaacctctggctaacattttaccccacacatcatttttgcctcacaagtcttttgttgttgttgttgttgttaggacagtctcagtccggttgcccaggctggagtgcggcagtgcagtcttggcttatggcagccttgactctcgagctcagctgattctcctaagtcagcttcctgagtagctgggactataggtacacaccaccatgcttgactagtgttttgtatttttagtagagatggggtttcaccatgttggccaaactggtcttgagcccctgacctcaagtgatctagccacctcagcctcccaaagtgctgggattacaggcataagccaccgtgcctggccggctgtattttttaaagaagaataaagatcaggtgcagtggctcacgcctgtaatccaacaattttggagaccgagatgggtggttcacttgggcccaggagttcgagacaagcctgggcaacatggcaaaactccgtctctacaaaaaatcagctgggtgtggtggcgcacacaggtgcacgctgtcaggattgcttgagcccaggaagtcaaggctgcagagagatatgatcgcaccactgtactctagcctgggtgacagagcaagaccctgtcccaataataataataattatgattacaattaagaggaaaaagcagatggtctcactgagaaggagccaggtgggtctagggaaagcatctggctaaggagttgggaggccccagagctggcggagggagagacaggggcctggcacagaagacgcacgggtggccagcaccagtaaatgcctgttgactgacagtgaacccacacaggtacatgctgcctacctgtatagacttcaggtgatccaccagcctcggactcccaaagtactgggattacaagcctgagccaacaataaatatcttttttttttttttgagacggagtctcactctgtcgcccgcccaggctggagtgcagtggcacaatctcggctcactgcaagctccgcctcctgggttcatgccattctcctgcctcagcctcccgagtaggtggggctacaggtgcccgccaccacgcccggctaaatttttgtatttttagtagagacggggtctcatcgtgttagccagcatggtctcgatctcctgactgtgtgatccgcctgcctcggcctcccaaagttctgggattacaggcgtgagccaccgcgcctggcaataaatatcttaatagcacgcggcttaaatgaagtgaatgcactgagttgtggcaccctcaaactcacctgcaatctggaaataatatcctcatttcctgtgcggccaccaaagaccaaatcagaattttctgagtggtcataactccttgagctgaaatgaaaatacaataaaatcctcctcagtatcgcctaatagtgctgaagttcccagttctcctcctgcctccggagctgagtgatggctgtgcttctctgacagtgtgaccctcacattagtcaacaataaacaacaaaaactgccacaaaatactaccaaccccaacctaggaaatacaaaaattatgtaccatgaccaaggaggcttatcccaagaatgcaaggatgtgggtggcaagccacccaggcaccaaggcaagagacagaggacacgagctgttccagtataataaaatataaaacaagaatagttataccagatatagatcttagatatgattacatatgaatatcattaatcattagttggtagcaattactttttattccaatattatgataatcctcactcaataatcatagcctaggaaaaaccaggccatacagagataggagctgaggggatatactgaggtgtgaccagaagacaagagtgcgagccttctgttgtgcccggacagggccaccagagggctccttggtctagcggtgatgccagcgtctgggaagacgcccgtcaccaagcggatcgtggtccagcggtagcaaaaggtgtcaaggaacaacacccactacttagcagaccgggaaagggagtctccctttcccccggggagtttagagaagactctgctcctccacctcttgtggagggcctgacatcagtcagactcgcccgcagttatccggaggcctcaccgtctccctgtgatgctgtgcttcagtggtcatgctcctagtccaccttcatgttccatcctgtacacctggctctgccttccagatagcagtagcaaattagtgaaaatactaatagtccctgatatgcagaaataatggcgtaagctgtctttctctctgtctcctctccctctctgcctcagctgccaggcagggacgggccccctgtccagtggacatgtgacccacgtgaccttacctatcattggaggtgactcacattgtttaccctgccccttctgccttgtatccaataagtaacagcgcagcccgacactcggggccactaccggtctccgcgcattggtggtagtggtcccccgggcccagctgccttttctcttatctctgtcttgtgtctttatttctacactctctcatcgccgcacacagggagagacccaccgaccctccggggctggtccctacacaaggatagcttaagatccccaaaccaatataacgcagttatcaataaaataaaaagcaaaaaccgtaagattatctcaatagatgtagaaaaagcacttgacgaaatgtgacatccttttgtgataaaaacactcaatcaaccaggaacaaaggaaatcttctcaatctagtgcctggcatggatgaaaacccacagcaaacgtcagatttaatgaggaaagactgaaagctgttctcctaagatcaggggcaacaaggatgtcctctctacactcagaacagtgtcgctgcctctactcaacactgcactggggacagacacggtggctcacgcctgtaatcccagcactttgggaggccgaggcaggcagatcatctgaggtcaggagatcgagaccatcctggccaatgtggcgaaaccctatctctactaaaaatacaaaaattagacgggcgtgttagcggacgccagtaatcccacctattgggaggctgaggcagcagaattgcctgaacctggaaggcggaggttgcagacagctgagatagtgccactgtactccagcctgggacacacagcgacactctgtctcaaaaacaaacaaacaaaaattagctgggcatggtggcgggtgcctgtaatcccagctactcgggaggctgaggcaggagaatcgcttgaacctgagaggcgaaggtttcggtaagccgagattgcaccactgcactccagcctgggtgacagagcgagactccgtctcagaaaaaaaaaaacaaaacaaaacaacaacaaaaaaaacaacactgcccggggagttcaagccggggcaattcaacaagaaaaagaaaaagcatccagataggaaaggaaaaagtgaaactatctctcttcacatattatatgatctttcttttgtttttttgttttgagactgagtttcactcttgtcgcccaggctggagttgcagtggcatgatctcaactcactgcaacctctgcctcctgagttcaagtgattcttctgcctcagcctcccaagtaacggattacaggagcccaccacgatgcccggctaatttttgtatttttagtagagatggggtttcaccatgttggccaggctggtctccaactcctgacctcatgatccgcccacttcaccctcccaaagtgctgggattacaggcatgagccaccatgcctggccagacacgatcttatatatacaaagccctaaggaatcgatacaaaaacactcttagaactaataaatgactagagccaatgaatatacaagaatcactggtgtttctatacgttagcaacaaatgattcaaaaggaaagaagactcgctatcactgagatggcaatactgccccacatgcagtccgtatcagggtcccagctacttttgtcgaaactgacaagctcatcccaaaattaagacacaactacaaagcacctagaaaagccaaaccatcctgaaaaagaagaaccaagttggaggcctcacacttcccaattttaaaacctactacaaagcttcatcccaatgacgcagtgcatatggacatacagaccaagggaacacaatgagagccagaaacaaaccctcacacgagcagccatctaacttttgacaagggtgccaagaccattcagtggggaaagaagtgttttcaacaaatggtgctgggacaactgcatggccacaagcaacagaataaagctggatgacctcacacaacaattttttttttttttttgagacagtctctcactctgtcgcccaggctggagtgcagtggcacaatctgggctcattgcaacctccgcctcccaggttcaagcaagtctcctgccgcctcagcctcccgagtagctgggattacaggcgcctgccaccatgcctggctagtttttgtatttttttagtttcgccatgttggccaggctggtctcgaactcctgacatcaagtgatctgcccgcctcagcctcccaaagtgctgggattacaggcgtgagccaccgtggctggcccaaaatgttttctgatccatcaaaatgaatcaaaatcctaaagagctaaactaaaaataaatgatctggactttataaaaatttaaaacctttgtgcattaaacgatactatcaagagagtgaaaaaagaattaacagaatgggaaaaaatatttacaaatcatatatttgataagaactttatctaaaatatataaagaactcatacaactcagtaagacaaatacagtcatgaactgctcaatgacaaggatccattctgagaaacacatctttaggtggtttcatcacgtgaacatccaagagcacagacacagaccagagccccccgcacacctaggccacacggcacggcccaccgcacagacacagaccggagccgcccgcacacctaggccacacggcacggcccaccgcgcagaaacagaccagagcccccgcacacctaggccacatggcacggcccaccgctcccaggctataaaccggcatagcatgtaactgtattgcatgccgcaactgtaacacaacagtatttgtgtatctaaacatagaaaaggtacggtaaaaacacagtttaaaaaaaaggtacaaaaaattatggctatgtgggattactgtcatatatgtggctcgttgttaaccagaacattcttatgcagtacatgaatgtgacccagttttcaaatgggctaaggatgtgaacagatttctccaaaaaaaatctaaaatggccaataagaaaatggaaagatgttcaaaatcactacccattagggaagtgcaaatcgaaaccactatcaaatagcacttaatacccactaggatggctaccatcaagtcaggcctggcagaggttcacgcctgtaatcccagcactttgggaggccgaggcgggcagatcacctgaggtcagaagttcaagaccagtctggccaacatggtgaaaccccatctctactacaactacaaaaatttgccaggtatggtggtgcctgtggtcccagctacttgaggggctgaagcaggaggatcacttgagcccaggaggtcgaggctgcagtgggctgcagtcactgtaccccagcctgggtgacaaagaaagacccagtttcaaaataaatataaataagacaaagtaagactatctcaaaaaacaaacaaacaaagtgaatggataaacaaaatatggctgatctttctgttccgcagtgagcagctctgtgcaaacctacccataaaggctggggaagctggaaggctgaagagaggctgaataatccagtttctcagacagaaacgtttaaggacttacagacagaaaccatgtctcaggcagcctagagagacgatgcatccctgcactgttacccccaggcagggcttctataccacagggaaggactattgaagtcaacccctcagggaaaggcaagaatgctctgtgaatctaaccgctggatttatggtggaagatttgcttttttgttttgagatggagtctcactctgtcacacaggctggaatgtagtggtgttttcacagctcattgcaacctctgcctccccggctcatgcaatcccacctcagcctcacgagtagctgggaccataggcacacactaccatgcctggctaatttttttttttgtctagacggtttcaccaggctggtctcgagctcctgagctcagatgatccgcctgccttggcctcccagtgctgagattccaggcatgagccactgcgcccagcctcaaggttgttttgacctaagagtgggatttaaggtaacagcagataaatgggaaatctcaggaggcattcttggagtagggttaacaagaagtcacccacgatggaggtgcgtcagcctccataccttctgtgagcatcagtcagccataagaaggaagggtatgctgatatgtgctacaacacagatgagcctcagaaacattctgctcagccaaagaagccagacacaaagggccacatactacatgattctgttgatattaaacatcccaaacaggcaaatccatgaacataaaatggattcgtggttgccgcaggcaggagacatggggggaagctgcatacacacttgccatctgtactgaatgctgcagctgtaacacaacagtgtgaagctgcaaacaagagcccctggggacaaagcctggacagccccaggtacactccgtccatccttctggcccacatgcaacacctcaggaactgctctgtcctgagaatccctctcagatggagagaggctgtgatgcccaggatctactaggccatttgtgccgtgcttcacacatgctcaccttgaataccaggtgacagaacagaaaaacaacgttgttgctatttttatcttttttttgagacagagtcttgctctgtcgcccagtcggctcactgcaacctctgcctcccaggttcaagcaatcctcctgcctcagcctcccaagtagctgggattacaggcacccgccaccacactcagctaatttttgtatttttagtagagagggaggtttcaccatgtaggccaggctggtctctaactcctgacctgaggtaatccacccacctcagcctcccgaagtgctgggattacaggtgtgagccaccacgcccagcccgaagttgtcgcttctgacaagtctatacacataaagaaacaaccgatgcaggaagcttggctttattttgtattgacatagatttgctatgtgataggctcaagtgtactttgcataccaaaattggactgagagaaaaatgcattcttagaactaccatgattaaaagtaaggcctcatcggtgtgtgatggttaatactgagtgtcaacgtgactggactgaaggatgcaaagcattgatcctgagtgtgtctgtgagggtgttgccaaaggagactgacatttgggtataggctgggaaaggcagacccaccctaagctaattagatgggcaccagcatggccagaaactcccctttatatatatcctattagtcctgtccctccagagaaccctaatacagtgtgtgctgctaacctttggtggaaatccatcagtgcgttgacaagaatggtacacgcagcctgcaggtctccgtcacagccccctgaagccgaggactcagggagaaagtgctcatggatcgcccactggtggaagtcctgcctagaacagcaaacactgctatcaattctgagaaatgcttcgtggccagcggttccccataaccagggaataggcccatagtaagggacacacagcactagtgagagctgggttgagactggcggctcgggaccttggagtagggatgagacctcactgtctgcagggtgggatgcctggggatgtgggaaaggcctggtctcaggagtgacctttgtgaccccaccttccacggatcaaaggccactcaggatgacatcccacggggtaactgctggccacacagcacatgagcttggtgaacagaataggcaagcacaaaaatgtaggctggggcaggtgcagtggctcatgcctgtaatcccagcactttgggaggctcaggcgggcggatcacgaggttaggagatcgagaccatcctgggtaacacggtgaaacctcgtctctactcaaaatacaaaaaattagccgggcgtggtggtgggcgcctgtagtcccagctactcaggaggctgaggcaggagaatggtatgaacctgggaggtggagcttgcagtgagctgagatcatgccactgcactcctgcttgggcaacagagcgagactccgtctaaaaaaaaaaaaaaaaaaaaaaaaaaaaaaagtagcctggaaagtcacctgagggcacctgagctactcacaggcccaccagaaggggatggtgaagcaacctgcatccagactgtggactctgtggatacggatgggaaggggctcaaggagacactgactcaaaactgcagtggctacacctgtaatcccagcactgtgggaggccaaggtgggaggatcacttgagcccaggagtctgacatcagcctgagcaacaaagggagaccccattcctacaaaaaataaaaaaattagctgggcatagtagtgcccacctgtggtcccagctactcaggaggctgaggcaggaggatcactcgagctctggagagggaagctgccgtgagccgtgagtgcatcactgtactccatcctggccaacagagtgagaccctgtctcaaacaaacaaacaaatccgcagtgcacagaaccatcaataccgcaatccatttatgcagaaagagccacaaccaggaaaacgctccacacgaccctgcaaatgtgagtgctagggagtgtgtgctctcctcacactgtccgggactggggtgctccacccacgctgtgcgggacctgggtgctccacccacgctgtgcgggaccggggtgctccacccacgctgtccgggaccggggtgctccacccacgctgtccggaactggggtgctccacccacactgtctggaactggcacagaatgtatctaagtatcacttaagtaattcagaaaagaaagaaaatcccgcaacacatctcaacacaacttccacgcagcggtgacctgatgcagcatgacctcatgcagcagacaagcccctccctctgacctcctccttagactccaccccagagagcagccgggaggagaaacgggggtgagtgaaggaagcgcctgcagagcgggcttggcacgacctgaaccatcagcacgtgttttgccgcaggcagcagcgagttttctttttgtggcccctatgttttccttttcctattacttccattggtttcatccagaatctgataccaggatccaggtgcaggcgacagtgctgcatgtgcctggaaggcccctgatggccggaaggacgaggagcacagggtggctgttgccaaccctctcctgagtctaggtgtggcaggcaccctgaggcccatatacccaccaggatactccatatctgcagtgaccacattcccctctccctgacctccaccctaaactccacacccttaaacccaacggtcctctgggctccctactcctatgcccagaacagcacatctggcctctcaaatagtctcaaatggtctcagtcatcagccctgggactcatgggggttcactgcttcatttacccacttcttggtgcccccaagtcaaggctggcatcactcctcaaagtctgcaccacctgctccacaccagcctctgctcctgcctggtcatttcctctcacacggccctgtctgttatctccagggctcattcctacctttaatccacttctgtatctacctgtgtgttgccagggcctggacacaggtgtacagctcccggacagcagccatagcccagccagggtagggtgaagtctaagtgggtgccttatacgtgccacatctgccctcattgatacaaaggtgccatatgggcaggcttgtttattcccctctatactccctgcttctagaacactctagaattgtctgccacatggtaggagctcagtaaatgtttcttaaataaaggaataacaaccgaaattgggcaacctggccaggcgcggtggctcacgcctgtaatgccagcactttgggaggccaaggcaagtggatcacgaggtcaggagattgagaccaccctggttaacacggtgaaaccccgtctctaccaaaaatacaaaaaattagctgggtatggtggcgggcgcctgtagtcccagctactcgggaggctgagccaggagaatggcgtgaacccgggaggtggaggttgcagtgagccgagatcgcgccactgcattccagcctgggtgacagagcaagactctgtctcagaaaaaaaaaaaaaaaaagaaaaacagaaattgccaccgcgtggaagctttactttcgcttttgctttaataaatcttgccaccgaaaaaaaaaaaattgaaattgtgctcaaagattaacaggtaaaccaaacattaaattgaggataaaatgacgaaacataggctttaaggcaatgtggaaaaccgtgtaacattttaaagggaagctcctttttcttttgagatagggtctcactccgttgcacaggctaaagtgcagtggtgtgatctcagctcgctgcagcctctacctcccaggctcaagcaatgctcctgctcagcttcccaagtggctgtgatgactggaacgtgccgcatgtccggctaatttcttttctattttttgtagaaatggagtttccccatgttgcccaggctgacctcaaactcctggattcaagagatctcctgcctcagcctcccaaagtgctgggattataggtgtgagccatcatgcctggccagggtagctcttttcaacacttaccgttcagtatctgaaagagcatcagcttcaggttgaatttccagctccaggtgtaaccagtcttggtaagttaactgagaaagagagcaagcaattcaatacaatgaggacagaacacacaatccaccgacaggtttataaaccagtttgtcatttcatctcatacgcagtcctccatgtccctgtgttataatgaaattgcagctgagagttccacaggaaagaaaccttagttttatcaagaatgatttcttacaggatttccctagcacaaagatgttagtactgtaatccttctttctaagtataaaacggctattttagtctgggcaacatagtaagacctcatctcatttaaaaattacctgggcacggtggctcatgcctgtaatcccagcactttgggaggctgaggccagcagattgcttgagcctaggagtttgacaccagcctaggcaacatggtgacaccccgtctctacaaaagatttaaaaatcagccaggtgtggtggcacatgtgtgtggtcccagcctcttgggaggctgaggcaggaggatctcttgagcccaggaggtcaaggctgcagtgagtaacagagtgagaactatctataaaaaggaaaaaaaaaaaaaagaaaaaagaaactaacaaaacaacaacattctacagctattcacagtagcataccttcatttatttttggaaacaggttctgttgcccaggctggagtgtgtgcagtggtgcaatcgtagctcgctgcagactctgcctcctgaactccagaattctccccctcagcctctcagatggctgggactgcaggtgcacatcaccatgaccagctaagttttttaaaaacatttttaggaggccgagcacggtggctcatgcctgtaatcccagcactttgggaggccgaggcaggcagatcacgaggtcagcagattgagaccatcctagctaacacggtgaaaccctgtttctactaaaaatacgaaaaaaaaaaaaaaaaagggttgggcgtggtggctcacacctgtaatcccagcactttgggaggccgaggcgggaggatgatgaggtcaggagattgagaccatcctggctaacacagtgaaaccccatctctactaaaaatacaaaaagttagctgggcgcggtggcgtgcacctgtggtcccagctacttgggaggccgagtcaggagaatcccttgaacccagaaggctgaggttgcagtgacccaagattgtgccactgcactccagcctgggcaacagaggaagattccatctccaaaaaaaaaaataataatttaaaaataataaaataatttcacaaaaggcttggcacagtggctcacacttgcaatctcaacatattggcaggccaaagcagaaggatcactttttcctatttttagtagagatggggcttcatcgtgttacccaggatggtctcaatctcctgacatctcagcctcccaaagtgctgggattataggcatgagccactgtgcccagccaccttgaaattcttttctaaagaccaaaacaaccaggcaaacatcctcagaaataaatcagtaccaaggcacactggtgagagcaatgccagctccagtaaccaggcacacatgggtgagcccagagaccctgagtgaccaccacacagcctggcagacatgtttaaaacaagttcccaggggccgagcgcagtggctcacacctgtaatcccagcactttgggaggccaaggcgggcagatcacgaggtcaggaggtcgagaccagcctaacatggtgaaaccccatctctactaaaaatacaaaacttagccaggcgtggtggtgcgcgcctgtagtcccagctacttgggaggctgaggcaggagaatcacttgaaccagagaggcagaggctgcagtgagccaagattgcgccactgtgccccagagtaagactccaccagaaaaaaaaaacaaaacaacaacaacaacaaaaaacaagttctcgggcgcaatggctcacgcctgtaattccagcattttgggaggccaaggcgtgtgggtaatttgaggccaggagtttaagaccagcctggacaacatggtgaaaccccgtctgtactaaagataccaaaattagtcgggcgtggtggcaggcgcctgtagtcccagctactggagaggctgaggcatgagaattgcttgaacccaggaggcagaggctgcagtgagccaagactgcaccactgagcacagcgagacgttgtctcaaaaaatatatcagtaaaaataaaaaaagaagttcgtgttgggagaaactgagaaagtatagcagggtttctctgtatttattaatatatttttttgagacagggtcttgctgtgtcatcctggctggaatagagtggcgtgatcttggctcactgcaacctccacctcctgggctcaagtgatttctcttgcctcagcctcccaagtagctggaaccaaaggtgcacacaactgtgcccagctaatttttgcattctttgtagagatggggtttcactatgttgcccgggctggtcttgaactcctgagttcaggtgatcaacccgccttggcctcccacagtgctgggatcacaggtgtgagcaccgtgcccagtatctgtataatttcttaagagctgcacatgaggccacaacgattttagtcaagattccaatcaaaccatctaagtgctgctgttcttgcctctgaggagacagtcggcacacgcaccctagactcgagacgaggagacagtcggcacacacacaccctagactcgggacgtggcatgatgcaggggaaggaacggtcacctacgtgctgctgttcttgcccgaggagcacacacaaaccctagactcaggacgtggcatgatgcaggagaaggaacggtcacctacgtgaacatcttcctctttcaacacctctcggaaggttctgtgtgtccagagagagagggcagctctctgccagtctgcagaaggaaggtgcaagggtctccaggaaaggctggctacgtcctcctcagaaagaggctgtcgggcctctgagaacaatctgaacatgaggaactgaaactgaaacagagagtgacccggccgtttcttcattgcgcaagtttcactgtgagtggctgagcaaatgctcaggtggaaacagaccatcaacagcccacacacacaaccccacattcagaggacctcagtccagcccctgggagggcgcaatacacgaccccacgttcaggggacctcagtccagcccctgggagggcacaacacacaaccccacgtttaggggacctcagtccagcccttgggagggcacaacacacaaccccacgttcaggggacctcagtccagcccctgggagggcacaacacacaaccccacgttcaggggacctcagtccagcccctggaagggtgcagagcccctcagcgatcatggctgtgcacagtgctccagggaagagcctatgtgcagaccttcctgccatctgactgcttccttgagctaaatgtctggaagcagaattgcaggaacaaaactgcctcccaggggtagggctggtttggtcccgggcagtgaaacagcccatctctaggcctctgccaggaatggcgttcccaccaaaaatgcacaccaactggacaagccagacacactattggtgctgcgtgaccgtgtccatctctgcccccgaggagatgagagcctcccatgtttataaccagcctgctccaaggactgtcgtccctgctcagcatgctgggtgggaaccacgctgccctctcctaagctcaaactccatgttttctttaaaaacttggcaccagggacaaagttcctcagaggaaataactggaaatacgtgcaccctggatcctcaggggctgctcccagattctgacttaatttatctggaaaggggccaggaatctatagtttcaaaagcttctcagttgattctaatgtgaagcctgaagttgaaaaccattatttatttatttttttttttttttgaggtggagtctcgctctgttgcccaggctggagtgcagtggtgcagtctcggctcactgcaacctttgcctccctggttcaagcgattctcctgcctcagcctcccaagtagctgggattacaggcgtgcgccaccacgcctggctaatttttgtatttttagtagagaccaggtttcaccatgttggccaggctggtctcgatctcttgacctcatgatctgcccgcctcggcctcccaaagtgttgggattacaggcatgagccaccacgcccagcctgaaaaccactattttatacacgagacgttcattaaaatcctataaaaggacaacactggtttgcagtgccatttcacctttacttttgacattcagggtttccaatgctcatctttaaattcctttgtctgggccgggcaccagcggctcacgcctgtaatcccagcactttgggaggccaaggcgggtggatcacttgaggtcaggagttcgaaaacagcctggccaacatggtgaaaccctatctctactaaaaaacatacaaaacaattagccgggtatggtggcacgtgcctgtaatcccagcaacttgggaagctaaggcaggagaactgcctgaacccgggaggtggaggttgcagtgggccgagatcgcaccactgcactccagcctgggcgacagagcaagactccatctcaaaaaaaaaaaaaaattcctttgtctgaacaatgtaaggaacatttactagatgagaggaataagaattcttctttccagggaaagatacttattatgaatactgatcttttaattcatctatcctataaatgccaacatctatttcattacaattacagacttgtagttgtcttcatacaacttcactttacactcagagaacacaaggaaaggcagcactcagcagtcaggctgcctaagcagacagcagaggtggccatgacagccagcctgactcaggagctgccccatgacagccagcctgacccaggagctgcccctgagatgggcacaaagcggcagcagacctcggccttccggtccgaaagctgcgtaaacctgaaacgtatggcagaatggaaaaataggaaaagagtgaacctacctttttaataaggcctggagataagcagctgcacaaagtatctcgtgactgggaagaaaacttgcagagagagtaagaaattgctgctgtacaaaatctgaaaacagaaattataacatataaatgtaatccatacaaaataagggatgaaggaaaaagttactttgaatttcataaaactgaatttagtgcattccgaactggatggcctgagcattggtccttcgttttttggttcgtttgttgtgagacagtcttgctctgccgcccaggctggagtgcagtggcaccacctgggctcactgcaatctctgcctcccgggttcaagcgagtctcctgcctcagcctcccaggtagctgggattacaggcatctcccaccatgcccagctgattctgttgtagttgttgttagtgctttttttttgagagggagtcttgctctgttgccaagccggagtagagtggtgcgatttcggctcactgcaccctccacctcccaggttcaagcaattctcctgcctcagtctcccgagtagctgggactacaggtgccagcctccatgcccagctaattttttgtatttttagtagagatggggtttcaccgtgttagcgaggatggtctcgatctcctgacttcgtgctccgcccacctcagcctcccaaaatgctgggcttacaggcatgagtcactgcaaccagtcgagtttttaattttttttagtagagacggggtttccccatgttggacaggctggtctcgaactgctgacctcaagtgatctgcccacctcagccactcaaagtgctgggattacagcgttagccaccgtgcctggcccagccctcggtttattttttgttttatacagggccttactctgatgcccaggctggagtgcagtcgcacaatcacagctcaggggatcacttaaacccagaagttcaagaccagcttgggcaacacagtgagaccccatctctcactagctgggtgtgtgggtgtgcacctgtggtctcagctactgggaggctgaggtgggaagatcacttcagcctgggggacacagtgagacctgtgtcatttactcaacatacatacctacagcaatacccatgtgaaaaattctcacttgtaaccaaggaagctcagaatgagattccatgaggcaatggagatgtcaaagcactgtcatggtgttcttacagttctaatacttctgttttactaatacatatttgagctgggcgtggaggctcacacctgtaatcctaactgaagtgggcagatcacttgaggtcaggagttcaagaccagcctggccaacatggcaaaaccccatctctactaaaaatacataaattagctgggcatggtggtgcacacctgtagtctcagctactcaggaagctgaggcacaagaactgcttgaacccgggaggcggaggttacagtgagccaagatcacgctactgcactccagcctggacgatagagtgagactctgtctcaaaacaaaaaccaaaaaccaaaaaacaaaaaaaaaaacaaaacacacaccaaatatatatttcattctccctttcttatgcaaaaagtagcatctgagaccgagttcagtattttgctttcttcacctggatatatatcctgaggcatctctgtgtttctaagagaggatggccctgtctcccccaagccacctggatgcctccctcctcaccagctcccaacttctccattggctgtgtgcctctcatgccaacacccagtactcagtgtttggggcctggggtgagtggggactgtctggtgtggccaagcgcctaggagggactctgtatccccggagtaccgagtgcctgctccccgaggcccatgtctgaggtgtgggatccgcacagctgccatctgactccctctccttgctccacgtacatttcttgcgcctcttctaagttctctgttattcagaccctgtcataatgtcagatctcccctttcccgcacagggtctccggcaccgcaacagggctctgtcccgacctgggctacctctgcccaagagaccagaagctacaagccaagccccagccagcaactcccaccagagtctcccagccctctgtcctggcttccgcctctgagtggcagctgaagggattctgtcctggcttctgcctgtgcgtggcagctgcagggagcccttgaggcactgagcagaccattcttaaccacagggtccttcctcacctcagcacatggccccatctgctgagccctagagaaacagcccgaggtgtacacactgggaagctactcaccatggggtgccgaagaacctgaccagagggagctggtccaaccaagggccagacaagggaccaagacaaaacaaagcagctctcaccaggacatcaaagaatgcttaacgatatagacagttactatctactattaatttcagcagtttagtataatatgatctcatttttatgaacaaagaaacaaacgcacgcatattataaacaaatgacagataaaattctggaaggatatataccaaaatgctaaaaagtggttatctttgggtggtatgtctgcatgtctgtctcttctaattttatcaaacgagcatgtgtcacttttcgagagagaggagagaagacgcgactgtggaagaagagctcacttcaggcagaagaacaaggaatccctcgtcctacaggtcaggaggctgtcaaagagcgcagggacaggaaggccagcaccaggtgcaggaggacccacatccacctctgggagcgcagacctggactcacccaggtgcacggccagggcagccaaccccagcacatgtggggcactcaggctcgggccctgcaacgagaatgagggtggcagagcagactgccctcttccaagctggaattttccagggcactgaagacgaattgagaagtagcagcctggccctcagagtgggcccccaagggtggcccccatgaaggagagcctcacctggtgacggagcagctggcagagccgggtgagcactgcagggagcacacgtccacacatggtcctcacgaagagggcagcccagggaccctgcctgcagagacagccgtgaaaccatcagtactagccattcagtcctgcacatccctccaacagctaatccaaccaccagcggccgaagaaagagccaagctgttccccaaaacagtggtctttctggaagacaacccatcttctgcagtgcttcccaacttctgctgcgtcctatttgatgaaactcagcatcgccgcatgctcctgcggagacgagctcatgagtccctggtctgcagacttggcccagcaagaggtggcacccagaggagccccaccactcagggagctgcccgcgccttcacctctccgggggagcgacactggaggcagccatcaggttctgacagaaagacgtcagcaggaggtccacagcctgcagagacacagttctcatgagcgtggtgtcctggggacgggagcagcaggaaggaagccggccagcgctcccgccacagacatcgcaattctgctttgcaaaaagacctccaaaacaggcttgtttggagggcatgttacaatgcaaactggtgcccagggcccccattccccaatcttgggaatagcagccctcaagtaatcgccaatcacaaaattctacagcagcaggcgggactggcaaaccttgtgtgtaaggggccagaaaaatattttaggttttggggccagaaacagcctctgtcgcatattctaaagaggcagtcgagcccaacctggtcaacatgatgaaaccctgtctttactaaaaatacaaaaattagctgggcgtagtggtgtgcacctgtaatcccagctacccaggaagctgaggcaagagaactgcttgaacccaggaggtggaggctgcagtgagccaagatcgtccactccagcctgggcaacagagaagactcagtcaaaaaaaaaaaaaaaaaaagaggccaagtgccgtggcttatgcctataatcccaacactttgggaggctgaggcagacagatcacttgacctcaggacttctagaccagtcgaggcaacacagagaaaccccaactgtacaaaaaatgcagaaattagccgggtgtggtgatgcacgcctgtagtcccagctactcgggaggctgagacaagaggatcacttgagcccaggatgtcaaagctgtagtgagccatgattgcaccactgcactccagcctgggcaacaaagcaagaccctgtctccaaaattaaataaataaataaaatgtaaaaggagctcttcatacacaaacagactgtggcagctgaccctggtacaccgctgcctggccctggaacatctgatacgacactaactgagcaagtcaaacagaaattgagagaaggctccatgcgtctaatgcctctgcctaatggaaaatggtgaagaccccctgctttgttctgagcccctacacctaccatgtgttcccgtggctccagtctcggcgtgttgatgctgagctgaatctttgatatctcaacgctgctgtcatcctcattgtggcccaggacagccctcagtctttcagaaatcactgccacctgtgccgatataactgcgaaggaagaaactagttagggatgacaagaaccccgaaaggagggatacagctgcggcctagagagctccgcctcccgtcaagtacgattccacggatcctgctgactgcacacatcccccagccaggtgctgaacaccagtgtttgttcgccccgcaggatttgcagccttgtggtgcagcatgtgtcatggcaaatggggccagacgccatccactaccttttcctgattggctgagagggggacatgttcattcaccaacatgaacctccccatctgaaatcccatgccagccctccagacaccacatctgcctaagcgcatgccagaggttccatgttggcccagggaaatgggccacacatagcccaactacatcatttaaaggtgaaaaccgctttgcttttagaaacaggactcacctgacatgtatcaacctcttgcttaagcactggaacttttcctccatgtcccccatgtaccacattctgcacaagccatcattgaatcaccggaaggctgcactcaggaactggcgcacttggtctgagtgaagaccgccaaggcgctgcagccccagctagcgctaaccaagctgtgttaacattgcctccatgcggagcttgcagtgagctgagatcacgccactgcactccagcctgggtgacagagcaagactccgtctcaaaaaaatatatatatatcacctccatgtaggccaggcacggtggctcacactgaaatcccagcactttgggaggccaacacaggtggatcacctgaggtcaggatttcaaaaccagcctggccaacatggtgaaaccccatctctactaaaaaatacaaaaaattagccagacatggaggcagtcacctgtaatcctagcaacttgggaggctgaggcgggagaattgcttgaacccaggaggcggaggttgcagtgagccgagatggcgccactgcactccagcctgggggacagagtgagactctgtctcaaaaaaaaaaaagaaaaaagaaactgcatgttctcaatccacagatgaacatttcttactctggattttacagaaaaccatcacatggaagcaggatcacagggcagagaccctgtgtgtctgatgtgacatcgactccggcaggcaggatgagcgggaaaacaggcatcctagtcacgcgttttcttctctatcatcattcgtcctactcagatgcaactagccgaatattcaccttctgccaagggtctgtgacagcttcagtaggactagccttccaccttgtctcaaaaaaggttccacacccgccagcccggggtcaatctttaaactactggactactaggaagacacaccagcctgatgtcactatggggaaaatggcccagccacagagctccaaccacaggctgcacacatgagacacagcatgagctcccatccatcctcaccatcacgctggctggggtctgtcatggaggctctcagctctcccagtgcagctgtgagctgtcccaggggctcctcagcagagttgggttctgccctcactcccagggctgcatctgtgagaagaaggaagaaaccagatggaaagacactcaacaggactcttcactgcaaaaatagaaacttcacacagtcaaatacagagctgtgaacttccaagctgctgtgtgtggcagacggagggactgggagtctctgaggaggtaaatgaggtgtcttccctgatgctggatgccacatcgaaaattacaattataaacgagtttcataaaaaattacatttataaacaagtttaagaaaaaaagcggttctgtgtgcaccatcaataccactccaccaccgtgagaagcatacacacggaagaaaacaaggaggatcgagggctggcgagggtggggacaggatcacggataggtgaccatttagtcccctggttcctcaaacttttttttttttttttttgagatggactcttgctctgtcaccacgctggagtgcagtggtgcgatctcggctcactgtaacctccgcctcccgggttcaaatcatcctgcctcagcctcccgagtagctgggactacaggcacgcaccaccacatccagctaattttttgtatttttagtagagacgggatttcaccacgttggccaagatggtctcgatctcctgacctcatgatttgcccgccttggcctctcaaagtgctgggattacgggcatgagccactgcgcccagccaccactttcaatataaaaaggaagatacgctgcatatgtttttaaagtaaaaaaccttcaagttctggggttgctggagaagacacaagcatgaaaatgcactgctatgcacagccacagccaaaatgaaaccagaaatcacaggctctagaaatcataggctctaggagtctgtgcataagcctcatcagacaaatgattagaaaccattctggaagccaccaaaagctacgaacaagtggaccccaggggaaggaggatcctgggggaaggaggacacctctcaagagaagcaaacgcctcacaccgcagggtacacagccctgaggcccctgtggcatccccagcacaactgagaggtcatgctctcagggtgggtcggccgggcatgggggctcccacctgtaatcccagcactgtgggaggccgaggcgggtggatcacgaggtcaggagattgagaccattctggctaacacggtgaaaccctgtctctactaaaaacacaaaaaattagccgggtgtggtggcgggcgcctgtagtcccagccactcgggaggctgaggcaggagaatggcatgaacctgggaggcggagcttacagcgagctgagattgcgccactgcactccagcctgggcaacagagcgagactctgtctcaaaaaaaaaaaaaaaaaaaaaaaaatctcaacgagcctccctggccctgcaggtggaaggggatctagaagagcacacaaggggctgggtacggttgctcatgcctgtaatcccagcactttgaaaggccgaggcaggcggatcagttgaggtcaggagttcgagaccagcttgtccaacatggcgaaaccccatctctactaaaaatacaaaaactagcaaggcgtagtagtgcgtgcctataatcccagctattacagaggctgaggcaggagaactgcttgaacccagggggcagaggtttcagcgagccaaaatcgcgccactgcagtccacagccacagagcgagactctgtctcaaaaaaaaaaagcccacagggaagcagcagcctcagatctatgtcttcagctcatagcggctcccacagggagatgctggcttctactggagataaagccacacacttcaagaaaaaccagcctcatgatggcatctcccactgctgcctgagtgcagcctttcacggattcccaatgagggcgtaggtctgaccgacagctgcaccactgctccccacaggccaaaagagcctgacttctactcctacctgcactgtgcaacagaaaagtgctgcatgacactccctacgacaggctcgagccagcgctgtgggccccaaggtggccgctgagagagcacccgagtctgaagcctgtacaaacacctcagtgcggcccacaggaagatgacgagtgacaaagtggggctgtgcactgcacacactcctttccggaaggtgctaagtgattcttcaggacccccaggtaagagtctgtgccacagctggcactgggcgtcagcatggtgggcggaccctgtacccaaagcaccggcttgagctggcacagccacccccgagctcactcgggtggtgtagcacaacagacactcaaggttaggaaaatggaaaagcacaagtcccagagtggacaagcggcccaggaacttaccttctggcttctcttcagcagcagagcaggcctggcagtaggtggagtacagagatggggggattttatctgctctggatcacaggaaaacaatacaattaagtcagctatggcttaaattaattcaagattacaatccccaaatctattataaaataaaaacatattaaatttaaataaattataaatactgtgtacagtatgagcctgtttttacaaaaaaatattaaaaaatatatatagatttaaaaagcactgtttcaaaatatatcatattaatcatatattaatatctaaggagctagaccacaaaataccaccagtgattatccctgggcagtgaaattataaattatttctatttctctcatacaatttttggtaatttccaaattcaaaacacgaatctttgtttttcttttttttttttttttttttttttttgagacagagtctcccactatcacccacactggagtgcagtggtgcgatctcggctcactgcaacctccgcctcccaggttcaagcaattctcctgcctcaccctcccgagtaggtgggattacaggcgcctgccaccaggcccagctaattttttgtatttttagtagagacggagtttcaccatgttcaccaggctggcctcgaactcgtgaccttgtgattcacctgcctcagcctcccaaagtgctgggattacaggcgtgagccaccacgcccagcaaaacatgaatctttgttaattttaatgattaatactaagaaaaacgtttagttcgtgtcattaaaaatatgcaaaattgggccaggcgcggtggatcccgcctgtaatcccagcactttgggaggccgaggcaggcagatcaggaggtcaggagattgagaccatcctggctaacacagtgaaaccctgtgtctactaaaaatacaaaaacaaaattagccgggcgtggtggcgggcgcctgcagtctcagctacttggtaggctgaggtgggagaatggcatgaacccagaaggtggagcttgcagtgagccgagattgcgccactgcactgcagactggctgacaaaccgagactccgactcaaaaaataaattaaagaaaaaaaaataaaacgcattagttcatgctaaaaatccttagcaaattagtaagagggaactttcttaacatgataaagggtaagccaggtacagtggctcatatttgtaatcccagcactttgggaagttgaagcaggaggattatttgaggccaagagagagagaagcctgggcaacacagcgaaaatccgtgtcctcaaagcatttacaaaatggctgggtgtggtggagcgcgcctctagacccagctacttgggaggcagagggggaaggattgttgaaacccaggaggtcaaggctggccaggtgtggtggatcgcgcctctagaccctgctacttgggaggcggagggggaaggattgttgaagcccaggagatcaaggctggctgggtgtggtggagcacgcctctagacccagctacttgggaggcggagagggaaggactgttgaagcccaggaggtcaaggctgtagtaagccatgactgcaccgctgcattccagcctgggtgacagagtgggaccctgtctcaaaacaaatgaaagtaaggatcccagagaataaacttattttaagatttaaaaaattatttttgcagagcatggtggctcacgcttgtaatcccagcactttgggaggccgaggtgggtggatcacaagatcaggagtttgagaccagtctggccaacatagtgaaaccctgtctctactaaaaatacaaaaaaagaaaaaaaaaaggctctttgtgtttatcttcttacaggtcccagaactttataaattttgctggaatataggacttatactttcctatttcttccaaagttggttgataccaaccaactttcttactagaaacctgcaatgtaagtgatccaaggataccttattattctaaacaataacttccaggtctactctcaagttctgcagcatgaggctttcccagagctctttcattttccttcagttctcctctctgcacaatcattatgtactgaaacattttctttcactgaagaatgatgcagccgggtgcggtagctcacgcctataatcccagcactttgggaggccgaggtgggcagatcgcttgagcccaggagttcaagaccagcctgactaacatggtgaaaccccgtctctactaaaaatacaaaaattagccgggcgtggtggtgcgcgcctgtaatcccagctactcaggaggctgaggcaggagaattccttgaacccaggaggtggagggtgcagtgagccaagatcgcaccactgcactccagcctgggcaacagagtgagacttcatctcaaaaaaaaaaaaaaaaaaaggccaggagcggtggctcacatctgtaatcccagcactctgtgaggatgaggtgggtagatcatcttctgagctcaggagtttgagaaccgcctggccaatatggcaaaaccctgtctgtactaaaaatacaaaaattagcagggcgtggtggtgcatacctataatcccagctactcaggaggctgaggcaggacaattgctccaacccaggaggcagagcttgcagtgagccaagattgtgcaattgcactccagcctgggcaacagagcgagactccatctaaaaaaaaaaaaaaaaaaaaacttagccaggcacaggcttgtaatcccagctactcaggaggctgaagcaagagaatcgcttgaacctaagatgtggaggttgcagtgagccaagatctcgcctctgcactccaagcctgggtgacagagtgagactccaactaaaaaaaaaaaaaaaaaaaaaaaaaaaaaagtaaccaaccaattttggagccaatattttaccaataaaacacaatagtggtctaacaaatttctctacagaagatccacaattcttcgcattgtcagaagaaacctggaagtagtcatccccttctaaccgttgctgcatacctcttcagagactctataaacgccacacgggagtcagggactttggggagctgtgggaagagaagagacctgtgagagactgacaaggaaagtccttgctttctacacaactggtcacaaactcatggagacgcatactgaccactcgaggtgtgagcagggcggggaggaagtgggacacgtagtaaggcctcctgaatatgctgcaacacagagaagcagacagtgcatcagtcagagcagcgagaaggcaattcccacagacggtgaccggtgtttcagagagtggactgcgagggctcactccaaagccacgatgcattatgaagtcttcttgtgcacagttccgggacaaggcatgtgtagggcaggccgtgctagcccagccctgagtccgtgggaatcaggaccacattcggcctgctccctgggcttgaacgtggagcctggatcaatctgaggccacgaggaccatgtaaggtccatttggggcaatttccttggagctaaatttcaaaaccctgggagctgcaatcagctcatccacatgtgtaaccaccagaattcaagatgttttgagatcataccaaattcaataaagctgtgctattcagctctctgttactgactccatattggtcacaaagaaggcattgataaaaaaaaaaacatcatggccccactgccttccctcccagtgcaagctccccaatcagcagttcctgttggctgcttcagcacgggaggggcatcacctgcttttacagaggaaaaaatgtttcacagcaaatgcacagctcttgacctcaccccgtatcccttaacggcaggatcctcgattcacagccctgactcctgtctctctctgaatagacagtggccaacctgccccatgtggctctgggcagaaatgggacacactccaaagagccccagacgctggcaggcatcagagcggagtctgcacaccctgcaggcatcagagcagagtctgcacatactgcaggcatcagagcgcggtctgcacacactgcagctgctagaggccttttcggcagcccagcctacctggcctccatgacggtgactgggatgttccccgtatgctcaaacaccatgatggccttttcaacatcctgaagagcttggctgtggggctggttcccatacagggaggaaaggaaaaagaacagaggactttaaagaaaagactgagcagtgaaggccacactcaacctgtgcttccttgttgaaaggctctgtacacattaaaggtaaaggcccacatgctgtgcgcacagcaggggccctggagcactccaaaatgtcccaaaataccagcacgacaggggaggatgacactgccacctccacacacacaaggttcagaccccgtgatgtgcggccctcctcgagagctcagctctgctgagagcctgccgtgagcctctttcctgcctccaggaaagagttgaaagtaaagatttctaggtgggaaggagtagagacttaatttttgagattaaaagaaattacgagggctgggtgccatgactcatgtctataaacgcagtgctttgagaggctaagcggggcagactgcttaagcccaaggagttcaagcccggcctgggcaacatgatgacatctcatctctaaaaaaatacaaaaacattagccaggtgtagaggcatgagccagtggtcccagctactcaggacgtggaggtggaaggattgcctgtgcccaggaaatcatggctccagtaagccatcatcatgctaccctactgcagcctgggcaacaggggaagtccctgcatcaaaaaaaaaaaaaaacattctgaggccaggcgcggcagctcacatctgtaatcccagcattttggggggccaaggcggaaggatcacttgagcccaggagtttaagaccagtctcggccacacagggagaccctatgtctgcaaaaaattttagaaaccagccaggcatggtggcgcacacttgtactcccagttactcaggaggtcaaggtgagaagatcgtttcaacctaggagtttgaggctgcactgaactgtgatcacggtactatacttcagcctggtcaacagaacaacatcccacctcaaaaaaaaaaaaaaagtaatttataaacagcaataaattataaatggaaaattatattaaatattttcacctaacactttaatgtcacctataagtgttcttcagtaactcgtaactttaaaataaaaaggtcttaaaaagtaaagaatggagggccaggcgcagtggctcacgcctgtaatcccagcactttgagagaccgaggcagacggatcacgaggtcaggagaccgagaccatcctggctaacacggtgaaaccccatctctactaaaaacacacaaaattagcctgacgtggtggcgggtgcctgtagtcccagctactcgggaggctgaggcaggagaatggcatgaacccggaaggcggagcttgcagtgagctgagactgcgccactgcactccagcctgggcaatagaacgagactccattccaaaaaaaaaaaaaaaaaaaaaaacaatacgctgggcacagtggctcatgcctgtaatcccaggactttgggaggccaaggcgggcagatcacgaggtcaggagattgagaccatcctggataacatggtgaaaccccatctctactaaaaaaatacaaaaaaattagctgggtgtggtggcaggtgcctgtagtctgagctactggagaggctgaggcaggagaatggtgtgaacccgggaggcggagcttgcagtaagctgagatcgcaccactgcactccagccagggcgacagagcgagactccgtctcaaaaaaaaaaaaaaaagtaaaaagtaaagaatgttttcattaggccggccatggtggctcacgcctgtaatcccagcactttgagaggccgagacgggcggatcacgaggtcaggagatcgagaccatactggctaacgtggtgaaacctcatctctactaaaaatatacaaaaaattagccaggcgtggtggcaggcatctgtaggcccactataggctactcgggaggctgaggcaggagaatggcgtgaacccaggaggcagagcttgcagtgagccgagactgcgccactgcactccagcctgggcgacagagcgagactccatctcaaaaaaaaaaaagaatgttttcattagtgacccacacatatcacatgaccatctgacatttggctgctataaaaacagttaacacttggccaggagcagtggctcacacctataatcccagcactttgggaggccaaggcgggcagatcacgaggtcaagagatcgagatcatcctggctaacacggtgaaacctcgtctctactaaaaaaaattaaaaaattagccaggcgtggtggcgggcgcctgtaatcccagcactttgagaggccaaggcgggcggatcacaaggtcaggagattgagaccattctggctaacatggcgaaaccctgactctattaaaaatacaaaaaaattagccaggcgtggtggcggctcctgtagtcccagctactctggaggctgaggcaggagaatggcgtgaacccaggaggcagaggttgcagtgagccgagattgcgccactgcactcaagcctggtgacagaccaagactgcatctccaaaaaaaaaaaaaaagttaacacttttctgtgattcagagaaaaacatgacgaaccacctctccattcaaccccacaggaaccaagatctcccaaaaggacaaatgtcctgcagcctgaggcacttcactctgccacacagtaaccctttccctgccaatgctggggacacacaaggtgggacacagcaacacagaggcccgcagagcctcgcccccagctgcgcccgaggcaagaccagacatgagactgggaaggctgaaaaactcaactcaagagtcaaaagaaactggacctttgcatggtgggcgtgactggctgagaccctgcagggctcaagcaacattacctcagtaatgtccccagctgatgacaaatcctcgtagagtcccatgttttctatagaaaccttcagggaagacacagaatgagaacaagaaaacaaagcagtttctgctgggacaggtgtgaggagtgggcatggagggacagcttgccttgaggtcggccagccgtgtcttggccaatgagatgtagtctgtgaggagggagcggtacttgccgggaaccaggggtgggtggagaatgtgcacctgaggatagatagcagagcgcagcaccgttagtctgggaactgcctgggactccagggaggccacaattcacttccaacatccacagtgctgagtagagaaacacagccctttacagtcagacttatgagtatgcaaagcaaaccattagtaaaattaaaacacaagccgggcgcagcggcttacacctgtaatcccagcactttgggaggctgaggcgggcagatcacgaggtcaggagatggagaccatcctggctaacatggtgaaaccctgtctctactaaaaatacaaaaaaattagccgggcgcggtggtgggcaccagtagtcccagctactcgggagactgaggcaggagaatggcgggaacccaggaggcggaccttgcagtgagccgagatcgcgccactgcactccagcctgggtgacacagtgagacttcatttccaaaaaaaaaaacaacaaaaaaaaaacacaatagaaggctgcttccccaggtgaaaaatcaagaaaccctaatgtagctggtcctgcaagtccagggcggctcactgggggaaccagggatgtgcaatcctagcagcggcagcaggaaccggccccggccgcctgcagctccatgcctttgacttcctggtcaaaggggacagaggggacacagcgtgtttttttcttttgagagggagttttgctcttattgcccaggctggagtgcaatggtgcagtctcggctcactgcaacctccgcctcccgggttcaagcaactctcctgcctcagcctcctgagtagctaggactacgcgcgcgctaccacgcccggctaattttgtattttcagtagacagggggtttctccacattggtcaggctggtctcgaactcctgacctcaagtgatctgccctcctcagcctccaaaagtgctgggttacaggtgtgagccaccacgcccggccaattttcttaaaagatgagggtcaggctgggcacagtggctcacacctgtaatcccagaactttgggaggccaaggcggaaggatcacttgagctcagttcaaggccagcctgggcaacacagcaagaccccatctgtactaaaaaaaagaaaaaaagaaaaaacagccaggtttgctggcatgcgcctgtagtcccaactactcaggacgctgaggtgggagaactgcttgacctgggaggtctaggctacagtgagctatgatggcaacactgcactctagcctaggcaacagagtgagactgtctcaaaaaaaaaaacccaaaaaaacaaaaaaacaaaaaaaaaacccacatgaaattaaaaaaaaaaaaaaaaaagcaaacatgagatcctaaaaccctcactgcagtacaactcgctcttcctgcgtaactgggtgctgagaacgtctctccacgtcaccactcagacctgctcactgttttgagggagactgaacagtgacataatatatctacccacctccttggcctaggtgagaaaagggtttcttagcagttgccttgactggcacacacgcactcactgtgtgtccacgtggacacctccagttgcaatgtttgtgttgtttcaccataaacggcttggggaaggggaaggggaaggggaagggcctggctgagaggctcagagcagatctgcaggaggctcttggggaggccaaggcagtcctcagatgcagcaggtgagcgaagcaccagaaatcatggatgtggcagccagcttctcacctgcaggtaccggggagactcaaaaggcacgagttctgacaagaacgtaaacaggaagaccagggccttcttgctgcagccatggtagcctcgtgtgctcccaaaggaggcctgtgtggagagaagagcgtgaagcccaggacagccaggcgcggctgcaccacctaggcagtgtcctgtgtggagagaagagcgtgaagcccaggacagccaggcgcagctgcaccacctaggcagtgtcctgtgtggagagaagagtgtgaagcccacctaggcagtgtccgggcggctgctgtagtcggcctcctaaacagaaaggaaaaaagagaaacaccaaaaagtcatgtggttcatacatttacagatgtcacgactgcgctttgactgaagagatatctaaaagttattcgaagaaaaacagttaaaaatcattagctataacaaacactaactatgggatccttttgggatccttaggggtacaatttgctaaatgccctaagaagtgtttgtgcacagcaaacaaattgattttgtgggatgaagccacttctgaacacactttaacttctaacctcatccaccagtggacagatcactgcaagagaggtgggtaaggaacacaggccaaggagggccacccctcagacaatgaagctgcaagaccctagcagagcaagcgaggaacatgagcaaaccctcccaggaacgaagggggctgcagcaaagtcctgggggctgcagtgagtcagggaaggaaggagattttaaatgggcatggccctgaacgcatcatagtgaacctgcagacagaatgtgggcctctgtgaacactgaaccgcttacctgcaaaaccagacgagctcctgccaccctagccccacttgagaccacaggacatcctggtgaaacctcagcaagttaccatctatcaggaaacctgaactccaacgtgaactgaaggctcaccttggtctttctgaaagcgtgcaaaattgtgttttgtttttttttttttggagacagagtcttgctctgtcacccaggctggagtgcagtggtgccatcttggctcactgcaacgtccgcccacccaggtttgaacaattctcctgcctccctagtagctgagattacaggcatttgctaccactcccagctatttttttttttttttttttgagagagagagtctcactctgtcatccaggctggagtgcaacggtgcaatcagggctcactgcaacctctgcctcccgggttcaagtgattctcccacctctgcctcccaagtagctgggactacaagcacgtgccaccaagcccggttttttttttccttttttctgagacaaagcctcactctgtcacccaggctggagcgcagtggcgtaatctcggcttaccgtaacctccgcctcccaggttcaaacgattctcctgcctcagcctcctgagtagctgggattacaggtgtgcaccaccatgcctggctaattttgtgtttttagtagagacagggtttcatcgtgttggccaggctactcttgaactcctgacctcaggtgataccttggcctcccaaagtgctgggattacagacatgagccaccacgtctgacctagctaatttttgtctttttagtagagatgaggttttgccatgttggccaggctggtctcaaactcctgacctcaagtgatccacctgcctcggccttccaaagtgctgggattacaggcatgaactatcacacctgaccatgtgtagattcttttgaatgttatcatcatgcagacagacccaaaaagccattagataaaaagcggaaaatgctgataacgcttgtcaaatgtctctgagagggacagagtcacggaaaaacaaagctcagagacatgaactgtctgtgccaaataccaggaaagcagctcaatacttgtcagttaaaaatttaaataaaacctgagaccactcaagggttcccttctcaaaacatcagcacccagtttcaacctgaaattctcccgccaagcacaccatgtcttatcaccctccattcagccatccacaacacaactgctcctgtctcttggcaacgttcactcaattaacagtgagccagatgatcactggccgcagcaggaacagtccagacccgtcgccaaaggcatttctgtaaagcatctaagtgacacgcgcaagccagacctggggtcacagcagccattgttagagttgctgagataaaaggcagttctgtttgctatttttgaaaaaattacacttaatggctgggtgcagtggctcaatccggtaattccaacactttgggaggttgaggcaggaagatcacttcagcccaggaggtcaagaccagccaggacggccgggcgcggtggctagcgcctgtgatcccaacactttgggaggctgaggcgggcagatcacgagttcaggagatcgagaccatcctggctaacccggtgaaaccctgtctctactaaaaatacaaaaaattagccgtgtgtggtggcaggcgcctgtagtcccagctactcaggaggctgtggcaggagaatggcgtgaacccgggaggtggttaccgtgagccaaggtcgcaccactgcactccagcctgggcaacaagagcgaactccatcttaaaaaaacaaaaagaccagccagggcaacatagtgagacactatgtccacaaaaaattttttaataattagccaggtgtggtgacatacacctgcggactcagctgctcgggaagttgaggtgggaggatcatttgagcctggaaggttgagactgcagtgagccatgatcacaccaccacatcccagcctgggagacagaacagagaccttgcctcaaaaaaacaaacaaaaaaaccccacaaattacatttaactacataatgtgatatgctgagaattatattaattaccccaaagggctcaaattcacgatcatttggtctacttatattaacatttcctaaaagtaaaaaaaaaaaattttttttttgagacggggtcttgctccattgcccaggctggagtgcagtggtctgatcttggctcactgcaacctgcgcgttccgggttcaaggaattctcctgcctcggccttctgagtagctgggattacaggcacctgccaccataccagctaaattttgtatttttggtagagatagggttttgccacgttgcccagggtggtcttgaactactgggctcaagcaatcggcccacctcgtcctcccacagtgctggtatttgccctcaaaagtaaaaattaaaacagatgttcaggccaagtgcgttggctcatgcctgtaatcccagcactttgggaggctaagtggggcggatgacaaactcaagagatcgagaccatcctggccaacatggtgagaccccatctctaccaaaattacaaaaattagccaggtgtggtggcaggcacctgtagtcccagctactcaggaggctgaaacaggagaatcgcttgaacccaggaggtgggagttgcactccagcctggtgacagacggggactccatctcaaaaacaaaacaaaacataacaaaaacagatgttcaaacactgaatatgcatatatacatttatcaaaactcatctaactatctggacatggtggctcatgcctgtaattccagtacttcgggggttaaggtgcggggatcgcatgaggccaggaatctgagaccagcctgagcaacacggtatgacattgtatttacaaaaaaattttttttaattagctgggtgtggtggcacacacctatagtcccagttactctggaagcggaggcaggaggactgcttgaccccaggaggtaaaggctgcagtgagctatgatcatgccactgcactccagcctgggcaacactcagtctcttaaaagaaaacacaaacagaaaaaaacaaaaaacctcatttaatggtacacttaaattggatacctttcattatttcatttaaactatattttgataaagttgatttgaaaaggtaaaagaaaagcaaacaaaaccaaaacaccaccaccaacacagcacttcagagtattcctctcccaactgtcgcctctggaaccgaagaaaaagcagcccagggagacacctgagccgcggctcggggagacccatcaactcctgacccaagagcaccaggtggattctggcacaaatctctcagcgcctcactaaaaggacagaacaaacacctctcctcttagtttagtggaagccccaggctaactgggcagagctggggagagcctgagggcaggtgagaaggaactttaaggaatagaagtgagttgacactgacactgcaccagtcaccaccttctcccaacacaagcagatgcggctcagcctcctgtgcagcctcagctcctcagaaggcctggggggggagcaggcaccgcagccacgatggcgatgcaggcaccgcagcccttgaaaatttcagggagctgagactcctacaaagaggcaactacttcaccgaggtggtgatggcaggaaaactcaatacttttttttttttttttttttttgagacagagtcttgctctgtctcccaggctggagcgtagtaatgcaatcccagctcaatgcagcctcaacctcctcggcttaagtaatcatcctgcctcagccggtaagtagccaggaccacaggtgcttaccaccacacccagctaattgttacattctgtagagaccggggtctcactgtgctgcccaggctgatcttgaacccctgggctcaagcaatcctcctgcctaggcctcccaaactgctgagattacaggcatgagccactgtacctggcccgaacccaaaacttctacaaaaattagctcttcaaatggaaactttactcacaagcactaaaagagaaaccatggcggtccttcaaagctgatatctcaaatacacccaactccccacatgaactgggggttttcacaggggttgcccagggatccctgaggtctcaggagctcagactcagtagtctcaaatgggccctggatctttatttccaaagccccctccaggcgagtctaatgcccacttaggttcaggaacagctgcataaacttctgtcagagagcacactgtgtgtgttccaaagaaaaaggaagaatatgtgatacggctgaagaaatgaagtacttgtttcaggacttacgtgaaaattagagacgcaaggctgggcacggtggctcatgcctgtaatccctgcactttgggaggccgagggaggcggaccacttaaggtcaggattttgagaccagcctgaccaacatgatgaaaccctgtctctactaaaaattagccaggtgtggtggcgaacgcctgtaaccccagctactcgggaggcggaggcaggagaattgcttgaacccaggaggaggaggttgcagtgagccgaggtcgcaccagtgcactccagtatgagtgatagaatgagactccacctcaaaaaaataaataagtaaataaataaaataaataaataaataaataaaaaggaaaggccaggtgcgctggctcatgcctgtaatcccagcactttgggaggacaagacgggcggatcatgaggtcaggagttagagaccagcctgaccaacatggtgaaaccccgtctctactaaaaatacaaaaatgaactgggtatggtagtgcacacctgtaatcccagctactcaggaggctgaggcaggagaatagcttgaaacggggcagcggagtttgcagtgagccgagaaggtgagctttctgtaccactgcactctagcctgggcgacagaggaagactccatctcaaaaaaaaaaaaagggaaaataagagacattgtatactctgcaaaaagcagcatccacttctgtgtcccctctttcctgatttcactcattttcttttttttctttttgggatggagtctccttctgtcacccaggctggcgtacagtggtgcaatcacagctcactgcagccttgatctcccaggctcaagtaatccttgcgtctcagcctcccgagtaacgaggactacaggtgtctgccaccacacctgcgtagtttttgttttgtgtgtgtgtgtgtgtgtttttttttttttttttttttttttggtggagatgaggtttcactatggtgtccaggcttgatttcgctaattttcttataaaagacagcaggaggctccgtcaactaagtgagacagaaaccaggggaaggagctgaggccccgacagggagaacccaggctcctcggaacatgcagaggaagatccgctgaggccccgacagggagaacccaggctcctcggcacacgcagaggaagatctgccaaggccactcggcaaagctgacagcaaggttgctcactcacatgacagagaatcaggtggggacagcatggtccccactcccaggccttctgggaagatcaggtattaggtagccgattggcaggtcacttaccttgaaccagtctgcatatgacaggaacgcagaggggccctccagtgctgcctggcgcacaaccaggaacgcagtgaccatgctgtccagctggcagctctcgaatgcctgggccatcaaacgcgccacccagtctagttaagaaccatgacatagtcacagcaaggcaagggcagccagcaggaacatgacgtgagttatgctgggtgatcaagtattccagaaggagactgtgcacacccaaacaccaagttttaaaagactacacagcaattacagcatgtcaagtgcaaaccactagagacctgaatgaagcagcagtggacactctggcctctcagagcagcagtcagtgcttatggaagcgtctgacaaagaatgttccatcgacaggaggcactgcaggttccgggcaggtagggaagggcttcactgagaggctcacccacagtcagctgggactctgctgacacccccctacacacactcttgaccagcaccaccgggctcgcgtaaaagctcaccttcaagcagctgctgcgcttctggaaagcagacaaccagggcagacacaaaggagagcactctctgccagtgaacctcctgcgtttccagaacttcttgcaaatggccaaccaactcctctgcactcagcatcacaaagagctgaaataaaagcatccgctcccttcaatatccaagcaaaccaatgtgcgacagatgacccctcaccttcctcccagccggtggccaccgcagccccctcacttcccactgcaaaggtaacacatggagctgtgacagctcacaccgtggcgtctctcccctcacagtggccagcacctgcttggagagaattctccctatctcaaggaggaggggctcggcccaagggacaagttcagtctcctgacctgagtggtggccttgatgaggacagccacatctcaccagacatccctgaacctctcgatgtgccgtccacggcaggcagcatgacaagtactaggcagatcttaatccccccgccacgagctcagaagcaggtataataccacatccactcaccctgcggtacagtgaggtgagcagagggtgtgtccgcgcaaagctccactctctctgcatctgaacagcatcagatgctgcagggggagaaacagacaaaaacttcaagtcagagatcaaaaagttgtgggtttttgttaaggaccagccccacagggtcggtgggtctctccccgtgtgcggcgacgagagagtgtagaaagaaagatacaagacaaagagataaaagacaagacagctgggcccgggggaccactaccatcaatgcgcggagaccggtagtggccctgaatgtctggttgtgctgttatttattggatacaaagcaaaaggggcagggtaaagagtgtgagtcatctccaatgataggtaaggtcacgtgtccactggatagggggcccttccctgcctggaagccgaggcagagagggagaggagatagagacaaagacagcttatgccattatttctgcatatcagagacttttagtactttcactaatttactactgctatctagaaggcagagccaggtgtacaggatggaacatgaaggtggactaggagcgtgaccactgaagcacagcatcacagggagacggttaggcctccggataactgtgggtgagcctgactgatgtcaggccctccacaagaggtggaggagcagagtcttctctaaactcccggggggaaagggagagtccctttcccggtctaagtagtgagtggtgttccttgacaccttttgctaccgctggaccacgatccgcttggtgacgggcgtcttcccagacgctgccgtcaccgctagaccaaggagccctctggtggccctgtccgggcataacagaaggctcacactcttgtcttatggtcacttctcaccatgtcccctcagctcctgtctctgtatggcctggcttttcctaggttatgattatagagcgaggattattataatattgcaataaacagtaattactaccaactaatgattaatgatattcatatgtaatcatatctaagatctatatctggtataactattcttgttttatattttattatactagaacagctcgtgtcctcggtctcttgccttggtgcctgggtggcttgccgcccacaggttttgtttttggacagggtctcactatcacccaggctggagtgcagtgctcaccacagcctcgacctccctggctcaagcaatccacctgcctcagtctcccaagtagctgcgaccacaggcgtgtgccaccatacccagatactttttgtatttttatttttttgatgctgagtctcactctgtcacccaggctggagtgcagtggtacaatctcggctcactgcaagctctgcctctcgggttcaagcgattctcctgcctcagcctcccgagtagctgggactacaggcgcccaccaccacgcccggctaatttttgtattttttagtagagatggggtttcactcttttggccaggctggtctcgaacttctgacctcgtgacctgcccgtctcagcctcccaaaatgctgggattacaggcgtgagccactgctcctggccaaaaagttgtgtttcaaagcttcagtgtgaagacagatcttaatatgtactttttcagttattaaagttcaccatctccctgtttgttgcctatttgctatatcatcaattctgtttctcaggcccggttacttacttgtaatgctttgtcatattcacaataaatattttccaatgtaccaactgcatttcaattttcctgcttttaaactgtcagtaaggtcaggctaggtggctcacgcctgtaatcccaccactttgggaggccgaagtgggtggatcacaaggtcaggagttctagaccagcctggccaagatggtgaaaccctgtctctactcaaaatacaaaaagtagctgggcatggtggcaggcgcctgtaattcaagcttggcagggaatagcttgaacccaggcggcagaggttgcagtgagctgagatcgcaccaccacactccagcctgggcaacagagtaagactctgtctcaaaaaaataaataaatacataaaataagataaactgggaataaaccaatcatggtggggatgctgttcaaaggaagctcagctcagtcaagtgatgataaactcctgagcacctcacagcacctgttgggagccatctgtgtatccctcatctcccaccagtttcctgcctgagcatctaccctggggatatgctagatacagaaaaagctcaaagtgttcatcgtggccttattcgtaagactgatatcttgggtacagtctgtcatacatgggtaacaggacacccactgggcagacgatgcctgggccatcaaacacgccaccgagtctagctgagaaccatgacacagtcacagcaaggcaagggtagccagcagaaagataacgtgagttgtgctgggtgatcaggtattccagaaggagaatgtgcatgctcaaacaccaagttttaaaagactagacagcggctgggcacagcggcacacgcctgtaatcccagtattttgggaggccgagacgggcggattacctgagattaggagttcgagaccagcctggccaacatggtgaaagcccgtctctactaaaaatacaaaaattagccgggcatggtggcacatgcccgtaatcccagctactgtggaggctgaggcaggagaatggtttgaacccgggaggtggaggttgcagtgagcccaaatcacgccactgtactccaacctggcaacagagcaagactccatctccaataaataaataaataaataaataaataaataaataaataaaataaagatatttctattttacgctgggtgcggtggctcacacctgtaatcccaacacttcgacactctgggaagccaaggcaggtggagcaccgaaggtcaggagttcgaggccagcctggccaacatggtgaaacccagtctctactaaaaatacaaaaaattaaccgggtgtggtggttggcgcctgtagtcccagctacttgagaggctgagacacgagaattgcttgaacctgggaggcagaggttgcagtgagctgagatcacgccactgcactccagcatgggcaagtgagtgagactctgactcaaacaaacaaacaaaaaagatatttctattttaatgacaattattttgtccactcataattctgaattttcttataaaaatctgttgctttcaggtaaaaggatatttagtaacaatctcaggcatctgaggacccagtctctggttcaagacagacgtaaaagaggtcctagaattcctggcatctccagtcagcgttaccaaggcaacaaggcaacagcaatccccaaaatgggtagcaactgagcagcctccacactgggcctacctttcagcacagggctgtgagtgagtatctgagtcagggtatgactgaagaacctcttcagaggatctgtggaaattacactgccaagcgtgtgtccactgaacactccgaacctgccaatgcagcagaaagaggggtcaggaaagggagggtgccttgcacgccacccaccaatcccagcacaaactgtggctcaggctcatcccttctttaagcaaggaaggggctttcttggccaggccactataaccacagacttgaaactgaatccaaggaggtggcagttcaacgagaaagggggcaaggcaacggcgaaacccacggagcagagaagcgaaggagcagaaggaaacaggtggggaagggcaggccgcgccacacccgggagtggagcagaaggaaacaggttgggaagggcaggccgcgccgcacccgggagtggagccccgggagccaacccgacggggcctcagcggcaccctctgtgacacggaactcccccagagggtcgtgccaagcctgagagaagagcccagcacaccagggcctcaaacagtcacaacagggactgaggccagctctgtccatgaagatgaggaaggaatggaagggactaaggtttcctgggccatctgtgtgagagaacacgatgttctgggggtgaatggggtcacagagccaggtggcaagagcacttgaggtctgttagcctgccacatcccagcaggcctatacagaccaccaaaccaaacccagaccctctcgtgaggcttacaacctgcaaccagcaagcggcactttatgccgattccccaggtaagaaaatcaagggtccagccgggcacggtggctcatgcctgtaatcccagcactctgggaggctgaggcgggcagatcacaaggtcaggagatcaagactaccctggctaacatggtgaaaccccatctacactaaaaataccaaaatattaggccaggcgcattggctcacacctgtaatcccagcactttgggaggccaaggggggcagatgacaaggtcaggagctcgagaccatcccggccaacccaacgaaaccccatctctactaaaaaaatagaaaaaattagccgggcatggtggtgggcacctgtagttccagctactcgggagactgaggcaggagaatggtgtgaacccagggagcggagcttgcagtgagcagagatcgcaccactgcactccagcatgggcgacagagcgaaattctgtctcaaaaaaagaaaaataaaaaaaattagccaggcatggtggcacacacctatagtcccagctatgtgggaggctgaggcaggagaatcgcttgaacccaggaggcataggttgtagtaaaccgagatcgtgccactgcactccagcctgggcgacacagtgagactctgtctcaaaaaaataaagaaagaaagaaagaaaatcaagggtcctggcggttcagtgaactgccccagggtcacacacccaacgaggccacgtcggctctgtgcaaactcaagacactcacacaacagggtgtgggacatcgtggagattcacttctcagccctgctgtccttcctcacagggcagggctttgggacaccacagcccccagtgtgcaagggaagctggccaccaagactgttggaggatgtctgattttaaattattggcaggccaggtgcggtggctcacgcctgtaatcccagtactttgggaggctgaggtgggtgttatcacttgaggtcaggagttcgagaccagcctgaccaatatagtgaaaccccatgtctacttaaaaatagaaaatacaaaactataggcttgtgccaggtgtggtggtgcatgcctgtaatcccagctactcaggaggctgaggcagaagaattgattgaacctgggaggcagaggttgcagtgagcagagatctcaccactgcactccagcctgggcaacaagaataaaactctgtctcaaaaataaataaataaataaataattggcaactaattacaaaatataaaaatcggcaggtcagtggttgttacctgactctcaggacatcagtgtgagtaatcttatcacacagattataaaaaaaagcccttgccacagactaaactgtatccccacaaagttcctctgttgaagcccagcctctcaaggtggggtgttgataaggctgaggtgatgatgagatgactgcccggagaagacaccagagggcttgctctcccctctctacctcatgaagacacagaaaaagtaggtctcctgcaagccaggaagagggtcctcaccagaacccaaccctaggggcaccctgacctccaacttccagcctccactgctgtgagaacacatctgccgtccacaccgcagtctctggcactttgttacagcagcccaagctaactgatgcacatgtaaacattcaggaaatcacacagtgctttattcactgtttcagtaaaagtaccgaacggtacaacacatttaattgagcagttaaacagttactgtgagggatgggaaatgaggagcaaaataaagaatgaaaaggttgacaaggcctggaaacagtggcaaattctactggtttctcaagacttcacttcaaggtcccctgcccacactagagggaagcaaaccccagagccccatttccaccaaaccccgatgtccaccttccacccagcccccactcctcagcttccgcctcccgacctgtaagggtctccgcacatctccacagagccatggagagaaaaagctaatagggccaagctttgcctactggtgaatctgagcaggatctgtggaggccaggcagcgggagtctgtagaggcacagctacagtgtgttctagaaatgtggggggctgagaggcagggccagctctagagcctgaatcacacccagggaaggaggagcaaggggagactccacacaggaggaggtcacagtgagtgggacaaacattggtgcaggacttccagaggcggaacaggatactgcagtgggcgcaccttccgacctcatcctcacaggaaaaggctgaccagagcgttccccgggctttcccatggtcgcctcctcctcacgcacgttatcgtaactggcagaggaagtgtgctcaggagcgggctgctgaagctctggaagtgtttaaaatatcttggctctttaatttggcagacacctccctgctgcacactcaggcaggccaccctcaggaacataccagcacctcacgatcttgtgagtggaggactcctcctgtactccagcagccaaagcgtcaagtgcaactgaagacagagccaggaacagaaaacagatgtcagcacacggcggcagcccaccagaaacaatccccaggcgctttcagacaacagatccacttcaaccccccagagggcccacatccatcaagacttctacaatctgtaggccttaatcaaaacacacagacaagaaaatgcttccctgtgacccacagattcatgaggtatcccttcacagctctgaaaatgccaaaacaagggcattccagtaccaggactctgcacagtgaaacatacagaggagaaatacctcaaatggaaaggcagaaaactgatacaattgctaataagcaaactaagtcatttacagtctgggctgcagtgcaattaacttacaaatcagcattctctgcagtacatcaaccgtgacctgtcaaaatagaatgtgagttaccatcttggtaatcttctgtaatttgtgtgatacctgcatcacacaagagaattattacttgttactctaaagtaaagaaacggcacttcaggaggccgaggcgggcggatcacgaggtcaggagatcgagaccatcctggctaacatggtgaaaccccgtctctactaaaaatacaaaaaattagccgggcgcagtggcggacgccctgtagtctcagctactcgggaggctgaggcaggagaatggcgtgaacccgggaggcagagcttccagtgagctgagatagtgccactgcagtccggcccgggcgaaagagccagactccgtctcggaaaaaagaaaaagaaatggactttacaaagagatcaactttaaaaaccctcatagacctagaaattactccagtaccgaagggacctagacagagtgaaaaggctgaactttctggaattaccctaagactgctctcagcatggcctgaggccatgagcctagggctgggcaggacacttttgcacgcagagttttgctgaagtacttcagtgaagagaggaaagctcaggccttgaatctgggctgtggaactaaggactttcacccttgatgcctctggagccagaagacggtgagaaggtaccattgtccatttcccttcttcacatctcctgggcttaaagcataccactactcagagagcaactcatggtaacaataaaacagacttcctcaaacaaagcccacagactgcagtgtaggcaaaatgggagccactggctcaggaacctccaaaagggaataaaaatttgggacgtatccaaaactatctacagattcaatgcaatccctatcaaaataccaataacgttcttcccagaaatagaaaaaaagattctaaaattcacatggaaccaaaatagaacacagataagcaaagcaatcctgaggaaaaagaacaaagctatagaatatagaaatcacactgcctgaggtcaaaatatactacgaggctacagaaatgaaaacagcatgaggttgatataaacatacacacagaccaacggaacaggatagagaacccagaaacaggccgggaactgtggcccacgcctgtaatcccagcactttcggaagtcgaggtgggtggatcacctgaggtcaggagttctagaccagcctgaccaacaaggtgaaaccctgtctctactaaaaatacaaaaaaattagctaggtgcggtggcgggtgtctatagtcccagctactcgggagactgaggcaggagaatagcttgaacccggtaggcggagcttgcagtgaaccaagatggcaccactgcactccagcctgggagacagagcaagactccatctcaaaaaaaaaaaaaagaaaaaagaaaaaaaaaggccaggcacggtagcccacgcctataatcccaacactttgagaggccaaggtgggcgggtcatgagatcagaagttcgagaccagcctgaccaacactgtgaaagcccatctctactaaaaatagaaaaactagccgggagtggtggtgggcgcctgtagtcccagctattcaggaggctgaggcaggagaatggcgtgaaccccggaggcggagcttgcagtgagccgagatcgcgccactgcactccagcccgggcgacagagcaagactctgtctcaaaaaaaaaaaaaaaaaagccaatgtcactaatcatcagggaaatacaagtcaaagccacaatgagctattatttcactccagttagaattatcattatcaagaaaacaaaaaataacaaatgctggtgagaatgcaaacagaactcttatatgctatcagtgagaatgtaaattaatacagccattatggaaaatagtatggagatttctaaatagttgggtagttctaaaaacagaactaccagcccagagggtctcactttcaccaggcatggtggatcacatctgtaatcccagcacttcaggaggccaaggcaggcagatcatgaggtcaagagatcgagaccatcctagccaacagagtgaaacctcacctctactaaaaatacaaaaattagctgggcatggtggtgcatgcctgtaatcccagctattcgggaggctgaggcaggagaatcggttgaacctgggaggcagaggttgcagtgagccgaaatcgcgccactgcactctagcctgagcaacagagagagacaccgtctcaaaaaaacacaaaaaaacaaaaaaaaaaccagaactgccatatgatccagcaatcccattactgggcttacagccaaaggaaaggaaatcagccagctgaagagacatctgtactcctacatttattgtggcactattaacaatagccaagatatgaaatcaacctgtgtgcccaacaagagatgaccggatacagaaaacgtggtatatacacacaacggaatactggtcagctttaacggagtctcgctctgtcacccaggctagagtgcaaggcgcaatcttggctcactgcaacctccgcctcctgggttcaagcaattctcctgcctccacgcctgtagctgggactacaggcatgtgccaccacgcccggctattttttttttttttttactagagacagggtttcaccatgttggtcaggctggtcttgaactcctgacctcaggggatccaccagtctcagcctcccaaagtgctggattataggcatgagccattgagcccaacctcagctatttttttctttttctgagatggagtctctgtcgcctaggctggaatacagtgacacgatctgggctcactgcaagctccgcctccaggtttcacgccattctcctgcctcagcctcctgagtggctgggtccacaggtgcctgccaccaggcccggctaattttttctatttttttagtagagacgggattttaccatgttagccaggatggtctcgatctcctgaccttgtgatccgcccgcctcgtcctcccaaagtgctgggattacaggcatgagccaccatgcccggccagctattctttttttttaaagtgaaatcctgtcattcacagcaacaggaatgcaactgaaggccattatgttaagtgaaataagccaggcacagaaggacaaatattgcatgttatcacaaatatgtgggagctaaaaagtggctcttgtggaggtagagagtagaacgagagataccagagatgagaagggtatatgcagtgggggaacgaagagagttggttaatgggtacaaacatacagctagacagaagaagtaagttctaatgttccacagcagagtgaggcggctatagttaacaacagattgtatatttcaaagtaactgcaacatgtgaaatgttgccaacacacagaaatgatacatactggaggtgacggagactctaaacaccctgacttgatcattacactctatgcacaaaacaagtatcacatgtaccccgtaaataggtacaaacagcacgtttcaatagagagacacgtaaatacatttcaacacttggaataaggacggctccttccgctaaactcttcacttgacttttcctcctacctgcggcattttttcaggctccacagttcttctcagatctgagtttttctgaaatcccctcaaaacaaacatttgaacaaaatctgaaaaaccataaaaccaaagttatttatggacatcatggtctccaagcaactgtgaatggcacagaccatccacttcagaggggcgggtgagcatatggcttgggcccaccaggacccctgtgagctgctcctaacctgaggaacgctgcagaagttactgctcacctgaccacagctacactagcgttcaccaaacccaatcaggacccttagatgaaccagattttttcctcttgcacttctatttgaaagggaacaagtttatagtcagatttttttctttttttttttttttgtgagacggaggcttgctctgtcgcctgggcttgagtgcaatggtatgatctcgctcactgcaacctccgcctcccaggttcaagcaattctctgcctcagcctcaccagtagctgggaatataggcgccgccaccacacccagctaatttttgtatttttagtagagatggggtttcaccatcttggccaggttggtcttgaactcctgacctcatgatccacctgccttggcctcccaaagtgctgggattactggcatgagtcaccccacccagcccaatttttttctcttaaataaaagtggtttccaagggaggtcttatggattgtcttgcctgccaatctccaataccagagggtctagagggacccagaagcatcctattctgaggaatgtgatgggggaggaaaggcattcttagctttttaaaaaataagaccaagaggactgaaatccacaagattttctaactttgatttaaatttaacctatctggtaccaggttatagtagctcaggaatgctaagtcgctcatgccaccaaaaagctttaggaaaaaggaaaaaacccacaagctactgtacagatcagtttctcatctaatttttatttgtaggtgtcacttgtagtgggatgggtctcccagcaggtgttcctcagaacccaaatatcccagagaggatctgagaactcaccaaggaaaagagtctcatcactcaaacacagcaggcaaagagccagaaaacgagcttcaatgcaccttagagacaggtggtggggcggttctctagagctgtcctgccgccgtccaggagtgcgctgaatataagtcctgacaaacccaactactcctcaagctggattggtccaagccattctctgacaagcccaactactcctcaagctggactctggtccgagccatcctctgacaagcccaactactcctcaagctggactctggtccaagccatcttctgacaaacccaactactcctcaaactgggttggtccctagtctgagccatcctctggtctctcagcaccttcttagtttgtggggggacattacagtcccaagtttttctcataatatcattcctcaggaaggccaggcatagtggctcacgcctataatcccagcactttgggaggccgaggggggtgcatcacgaggtcaggagttcaagagcagcctggccaacctaatgaaaccccgtctctactaaaaatacaaaaaaaaaattagccgggcatggtgccacgtgcctgcagtcccagctactaaggaggttgaggcagagaatcacttgaacccaggaggcggaggttgcagtgagctgagatcgcgccactgtactccagcctgggcgacagaaggaagcagctgcggtcactctatgggaaaggtgaatggaaacacttaaactcatgtcaaggccgacttactagtatttccacatcagtcaagtaaaatgcaaccccacaacaggctgagactgggagtctgtcatgccaggttcccacggccacggagagacaggctgttctgcctcgcagagctcttgagagcagaaggcattatcacagatcaaaatgagttttacccaagaacccgcatcttgtcatgaacgcaccagaaagcatggccctggcgacgtcagcatgctggcaggatgcttccatctgttcacaaaggcagcacagattcctgaagagccacgatcccacagcatgcatgtcgggatggctggagacacacacagaggcagacgtaaggctcaactaaatcccatcatcaggggattgagttgagccatatgtcccaattttttttttgagacagttttttgctgtcactgaggctggagtgcagtggcgcaatcagtcactgcaccctcgacctcccaggctcaagcaatccttccacctcagcctcctgagtagttgggacaacaggcgcataccaccacgcccagctggaggtcttactactttgcccaggctggactcaaactcccgggctcaaaacaatctcccaccttgccctcccaaagtgctgggatgactggtgtggcactgtgcccagtctcaagttattttctaatttcccttgtgacttctttgactcattatgttaactttcaaatattgtggattttcccaattcccttctgttgtttattctaattaaattcatttgtggttagagaacatattttgaatgatttcagcccttctaaatttattcctctttgttttatggcctgaaccttttttttttctcttgaaacagttttgctcttgtcatccaggctggagtgcaatggcacaatctcagctcactacaacctccgcctcccaagttcaagcgattctcctgcctcagcctccacaacggctgggattacaggcacctgccaccttgcccagctaatttttgtaattttagtagagacagggtttcaccacgttggacaggctggtcttgaactcctgacctcaggtgatctgcccgcctcagcctcccaaagtgctgggattacaggtgtgagccaccgcacctggccttggcctgaaccttatgctgtatcctggggactgttccatttggacttacgaatacacactctgctactactgggtagagtgctccacagtcagtcaggtcagctggtttgcagcattcaacttctatatcattcttttttttttttttttttttaattgatcattcttgggtgtttctcgcagagggggatttggcagggtcataggacaatggtggagggaaggtcagcagataaacaagtgaacaaaggtctctggttttcctaggcagaggaccctgaggccttctgcagtgtttgtgtccctgggtacttgagattagggagtggtgatgactcttaacgagcatgctgccttcaagcatctgtttaacaaagcatatcttgcaccgcccttaatccatttaaccctgagtggacacagcacatgtttcagagagcacagggttgggggcaaggtcacagatcaacaggatcccaaggcagaagaatttctcttagtacagaacaaaatgaaaagtctcccgtgtctacttctttctacacagacacagcaaccatctgatttcgcaatcttttccccacccttcccccctttgtattccataaaaccgccattgtcatcatggcccgttctcaatgagctgttgggtacacctcccagacggggtggtggccgggtagaggggctcctcacttcccagtatgggcggccgggcagaggcgcccctcacctcctggacagggcggctggccgggcggggggctgactcccccacctccctcccggacggggcggctgttctatatcattcttaatctaacttgttctacccattactgaaaggggagtattgaaacctctaatgattattgctgaaatgtctacttctccctttaattctggccatttttgcttcatagattttggtgctgagataagatgtgtatatcctaggaagcaggtttttctttttttttttttttttgagatgaaattctgctctaggccgaggcgggaggatcacaagatcaggagttcgagaccagcctagccaacatggtgaaaccccatctctactaaacatacaaaaattagccgggtgtggtggcacgcgcctgtagtcccagctactgaggaggcaggggcagaattgcttgaatccgggaagcggaggttgcagcgagcccagatctcaccactgcactccagcctggcgacatagcaggtctctgtctcaaaaagaaaaaaaaaggccgcgcgaggtggctcatgcctgtaatcccagcactttgggaggccgaggcaggggaatcacctgaggttaggagtttgacaccagcctggctaacatggcgaaaccacatctctactaaaaataacaaaaattgccaggcacagtggttcatgcctgtaatcccagcgctttgggaggcagaggcgggcagatcctgaagtcaggagatggagcccatcctggctaacatggtgaaacccagtctctactaaaaatacaaaaattagccaggcgtggtggcggacgcctgtagtcccagctactcgggaagctgaggcaggagaatggcgtgaacccgggaggtggagcctgcagtgagccgacatcacgtcactgcactccagcctgggtgacagaacgagactctgtccctaaaaaaaataaatacataacaaaaattagctgcgtgtggtggcgggcgcctgtaatcccagcgacttgggaggctgaggcaggagaattgcttgaaccctggaggtggaggttgtagtgagctgaaatcgtgccactgcactcccacctgggccacagagcgagactccgtctcaaaaaaaaaacagacaaaaagcaaacaaaaccaaaacaccataaacgttctcttgaaataataaagcaatagttcctccaggtctagtctagtataaatatgcaatgcaatctagtctagtacaaattatatgtcaaagccagaaatcaaacccgtctgattctgggctttgaaatataatttatactagactagactgcaaaaacagtaacactgaatcatcattagcacgctacctttccagcagctcttgcaggctcacaatgccttgtacgtgaagatgccacaccgcttcaagcaacaaagaactctgaaaaacaaaacaaaacaaacaaaaacaaaaacaaaaaaacccccagcattctgagtcctttatgaatgcattttcctacaaaatgttcaacttaggttcttaaccatgccgtattgaaaattaacctcaagcaaaaacttagagcctgaaacacatctttttttacaaagctgtactggttttcaaactccctggcctttgggcacccacacaccgttgcccaacacttgcttctcttccttctctcttcctacgcactgtagcctacttctaaccctttctccacactacagccaacacagtattacacacactgacatgacagtctctccttcagaagccttcactggctcctcgaagctgccaggacaaaggtcaggcttcagtgtgccctgtgcatgtcccttgtctttctcactcaaccctctcccatttgataaaacaggatctgctttagccactcactgtgaacactgtgcctgtcacactgccctgatctccctgcagcctccccttctcatccccctaactcacactctatttttttttttttgagacagagtcgcgctctgtcacccaggctggagtgcagtggcgccatctcgggtcactgtaagctctgcctcccgggttcacgccattctcctgcctcagcctcctgagtagctgggactacaggtgcctgccaccacacccggctaattttttctattttttagtagagacggggtttcaccgtgttagccaggatgggctcgatctcctgacctcatgatccacctgcctcggcctcccaaagtgctgggattacaggtgtgagccactgggcccggcccctaactcgcactcttcacagtccgtgcaggaaggctttcctaactctccaatctgatatgcatgtccaacatcttcttcgcaaatctgtgagcacatgaatcatcgcacttcttgtggatttagtggcttgtttcccaagctacgtgataatgagggcagggaccaaagcaataactgaaaaatctaatgaattctataatgtatgctggataaaagaatgggaaaggccggacgcagtggctcacacctgtaatcccagcacttgggaggccaagatgggcagatcacctgaggtcaggaattgaagaccagcctggccaacatggtgaaacctcatctctactaaagatacaaaaattgggcagggcgcggtgactcacacctgtaatcccggcactttgggaggccgaggtgggcagatcatctgaggtcaggagtttgagaccagcctgaccaacatggagaaaccccgtctctactaaaaatacaaaaaaaattagccaggcatggtggcgcatgcctgtaatcccagctactcgggaggctgaggcgggagaatggcgtgaacccgggaggcggacgttgcgataagccaagatagcaccattgcactccagcctgggcaacaagagcaaaactccatctcaaaaaaaaaaaaagatacaaaaattaactgggcatggtggcacgcgcctgtaatcccagctactaaggtggctgaggcaggacaatcgcttgaacctgggaggcagacgttgcagtgagccaagattgcgccactgcactccagcctgggcggcagagcaatattctgtctcaaaaataaaaataaatgccaggcgcggtggctcacacttgtaatcccagcactttgggaggccgaggtgggcagatcacgaggtcaggagatcgagaccatcctggctaacacggtgaaaccccgtctctgctaaaaaatacaaaaaattagctgggcgtggtggcagtcacctgtagtcccagctactcgggaggctgaggcaggagaatggcgtgaacctgggaggtggggcttgcagtgagccaagatcacgccactgcactccagcctgtgcgacagagcgagacttcgtctcaaaaaaaaaaaaaaaagaccagcctgggcaacaaggcgagaccctgtctctggaaaaaaaaattacatacatttttttttaatagtttactatactaccctggaaaattctccatactaatatacccaaggctaaacgtgtttttcaatatattctagtctaataaatattactaatgataggtgaatagggacaaaaaatggcaattgaaggtacttctttccaatccacagatgatttctaaaccctttttcatccactctctgtaattaatgagaagcttggagaattcccaagaaaacccaggtactctgttgcctccatccagatcaacagaacattgcctggaacactggagagtcagatttgcaatctcaaatttacctgtattttccataattcttgacagaaggaaagacgggagaacatactgtgtgccaataaatactgagcaaactctaacagggaagacagcttcttctgaaaagagagattacattttttaaaaaacaaattacctgaaacaatactaaagctatgtcctattttcccaaccagcttaaaagtaacaacgggcaggtttcctcatctttgctggtgtcttactctctgctccacagtcagcagcacagggtgactggtctccgctggagccgtgcagatctgtcccacgctagaggcaaccatcccggctgagagaatacccacgggaacccccagccttgaggcttgatcctgcaaagcagagccttaaacacaaaacaaaaccatagctttctcttaacacatgagacaaaatctaaaaccaaagacttgctgtttaaaatgccttattttaagatgcagcacaaaaaaaattgccttttaaacggggagaatagatgcaaagggaaaaacatgagataaaaatgagaatttgatgatccaagcagctcacaataaaactggtggcaacacctgaacccagagttatacattggtatttgttacgtttcccatgacacaaaaggagcaagataaagaaatatattctgaccaagaactttatcatctttttacaaaggagcacaataaattgagaactgcagcaggctctttcaattacattgtttttctaattacttcagagataagcctgcccctgttgactcacattgatggttgtgataaaattaggcagggatttcccaacattctgccatgcacctggtgggcaggtgcagtcacagctgtgctcagtccgcaggccaccaagtggaacctcactaacagcctgcaggcagccaccattctcctgagcaaccagccactggtctgcattcaataaagtgagaaacggtgggcaacctggaagcaggcaatgccaagaaatcattttctaatttatttgtcttccaaaattaatttttttttgttttatttttttgcaatggtgtcttacactgccgcctggactgaagtgcaacggcgccatctcagctcactgcaacctccgcctctcaggttcaagcgattctcctgcctcagcctcccaagtagctgggattacaggcacgcgtcactacgcccagttaattttttgtatttttagtagagatggggtttcactatgttggctaggctcgtctccaattcccaacctcattaatccgcccgcctcggcctcccatactgctgggattacaggtgtgagccaccacgtgagccaaaattaattgtttaaagaaaccgggccgggcacggtggctcacgcctgtaatcccagcactttgggaggccgaggcgggcggattacaaggtcaggagatcgagaccatcctggctaacacggtgaaaccctgtctctactaaagacacaaaaacaaaattagccaggtttggtgacgggagcctgtagtcccagctactcaggaggctgaggcgaagaatggcgtgaacccaggaggcggagtttgcagtgagccgagatcacgccactacactgcagtctgggcgacagagccagacttcatctcaaaaaaacaaaacaaaaaaaaactggaggccaggctcagtgggtccctcctgtaatcccagcactttgggaggccgaggcgggtggatcacctgaggtcgggagtttgagaccagcctgaccaacatggtgaaaccctatctctactaaaaatacaaaattagccaggcgtggtggtgcatgcctgtaataccagctactcaggaggctgaggcaggagaatcactttaactagggaggcagaggttgcggtgagtcgagatcacaccattgcactccagcctgggtaacaagagcaatactccgtctcaaaaaaaaaaaaaaaaaaaaaaaactgttaactgcagtacgaacctgttattgtaatgtactggctctaaaaacacattatcaatacataagtaaaaacatttacaggctggttgcggtggctcatgcctgtaatcccaacactgcaggaggccgaggcgggtcgatcacgaggtcaggagtttgagaccagcctggccaagatggtgaaaccccgcctctactaaaaatacaaaaattagctgggtgcggcggcgggcacctataatcccagctattcgggaggctgaggcaggagaattgcttgaacccaggaggcagagtttgtagtgagccgagatggcgccattgcactccagcctgggcgacagagcaacacttcgtctcaaaaaaaaaaaaaaaaaattttacaatagttctagaagcttaaaattatagtacgagaaatcatcagctgctggtgaaattctcggtagaaaagtagacagatggggcacagtggctcatgcctgcaatcccaacaccttgggtggctgaggtaaactgattgcttgagctcaggagtttgagaccagcctgggcaatatggcaaaaccctgtctctatgaaaaaattagccaggcatggtggcgcacacctgtagtcccagctactcaagatgctggggtgggaggatcacttgaggccaggaggtcaagactgcagtgagccgtgattgcaccacggctctccagtccaggcaacagagtgagaccctgtctgttaaaaaaaaaaaaaaaagtagacaatgccattttctgttctgagacagagttttgctcttattgcccaggctggagtgcaatggaggggtctcggctcaatgcaacctctgcctcccacgttcaagcaattctcctgcctcagcctcctgaatagctgggactacaggcacccaccaccacacccggctaatttttgtgttttttagtagagacagggtttcaccatgttggccaggctcgtctcgaatcctgacctcaggtgatccgcacacctcagcctcccaaagtgctgcgattataggcgtgagccactgtgccaggccaacaatgccaatttctagtcatttgtttccaatgtgtctccataggaaagtttttttatctacaagtcttttactgtgtgtgtgtgtgtgtgtgtgtgtgtccgtgtgcacgtgcgtgcatgtactaactatatctttagcagaaaaaaacaaactcaaaaattaatgaattaaaggtttatctgtgtggctgagcttggttccttggaatgataatatgcaatttgtgaaattcaaatacaatcatggcagtgaaaatctgtatcatttgccaatgacattcagtgaccagttgtcaagggagcgctattactgaaggttattttaacagaaacaagtcatcacataaggacgtgaaggatcagaaaataacttactgttgttgacccagaacttaccctatctcccactctcaaactggggggagaaggaggtacctagaaaattgttctcccgtctgctctcctgggcacaccacagcctgtctcactacttccatgagcaaggggcacatccctgctgttgctatgtcccatgtttttccaagggacactctgggtcctactgcttctgagtcgcaggttgaatcagacgctgtttttaaacacagcatcgtaagaagcccaagagcaagtcacacaaacatcccatagaatttgcgactacacacaccagtggaaacccatcgcctgagaaaatttacatttctacttaatttagcaaactatggttactatataaaaacccttctgcaattcaaaatagagaaaatgaagctataacttacctataaatgaactagaatgattagcataggcctcagaactgtcacagtcaatcactttgctgagagacaattttttacacagtggaccttctacctagaatccaaaacacaacaaactccatttaaaaaattcaagctccaggccaggcgtagtggctcacgcctgtaatcccagtactttgggaggccgagatgggcagatcacgaggtcaagagttcgagaccagcctggccaacatagtgaaaccctgtctctactaaaaatacaaaaattaggagggcatggtggcgcgtgcctgtagtcccagccactcgggaggctgagacgggagaatcacttaaacccgggaggtggaggctgcagtgagccgagatcaccccactgcataccagcccaggctacagtgtgagactttgtctcaaaaaaaataaatgaaaataaaaaataaaaataaaaaaaattcaagatctgtgcataaacacaacctgtgtgtaagtaatgcttccctactgggctattttcctttttttcttttttgagagggagtctcactgtcgtccaggctggagtgcaatggcgggatctcactcacggcgacctccacctcccaggttcaagcgattctcctgcctcagcctcctgagcagctgggattacagacacctgctaccatacccggctaatttttgtattttaagtagtgacggggtttcaccatgttggtcaggctggtctcgaactcctaacctcaagtgatctacccacttcggcctcccaaagggctaggattacaggcgtgagccaccacgcccggctttttttttttttttttttttttttttttttgtgagacagtctcactctgtaatccagactggattgcaaggggcgtgatctcggctcactgcaatttctgcctcccgggtccaggttcaagcaattctcctgcctcaggctcccgagtagctgggattaaaggcgtgcgccaccacacccagctaatttttgtattttcagtagagaccgggtttcactatgttggccaggctggtctcgaactcctgaccctgagtgatccacccgccttggcctccccaaaagctgggattacagccctgagccacggcgcccggcctgtttttttgttgttgttgttttgtttttaataaaagaggcggggtctcaccccgttgcccaggttggtccagaactcccgggctcaggcgaccctcccctctgcgggccaggccaccgcgcccgccgcctcgggtgttttcttaggaaagctgtgcggtggctggactcaaaaaccccgaacctaaatctgcccgcagacggacaccagcttcctcttacctcaagcaaaagggcattcaggtcctgatggcttcgcaggaggcgcacagctgattcctttaatttctgtgccctttcaggattatatttttccctcttgacccttcccgctacggagagaagtcggttcgaaaccatcacagcacaattcacacacggggtccccggcccgacgcgcaggtggacgccgcggagaaacccaccagcgacaccctcccgaagaggggccggggctcctccccagggcgcaggtctcgggaaactaacggagacggccccaccgcggacgccggggaagacggcccaggagggcccgaggcaggggagcccggggacggctggcgaggggcggcctctgcgctgaggggagccccaggccgcgcaccccaggcccgcctgacagggcggccggcgggggcggcgttcgggaaagaagggagcgccccgcgggcggcggctgggggcgtccgcccaggcgcaggaggggccgggtccgaggcagccgcgccgccccagccgggcgcccaccccgcacagccccccgggcgcggcgtccggggatccgaccggcggaggctctggcgggaagggatcggggaaccggcgaaaccgtcccgggccggacgccgcccactcccgcggcctgccgcgcccacctacccagcagctcggcccaggccctccggcggccccctgggtcctggcccgaggcggagttcgggacccacgagtcggacatggccttggcgcctacagccccggcggcggctccctgcgcccg

SEQ ID NO: 1624 - DNA, 18300 bp, Homo sapiens
ggaaatcacacagtgctttattcactgtttcagtaaaagtaccgaacggtacaacacatttaattgagcagttaaacagttactgtgagggatgggaaatgaggagcaaaataaagaatgaaaaggttgacaaggcctggaaacagtggcaaattctactggtttctcaagacttcacttcaaggtcccctgcccacactagagggaagcaaaccccagagccccatttccaccaaaccccgatgtccaccttccacccagcccccactcctcagcttccgcctcccgacctgtaagggtctccgcacatctccacagagccatggagagaaaaagctaatagggccaagctttgcctactggtgaatctgagcaggatctgtggaggccaggcagcgggagtctgtagaggcacagctacagtgtgttctagaaatgtggggggctgagaggcagggccagctctagagcctgaatcacacccagggaaggaggagcaaggggagactccacacaggaggaggtcacagtgagtgggacaaacattggtgcaggacttccagaggcggaacaggatactgcagtgggcgcaccttccgacctcatcctcacaggaaaaggctgaccagagcgttccccgggctttcccatggtcgcctcctcctcacgcacgttatcgtaactggcagaggaagtgtgctcaggagcgggctgctgaagctctggaagtgtttaaaatatcttggctctttaatttggcagacacctccctgctgcacactcaggcaggccaccctcaggaacataccagcacctcacgatcttgtgagtggaggactcctcctgtactccagcagccaaagcgtcaagtgcaactgaagacagagccaggaacagaaaacagatgtcagcacacggcggcagcccaccagaaacaatccccaggcgctttcagacaacagatccacttcaaccccccagagggcccacatccatcaagacttctacaatctgtaggccttaatcaaaacacacagacaagaaaatgcttccctgtgacccacagattcatgaggtatcccttcacagctctgaaaatgccaaaacaagggcattccagtaccaggactctgcacagtgaaacatacagaggagaaatacctcaaatggaaaggcagaaaactgatacaattgctaataagcaaactaagtcatttacagtctgggctgcagtgcaattaacttacaaatcagcattctctgcagtacatcaaccgtgacctgtcaaaatagaatgtgagttaccatcttggtaatcttctgtaatttgtgtgatacctgcatcacacaagagaattattacttgttactctaaagtaaagaaacggcacttcaggaggccgaggcgggcggatcacgaggtcaggagatcgagaccatcctggctaacatggtgaaaccccgtctctactaaaaatacaaaaaattagccgggcgcagtggcggacgccctgtagtctcagctactcgggaggctgaggcaggagaatggcgtgaacccgggaggcagagcttccagtgagctgagatagtgccactgcagtccggcccgggcgaaagagccagactccgtctcggaaaaaagaaaaagaaatggactttacaaagagatcaactttaaaaaccctcatagacctagaaattactccagtaccgaagggacctagacagagtgaaaaggctgaactttctggaattaccctaagactgctctcagcatggcctgaggccatgagcctagggctgggcaggacacttttgcacgcagagttttgctgaagtacttcagtgaagagaggaaagctcaggccttgaatctgggctgtggaactaaggactttcacccttgatgcctctggagccagaagacggtgagaaggtaccattgtccatttcccttcttcacatctcctgggcttaaagcataccactactcagagagcaactcatggtaacaataaaacagacttcctcaaacaaagcccacagactgcagtgtaggcaaaatgggagccactggctcaggaacctccaaaagggaataaaaatttgggacgtatccaaaactatctacagattcaatgcaatccctatcaaaataccaataacgttcttcccagaaatagaaaaaaagattctaaaattcacatggaaccaaaatagaacacagataagcaaagcaatcctgaggaaaaagaacaaagctatagaatatagaaatcacactgcctgaggtcaaaatatactacgaggctacagaaatgaaaacagcatgaggttgatataaacatacacacagaccaacggaacaggatagagaacccagaaacaggccgggaactgtggcccacgcctgtaatcccagcactttcggaagtcgaggtgggtggatcacctgaggtcaggagttctagaccagcctgaccaacaaggtgaaaccctgtctctactaaaaatacaaaaaaattagctaggtgcggtggcgggtgtctatagtcccagctactcgggagactgaggcaggagaatagcttgaacccggtaggcggagcttgcagtgaaccaagatggcaccactgcactccagcctgggagacagagcaagactccatctcaaaaaaaaaaaaaagaaaaaagaaaaaaaaaggccaggcacggtagcccacgcctataatcccaacactttgagaggccaaggtgggcgggtcatgagatcagaagttcgagaccagcctgaccaacactgtgaaagcccatctctactaaaaatagaaaaactagccgggagtggtggtgggcgcctgtagtcccagctattcaggaggctgaggcaggagaatggcgtgaaccccggaggcggagcttgcagtgagccgagatcgcgccactgcactccagcccgggcgacagagcaagactctgtctcaaaaaaaaaaaaaaaaaagccaatgtcactaatcatcagggaaatacaagtcaaagccacaatgagctattatttcactccagttagaattatcattatcaagaaaacaaaaaataacaaatgctggtgagaatgcaaacagaactcttatatgctatcagtgagaatgtaaattaatacagccattatggaaaatagtatggagatttctaaatagttgggtagttctaaaaacagaactaccagcccagagggtctcactttcaccaggcatggtggatcacatctgtaatcccagcacttcaggaggccaaggcaggcagatcatgaggtcaagagatcgagaccatcctagccaacagagtgaaacctcacctctactaaaaatacaaaaattagctgggcatggtggtgcatgcctgtaatcccagctattcgggaggctgaggcaggagaatcggttgaacctgggaggcagaggttgcagtgagccgaaatcgcgccactgcactctagcctgagcaacagagagagacaccgtctcaaaaaaacacaaaaaaacaaaaaaaaaaccagaactgccatatgatccagcaatcccattactgggcttacagccaaaggaaaggaaatcagccagctgaagagacatctgtactcctacatttattgtggcactattaacaatagccaagatatgaaatcaacctgtgtgcccaacaagagatgaccggatacagaaaacgtggtatatacacacaacggaatactggtcagctttaacggagtctcgctctgtcacccaggctagagtgcaaggcgcaatcttggctcactgcaacctccgcctcctgggttcaagcaattctcctgcctccacgcctgtagctgggactacaggcatgtgccaccacgcccggctattttttttttttttttactagagacagggtttcaccatgttggtcaggctggtcttgaactcctgacctcaggggatccaccagtctcagcctcccaaagtgctggattataggcatgagccattgagcccaacctcagctatttttttctttttctgagatggagtctctgtcgcctaggctggaatacagtgacacgatctgggctcactgcaagctccgcctccaggtttcacgccattctcctgcctcagcctcctgagtggctgggtccacaggtgcctgccaccaggcccggctaattttttctatttttttagtagagacgggattttaccatgttagccaggatggtctcgatctcctgaccttgtgatccgcccgcctcgtcctcccaaagtgctgggattacaggcatgagccaccatgcccggccagctattctttttttttaaagtgaaatcctgtcattcacagcaacaggaatgcaactgaaggccattatgttaagtgaaataagccaggcacagaaggacaaatattgcatgttatcacaaatatgtgggagctaaaaagtggctcttgtggaggtagagagtagaacgagagataccagagatgagaagggtatatgcagtgggggaacgaagagagttggttaatgggtacaaacatacagctagacagaagaagtaagttctaatgttccacagcagagtgaggcggctatagttaacaacagattgtatatttcaaagtaactgcaacatgtgaaatgttgccaacacacagaaatgatacatactggaggtgacggagactctaaacaccctgacttgatcattacactctatgcacaaaacaagtatcacatgtaccccgtaaataggtacaaacagcacgtttcaatagagagacacgtaaatacatttcaacacttggaataaggacggctccttccgctaaactcttcacttgacttttcctcctacctgcggcattttttcaggctccacagttcttctcagatctgagtttttctgaaatcccctcaaaacaaacatttgaacaaaatctgaaaaaccataaaaccaaagttatttatggacatcatggtctccaagcaactgtgaatggcacagaccatccacttcagaggggcgggtgagcatatggcttgggcccaccaggacccctgtgagctgctcctaacctgaggaacgctgcagaagttactgctcacctgaccacagctacactagcgttcaccaaacccaatcaggacccttagatgaaccagattttttcctcttgcacttctatttgaaagggaacaagtttatagtcagatttttttctttttttttttttttgtgagacggaggcttgctctgtcgcctgggcttgagtgcaatggtatgatctcgctcactgcaacctccgcctcccaggttcaagcaattctctgcctcagcctcaccagtagctgggaatataggcgccgccaccacacccagctaatttttgtatttttagtagagatggggtttcaccatcttggccaggttggtcttgaactcctgacctcatgatccacctgccttggcctcccaaagtgctgggattactggcatgagtcaccccacccagcccaatttttttctcttaaataaaagtggtttccaagggaggtcttatggattgtcttgcctgccaatctccaataccagagggtctagagggacccagaagcatcctattctgaggaatgtgatgggggaggaaaggcattcttagctttttaaaaaataagaccaagaggactgaaatccacaagattttctaactttgatttaaatttaacctatctggtaccaggttatagtagctcaggaatgctaagtcgctcatgccaccaaaaagctttaggaaaaaggaaaaaacccacaagctactgtacagatcagtttctcatctaatttttatttgtaggtgtcacttgtagtgggatgggtctcccagcaggtgttcctcagaacccaaatatcccagagaggatctgagaactcaccaaggaaaagagtctcatcactcaaacacagcaggcaaagagccagaaaacgagcttcaatgcaccttagagacaggtggtggggcggttctctagagctgtcctgccgccgtccaggagtgcgctgaatataagtcctgacaaacccaactactcctcaagctggattggtccaagccattctctgacaagcccaactactcctcaagctggactctggtccgagccatcctctgacaagcccaactactcctcaagctggactctggtccaagccatcttctgacaaacccaactactcctcaaactgggttggtccctagtctgagccatcctctggtctctcagcaccttcttagtttgtggggggacattacagtcccaagtttttctcataatatcattcctcaggaaggccaggcatagtggctcacgcctataatcccagcactttgggaggccgaggggggtgcatcacgaggtcaggagttcaagagcagcctggccaacctaatgaaaccccgtctctactaaaaatacaaaaaaaaaattagccgggcatggtgccacgtgcctgcagtcccagctactaaggaggttgaggcagagaatcacttgaacccaggaggcggaggttgcagtgagctgagatcgcgccactgtactccagcctgggcgacagaaggaagcagctgcggtcactctatgggaaaggtgaatggaaacacttaaactcatgtcaaggccgacttactagtatttccacatcagtcaagtaaaatgcaaccccacaacaggctgagactgggagtctgtcatgccaggttcccacggccacggagagacaggctgttctgcctcgcagagctcttgagagcagaaggcattatcacagatcaaaatgagttttacccaagaacccgcatcttgtcatgaacgcaccagaaagcatggccctggcgacgtcagcatgctggcaggatgcttccatctgttcacaaaggcagcacagattcctgaagagccacgatcccacagcatgcatgtcgggatggctggagacacacacagaggcagacgtaaggctcaactaaatcccatcatcaggggattgagttgagccatatgtcccaattttttttttgagacagttttttgctgtcactgaggctggagtgcagtggcgcaatcagtcactgcaccctcgacctcccaggctcaagcaatccttccacctcagcctcctgagtagttgggacaacaggcgcataccaccacgcccagctggaggtcttactactttgcccaggctggactcaaactcccgggctcaaaacaatctcccaccttgccctcccaaagtgctgggatgactggtgtggcactgtgcccagtctcaagttattttctaatttcccttgtgacttctttgactcattatgttaactttcaaatattgtggattttcccaattcccttctgttgtttattctaattaaattcatttgtggttagagaacatattttgaatgatttcagcccttctaaatttattcctctttgttttatggcctgaaccttttttttttctcttgaaacagttttgctcttgtcatccaggctggagtgcaatggcacaatctcagctcactacaacctccgcctcccaagttcaagcgattctcctgcctcagcctccacaacggctgggattacaggcacctgccaccttgcccagctaatttttgtaattttagtagagacagggtttcaccacgttggacaggctggtcttgaactcctgacctcaggtgatctgcccgcctcagcctcccaaagtgctgggattacaggtgtgagccaccgcacctggccttggcctgaaccttatgctgtatcctggggactgttccatttggacttacgaatacacactctgctactactgggtagagtgctccacagtcagtcaggtcagctggtttgcagcattcaacttctatatcattcttttttttttttttttttttaattgatcattcttgggtgtttctcgcagagggggatttggcagggtcataggacaatggtggagggaaggtcagcagataaacaagtgaacaaaggtctctggttttcctaggcagaggaccctgaggccttctgcagtgtttgtgtccctgggtacttgagattagggagtggtgatgactcttaacgagcatgctgccttcaagcatctgtttaacaaagcatatcttgcaccgcccttaatccatttaaccctgagtggacacagcacatgtttcagagagcacagggttgggggcaaggtcacagatcaacaggatcccaaggcagaagaatttctcttagtacagaacaaaatgaaaagtctcccgtgtctacttctttctacacagacacagcaaccatctgatttcgcaatcttttccccacccttcccccctttgtattccataaaaccgccattgtcatcatggcccgttctcaatgagctgttgggtacacctcccagacggggtggtggccgggtagaggggctcctcacttcccagtatgggcggccgggcagaggcgcccctcacctcctggacagggcggctggccgggcggggggctgactcccccacctccctcccggacggggcggctgttctatatcattcttaatctaacttgttctacccattactgaaaggggagtattgaaacctctaatgattattgctgaaatgtctacttctccctttaattctggccatttttgcttcatagattttggtgctgagataagatgtgtatatcctaggaagcaggtttttctttttttttttttttttgagatgaaattctgctctaggccgaggcgggaggatcacaagatcaggagttcgagaccagcctagccaacatggtgaaaccccatctctactaaacatacaaaaattagccgggtgtggtggcacgcgcctgtagtcccagctactgaggaggcaggggcagaattgcttgaatccgggaagcggaggttgcagcgagcccagatctcaccactgcactccagcctggcgacatagcaggtctctgtctcaaaaagaaaaaaaaaggccgcgcgaggtggctcatgcctgtaatcccagcactttgggaggccgaggcaggggaatcacctgaggttaggagtttgacaccagcctggctaacatggcgaaaccacatctctactaaaaataacaaaaattgccaggcacagtggttcatgcctgtaatcccagcgctttgggaggcagaggcgggcagatcctgaagtcaggagatggagcccatcctggctaacatggtgaaacccagtctctactaaaaatacaaaaattagccaggcgtggtggcggacgcctgtagtcccagctactcgggaagctgaggcaggagaatggcgtgaacccgggaggtggagcctgcagtgagccgacatcacgtcactgcactccagcctgggtgacagaacgagactctgtccctaaaaaaaataaatacataacaaaaattagctgcgtgtggtggcgggcgcctgtaatcccagcgacttgggaggctgaggcaggagaattgcttgaaccctggaggtggaggttgtagtgagctgaaatcgtgccactgcactcccacctgggccacagagcgagactccgtctcaaaaaaaaaacagacaaaaagcaaacaaaaccaaaacaccataaacgttctcttgaaataataaagcaatagttcctccaggtctagtctagtataaatatgcaatgcaatctagtctagtacaaattatatgtcaaagccagaaatcaaacccgtctgattctgggctttgaaatataatttatactagactagactgcaaaaacagtaacactgaatcatcattagcacgctacctttccagcagctcttgcaggctcacaatgccttgtacgtgaagatgccacaccgcttcaagcaacaaagaactctgaaaaacaaaacaaaacaaacaaaaacaaaaacaaaaaaacccccagcattctgagtcctttatgaatgcattttcctacaaaatgttcaacttaggttcttaaccatgccgtattgaaaattaacctcaagcaaaaacttagagcctgaaacacatctttttttacaaagctgtactggttttcaaactccctggcctttgggcacccacacaccgttgcccaacacttgcttctcttccttctctcttcctacgcactgtagcctacttctaaccctttctccacactacagccaacacagtattacacacactgacatgacagtctctccttcagaagccttcactggctcctcgaagctgccaggacaaaggtcaggcttcagtgtgccctgtgcatgtcccttgtctttctcactcaaccctctcccatttgataaaacaggatctgctttagccactcactgtgaacactgtgcctgtcacactgccctgatctccctgcagcctccccttctcatccccctaactcacactctatttttttttttttgagacagagtcgcgctctgtcacccaggctggagtgcagtggcgccatctcgggtcactgtaagctctgcctcccgggttcacgccattctcctgcctcagcctcctgagtagctgggactacaggtgcctgccaccacacccggctaattttttctattttttagtagagacggggtttcaccgtgttagccaggatgggctcgatctcctgacctcatgatccacctgcctcggcctcccaaagtgctgggattacaggtgtgagccactgggcccggcccctaactcgcactcttcacagtccgtgcaggaaggctttcctaactctccaatctgatatgcatgtccaacatcttcttcgcaaatctgtgagcacatgaatcatcgcacttcttgtggatttagtggcttgtttcccaagctacgtgataatgagggcagggaccaaagcaataactgaaaaatctaatgaattctataatgtatgctggataaaagaatgggaaaggccggacgcagtggctcacacctgtaatcccagcacttgggaggccaagatgggcagatcacctgaggtcaggaattgaagaccagcctggccaacatggtgaaacctcatctctactaaagatacaaaaattgggcagggcgcggtgactcacacctgtaatcccggcactttgggaggccgaggtgggcagatcatctgaggtcaggagtttgagaccagcctgaccaacatggagaaaccccgtctctactaaaaatacaaaaaaaattagccaggcatggtggcgcatgcctgtaatcccagctactcgggaggctgaggcgggagaatggcgtgaacccgggaggcggacgttgcgataagccaagatagcaccattgcactccagcctgggcaacaagagcaaaactccatctcaaaaaaaaaaaaagatacaaaaattaactgggcatggtggcacgcgcctgtaatcccagctactaaggtggctgaggcaggacaatcgcttgaacctgggaggcagacgttgcagtgagccaagattgcgccactgcactccagcctgggcggcagagcaatattctgtctcaaaaataaaaataaatgccaggcgcggtggctcacacttgtaatcccagcactttgggaggccgaggtgggcagatcacgaggtcaggagatcgagaccatcctggctaacacggtgaaaccccgtctctgctaaaaaatacaaaaaattagctgggcgtggtggcagtcacctgtagtcccagctactcgggaggctgaggcaggagaatggcgtgaacctgggaggtggggcttgcagtgagccaagatcacgccactgcactccagcctgtgcgacagagcgagacttcgtctcaaaaaaaaaaaaaaaagaccagcctgggcaacaaggcgagaccctgtctctggaaaaaaaaattacatacatttttttttaatagtttactatactaccctggaaaattctccatactaatatacccaaggctaaacgtgtttttcaatatattctagtctaataaatattactaatgataggtgaatagggacaaaaaatggcaattgaaggtacttctttccaatccacagatgatttctaaaccctttttcatccactctctgtaattaatgagaagcttggagaattcccaagaaaacccaggtactctgttgcctccatccagatcaacagaacattgcctggaacactggagagtcagatttgcaatctcaaatttacctgtattttccataattcttgacagaaggaaagacgggagaacatactgtgtgccaataaatactgagcaaactctaacagggaagacagcttcttctgaaaagagagattacattttttaaaaaacaaattacctgaaacaatactaaagctatgtcctattttcccaaccagcttaaaagtaacaacgggcaggtttcctcatctttgctggtgtcttactctctgctccacagtcagcagcacagggtgactggtctccgctggagccgtgcagatctgtcccacgctagaggcaaccatcccggctgagagaatacccacgggaacccccagccttgaggcttgatcctgcaaagcagagccttaaacacaaaacaaaaccatagctttctcttaacacatgagacaaaatctaaaaccaaagacttgctgtttaaaatgccttattttaagatgcagcacaaaaaaaattgccttttaaacggggagaatagatgcaaagggaaaaacatgagataaaaatgagaatttgatgatccaagcagctcacaataaaactggtggcaacacctgaacccagagttatacattggtatttgttacgtttcccatgacacaaaaggagcaagataaagaaatatattctgaccaagaactttatcatctttttacaaaggagcacaataaattgagaactgcagcaggctctttcaattacattgtttttctaattacttcagagataagcctgcccctgttgactcacattgatggttgtgataaaattaggcagggatttcccaacattctgccatgcacctggtgggcaggtgcagtcacagctgtgctcagtccgcaggccaccaagtggaacctcactaacagcctgcaggcagccaccattctcctgagcaaccagccactggtctgcattcaataaagtgagaaacggtgggcaacctggaagcaggcaatgccaagaaatcattttctaatttatttgtcttccaaaattaatttttttttgttttatttttttgcaatggtgtcttacactgccgcctggactgaagtgcaacggcgccatctcagctcactgcaacctccgcctctcaggttcaagcgattctcctgcctcagcctcccaagtagctgggattacaggcacgcgtcactacgcccagttaattttttgtatttttagtagagatggggtttcactatgttggctaggctcgtctccaattcccaacctcattaatccgcccgcctcggcctcccatactgctgggattacaggtgtgagccaccacgtgagccaaaattaattgtttaaagaaaccgggccgggcacggtggctcacgcctgtaatcccagcactttgggaggccgaggcgggcggattacaaggtcaggagatcgagaccatcctggctaacacggtgaaaccctgtctctactaaagacacaaaaacaaaattagccaggtttggtgacgggagcctgtagtcccagctactcaggaggctgaggcgaagaatggcgtgaacccaggaggcggagtttgcagtgagccgagatcacgccactacactgcagtctgggcgacagagccagacttcatctcaaaaaaacaaaacaaaaaaaaactggaggccaggctcagtgggtccctcctgtaatcccagcactttgggaggccgaggcgggtggatcacctgaggtcgggagtttgagaccagcctgaccaacatggtgaaaccctatctctactaaaaatacaaaattagccaggcgtggtggtgcatgcctgtaataccagctactcaggaggctgaggcaggagaatcactttaactagggaggcagaggttgcggtgagtcgagatcacaccattgcactccagcctgggtaacaagagcaatactccgtctcaaaaaaaaaaaaaaaaaaaaaaaactgttaactgcagtacgaacctgttattgtaatgtactggctctaaaaacacattatcaatacataagtaaaaacatttacaggctggttgcggtggctcatgcctgtaatcccaacactgcaggaggccgaggcgggtcgatcacgaggtcaggagtttgagaccagcctggccaagatggtgaaaccccgcctctactaaaaatacaaaaattagctgggtgcggcggcgggcacctataatcccagctattcgggaggctgaggcaggagaattgcttgaacccaggaggcagagtttgtagtgagccgagatggcgccattgcactccagcctgggcgacagagcaacacttcgtctcaaaaaaaaaaaaaaaaaattttacaatagttctagaagcttaaaattatagtacgagaaatcatcagctgctggtgaaattctcggtagaaaagtagacagatggggcacagtggctcatgcctgcaatcccaacaccttgggtggctgaggtaaactgattgcttgagctcaggagtttgagaccagcctgggcaatatggcaaaaccctgtctctatgaaaaaattagccaggcatggtggcgcacacctgtagtcccagctactcaagatgctggggtgggaggatcacttgaggccaggaggtcaagactgcagtgagccgtgattgcaccacggctctccagtccaggcaacagagtgagaccctgtctgttaaaaaaaaaaaaaaaagtagacaatgccattttctgttctgagacagagttttgctcttattgcccaggctggagtgcaatggaggggtctcggctcaatgcaacctctgcctcccacgttcaagcaattctcctgcctcagcctcctgaatagctgggactacaggcacccaccaccacacccggctaatttttgtgttttttagtagagacagggtttcaccatgttggccaggctcgtctcgaatcctgacctcaggtgatccgcacacctcagcctcccaaagtgctgcgattataggcgtgagccactgtgccaggccaacaatgccaatttctagtcatttgtttccaatgtgtctccataggaaagtttttttatctacaagtcttttactgtgtgtgtgtgtgtgtgtgtgtgtgtccgtgtgcacgtgcgtgcatgtactaactatatctttagcagaaaaaaacaaactcaaaaattaatgaattaaaggtttatctgtgtggctgagcttggttccttggaatgataatatgcaatttgtgaaattcaaatacaatcatggcagtgaaaatctgtatcatttgccaatgacattcagtgaccagttgtcaagggagcgctattactgaaggttattttaacagaaacaagtcatcacataaggacgtgaaggatcagaaaataacttactgttgttgacccagaacttaccctatctcccactctcaaactggggggagaaggaggtacctagaaaattgttctcccgtctgctctcctgggcacaccacagcctgtctcactacttccatgagcaaggggcacatccctgctgttgctatgtcccatgtttttccaagggacactctgggtcctactgcttctgagtcgcaggttgaatcagacgctgtttttaaacacagcatcgtaagaagcccaagagcaagtcacacaaacatcccatagaatttgcgactacacacaccagtggaaacccatcgcctgagaaaatttacatttctacttaatttagcaaactatggttactatataaaaacccttctgcaattcaaaatagagaaaatgaagctataacttacctataaatgaactagaatgattagcataggcctcagaactgtcacagtcaatcactttgctgagagacaattttttacacagtggaccttctacctagaatccaaaacacaacaaactccatttaaaaaattcaagctccaggccaggcgtagtggctcacgcctgtaatcccagtactttgggaggccgagatgggcagatcacgaggtcaagagttcgagaccagcctggccaacatagtgaaaccctgtctctactaaaaatacaaaaattaggagggcatggtggcgcgtgcctgtagtcccagccactcgggaggctgagacgggagaatcacttaaacccgggaggtggaggctgcagtgagccgagatcaccccactgcataccagcccaggctacagtgtgagactttgtctcaaaaaaaataaatgaaaataaaaaataaaaataaaaaaaattcaagatctgtgcataaacacaacctgtgtgtaagtaatgcttccctactgggctattttcctttttttcttttttgagagggagtctcactgtcgtccaggctggagtgcaatggcgggatctcactcacggcgacctccacctcccaggttcaagcgattctcctgcctcagcctcctgagcagctgggattacagacacctgctaccatacccggctaatttttgtattttaagtagtgacggggtttcaccatgttggtcaggctggtctcgaactcctaacctcaagtgatctacccacttcggcctcccaaagggctaggattacaggcgtgagccaccacgcccggctttttttttttttttttttttttttttttttgtgagacagtctcactctgtaatccagactggattgcaaggggcgtgatctcggctcactgcaatttctgcctcccgggtccaggttcaagcaattctcctgcctcaggctcccgagtagctgggattaaaggcgtgcgccaccacacccagctaatttttgtattttcagtagagaccgggtttcactatgttggccaggctggtctcgaactcctgaccctgagtgatccacccgccttggcctccccaaaagctgggattacagccctgagccacggcgcccggcctgtttttttgttgttgttgttttgtttttaataaaagaggcggggtctcaccccgttgcccaggttggtccagaactcccgggctcaggcgaccctcccctctgcgggccaggccaccgcgcccgccgcctcgggtgttttcttaggaaagctgtgcggtggctggactcaaaaaccccgaacctaaatctgcccgcagacggacaccagcttcctcttacctcaagcaaaagggcattcaggtcctgatggcttcgcaggaggcgcacagctgattcctttaatttctgtgccctttcaggattatatttttccctcttgacccttcccgctacggagagaagtcggttcgaaaccatcacagcacaattcacacacggggtccccggcccgacgcgcaggtggacgccgcggagaaacccaccagcgacaccctcccgaagaggggccggggctcctccccagggcgcaggtctcgggaaactaacggagacggccccaccgcggacgccggggaagacggcccaggagggcccgaggcaggggagcccggggacggctggcgaggggcggcctctgcgctgaggggagccccaggccgcgcaccccaggcccgcctgacagggcggccggcgggggcggcgttcgggaaagaagggagcgccccgcgggcggcggctgggggcgtccgcccaggcgcaggaggggccgggtccgaggcagccgcgccgccccagccgggcgcccaccccgcacagccccccgggcgcggcgtccggggatccgaccggcggaggctctggcgggaagggatcggggaaccggcgaaaccgtcccgggccggacgccgcccactcccgcggcctgccgcgcccacctacccagcagctcggcccaggccctccggcggccccctgggtcctggcccgaggcggagttcgggacccacgagtcggacatggccttggcgcctacagccccggcggcggctccctgcgcccg

SEQ ID NO: 1625 - DNA, 33646 bp, Homo sapiens
gagcacccgtaggtcggattatctggtaaggcaccggaagtgaccgcctcgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcaggtagggcggtgctcaggcggttccgcctctttccccgaccccaaaggggatagcactggaggccttcctcccaccccctccctttttcttcttccgggttccttttttgctgcgcccttttccgcacttattgctcccagattttagaaactgcttggtggtcctcagatgacctcactagctttctcttaggcgcagggaggagtgggaggcaaattatagccgagaaaccaaagctggctgatccgtgctcagatccttgtaatgtcagagcagacatgaggactttgtatttagacaaaaaattcagccccctttctttttatttttttttctttttctttgagacggagtctcactctgtcgcccagactggagggcagtggtgcgatcttggcttaatgcaagctttgcctcccgggttcaagcgattcttctgttgcgtcagcctgtagctgggattacaggcgccagccaccacgccccgctaatgtttgtatttttagtagagacgggctttcaccatgttggccaggctggtctcgaactcctgggctcaagcagtctgcccgcttccgcctaccgaagtgctggcattacaggcctgagccacagcacccggccctcagccccctttgttaattatcgtaggtgattgagtttagtttccagatagttgccaagtctttagtgcatcttaactaattaataaagaatcccatatgtaagttttctatacttcgaactcccaagatagaagaaactttatttctagtaaagttttgtaaaataatcagcgaaggattaaatgcatgtagggcttgctttcttgattatactgaatagccagaccatatatattcagatacatgtgtgtattccaaaaagttctacattattttgttgatataaagtaaacatgagcaatcactgaagtcataagaaatagtggaagaaactcaagtgtttccatcgttggatgcgtattttccgtttattcactaagtaaacatatatgatgcaggcaccgtattaagggctgagtgttcaactatgaacagcatggtatataccatgctggggactcacagcctgctggaagagacaatattacaatattgtatgtctatgcaagagatatcaacggttatcttagaggtgcctgtggagtatgtagggagtgaattagggaagaggaaatttttttaatcaaagaaggtatttttaaaatctcattatgaaagaatgagtgaaagtttaccaagtattcaagaaaagaatgtcatctccagtggaaaagcatggatcatcagggagcagtaaagcttaaagcatagatcataaggagtcttagcatgctgagaacttaacaagaatttacaagtagtcaaatgtttttgagcagtggagtaacttgatcatatgaaaaggcttgaaagatgattagttacaatgtatttgtggcagaggcagctggtttatacgtgaaactggagagccaattcgaaggtgatttcagtagtataaagaagttttgaggacctcatctagcaatggaaacagcagagatataaattacagaatatacagaggaaagaaagatggagagagtaatgatattgtcaaatatagaaagttcaaataaaatgagactgagaagaatcgcatgggtgttgggcacgatagctcacacttgtaatcttagaactttgggaggccaaggtgggaggattgcatgagtccaggagtttgaagccagactgggcaacatggcaagatcccatctccattaaaaaaaaaataaataatcccttggattttaaggattcatagatccctcaaacatgctgttttagtgatggagtaggaatagaagccagattattgagggtggtggtgtcgaggaaccagactttgagataagaaaatgctttcaggtacagagtgaagaagaccgaggttgtagctaaaggaaaataatgaaacattaacaagttatacctctaaattttgtggaagcaattattaaaatggctttatcgtcccacaatatgtactgactggaagaggcagaataggagtgccagagcacctggggaaagttagaccaatattctaagtgtttaatattgagggtttgctttaatttcatcccattgaagacaaatgaaatattattttaagataaatagaagttggtttaactggtaattaggaagatagtttattctcatcctctgcattataactctaaattggtataaaaaatagttgaagtaaataaaggatatttctttatatcacttttcttgttcaggagttctttgttagtgtttactgtaaatattattttctcagtatcagagtttaatattattcaccattgccccatcaagaccaaggataatggagacctttagatgaggaacagtgggtttttaattttctagattaattacattattaaaattgcattattctcaaccccaaaccatatataccagtacttaaagtaatttgtcctaattttttttctctctttttaaaaataagttggctactcactttccatcggaagatattctcttggtaacagcttctcctgttattaaagcagttacaaatttcaagcaggtaagaacctttgtataacttgttaatattaatttgaaaaaattgcaataacttgcatagcagttagggtaattgtgtatttttttctttcttaaaaattgacaagtacagttatatgctgtacaacatgatgttttgatacatgtatacattgtggaatggctaagtcaagctatttaaaatctttccaatttggatgccttttatttctttctgtcacctaatttaattgctctagctaggactttagtactgtgttgaatagaagttgtgagagtgggcatccttgtgttgttcttgatcttggaaaagctttcagcttttctccattcaatatattattagctataggcttgtatatgaccatttttttgttgtggtactttccttccatacctaattgttgggtttttattatgaaaagacgtttaattttgttgaatattttttctatatctgtagagatggtcatgatttttgtcctttgttctgttaatgtggtatatcacatttaccgatttgcatattttaagccatctttgcatccctgaataaatcccacttgattatggtgaattgattgcttttttttgagatggagtctcaccctgttgcccagactggagtgcagtggcacgatcttggctcactgcaagctccgcctcctgggttcacgccattctcctgcctcagcctcccaagtagctaggactacaggcgcccgcaaccatgcccagctaattttttgtattttttagtagagacggggtttcaccatattggccaggctggtctggaactcctgacctcgtgatccatccacctcggcctcccaaattgctgggattacaggtgtgagccaccgcgcccagcctggaaagttttctgttgttatttctttaaatacatgttctactcctttgtctttcttgtctccttctataacgcctataattcaaagatttgctcatttgatgccatcctttaattccctacttctatgttctttttcattcttttttcttcttcttcccttctgactgtatattttcaaataatctgtcttcagattcacagatgttttcttctgtgtgatcagttctcttgttgacatagtctgttgcatttttttttgtttcattcattgcatctttcatcgtcagaatttctgctttagtttttaaataactttttaaattttttgttttggttgcttattgtttttctgatttaattgaattgtttgtaacttcttgaagttccttcagcttctttaaacaattattttgaattcttaggcagttctgacatttgtgttcttttggtggcatatcttcttggtttatcatgtttcttactgccttatgttgatgtttgcacatttgatgacacacttgctgttttcagaagtatgggctagttttgctgtggaaagaccttcccctatggggagggctgcttgctagatgggatgtagcagttctggcaccagtgagggtgcccactttgtagtctgtgcagctccgtcagctgagttaattgttgttgaagattgcagggatcctcagcatccaactctggatgtctgcagtggtagtgagggttgttggggttttcaatgtcaatggctgctaatagcctcccaatcttttcttctcccacaaaggaagttgtggcttaggggatccctgttggcactgagtctgccttctgggttcagtggcagcagcgctggtgtctgataagtggtgcctatggagcagatagagctgaggcccaaaacacaggcatacacggaggaattaaagttctgggatctgggactgtaatgatattggtgcctagggtgcaggtacccgtactgctatattggtaatagaatatgaggtgaggatgcttgtgaggcagccagggaaaccaagaatgggaacacatgtgtgctcagagttacagcagcttcagtgtcagggcagggcctagctttcaatggcagctgagccagtgcctagattgcagacatgtgcagtgaggattggttgcaggccccaaagtgcaaactagcttactatggtgatggctctggtgtctgagatgtaggtgggcccagtatgggccgtagaacctgggtctgaggtgtaggcattctcagagtgaccatggccctggggttggaacactcacagggttgaggacaaagtgactcctttgccaaagcatcttgacattggccacttctttgtggagacaagatatgccgccatgtctcccactctagggttccctggcaggaatggttgttggtcccctcacagtagcaagggatgccagtttcctctgcagtgcaggccaccatttaccacagtggtccccaccatgtggctgatactgatagcctctgcctttctttgctcctagctatctcctagtttctcaggtatgccagggtcattattgattcttttatgtggttattctccattttcatgctccactgtgttgctgcagattgtttaatgggccgttgagccctctttgggctattttggcttgtgaagatttgtctatatttgttttttttaatgggggaatgaaggctggtatctcctacttagccatcttgatgacaatacctccatgtattctggagtgttttaattgtttaaaattacaaatattcttttgagagttattttaaaaaagctcgagttgagaattattcagatagaataccagaagctcccagaatgatactaaatttttaatcttctattctttttctccattttccttccacttagaattacttttgagaaagtttccaataaaaaattttcaggaaagatgctctgcaaatctaaaatgggtacaaatatacatgatatttattatcaatatgggtaggggtgtgtgtgtgtgtttacacatcagaaaagtgcttccaagccaagtttatacttatagataattagtgtctcagaatactttgtattccattaatttatattcacattatagtaggagtctaagaacagttgggtaatagtatcatagaaaagtcatctccaaactttttttttcctgtagctcaactgttaaaaagttttgccctgacatcccaatatatgtatactaataagttatgtgtatgagctacagaactacaattataaatgttataaagcctatgcaaaataaaatttctaaaatgtcgaaaaacgtacattctgatctttcttcccacccttcagtgaagactactaccatagcccttcatttaatacgatgtctctggtaatatcctgataatggaatataattttctcatgttgtaaacccataagaccaagggtagtttagtggcatataccatgttgtccctttataacctaaatagagatacatatgatagcttagtacttaggtatagccaaagagttatggagtttgggagaaatagaggaaaaattatagctattaatctttaaaaggtaaaagtacatatttaatgacaagctaagactgtatacataagagaaggatgtatagctgggtctcataagtatctttccagaagacctaattcagtataataatccaagagttgtgagacttgaattcagtttttgccggttttgtaagttatatacaacagaaggaaaaagcttggtttctaggcctcttatttactggtcgggtagccttggaagatctctgtaagctgcttcacctgtagtattaggttaatactttccttgcttacttcacagggttgtgaacttaaatgtgccaataacaaatatacaaatatcagctattctgtgtacagcagtaggaaatggcattatctttatgatttattgagtacctatattatatattaaccaatgtgctaggcacataagataaggagattaaaagtatagaacataacaccaaaaagtcactagtgcttatcctgagggattaaggatgagatatgaagagtgatagagactttaacatttactctgtattatgtattgtttgtttagtgttacaaagagcatgattcatgacttgtataatttttaaaggagaaaaaagattactgctaataattcacatttattaagtgcttaccatgcatcaagtggccttctaaaggtttcagatctattctatgatccttaaataaccctagaagtaggttcttacataatttgtaagactgtaaaggggtcatgagaccaaaaggtttgagaactgtcagggccatgcagtaagatttccatgcagtttttaaggagcagctgaggttgaatatcaatctgtaaggctgtgtggtctttctgcagcaaactgggcttaggactagagcaagcagatagtttatagggttgagggttttcaggttaacagtttaggataagagagcaaggaagtaaaggatttagggaaaaggtgaaatgattcacaattgaactttagctggacagaaaggaaagtgagtctagaatactgatggttttatagaacaggaaagaagagtgcaaagactagatgaccataaggtctgctagtaaatagagaaagcttgaaggataaggaaataaataagctgtttggctaaactgtagaaatgtaagtggtgttacccctcattttacaggtcagctctcattttattagccaggaaactatggcttgtagcacctgacttgcccaggagcggccaagcaaatatttaagtctctaaatgctgagtctagtcctctttccactctatatagtgcagttggctaacttgtttgttttataaacacaaaatagtgtgtaaaagcaaagtatttttattatttaagattcttgaaagaaaatactttaaaaatatacatttttaatctcttggatctatacagatttctaaaatattggaagaattcgatgttgaagaacaatcaagtaccatgttaggaaaacgctttcccaacattaaggttatagaatctggcgtaaagcaactgaagagtgaagaacacgtaagataattgttttcttaataacattttccattgttgaatcttgatgaagttttgcctgcctcttttcactccagctctactaccaccaccatttaagtttttaacatgtaaagtttagtgacattgatttccagtattattagaaaaaatacagtttttgtaagtttattggaattatataattagatttgggattttagtcttcacatttcaaattacattaatgtttataaagtgtccactgtgttctggatactgcattaggtgctgggatgcagtagggttaatacgaggtgttggctcctaggaactgtcagtgtcaaagggaatatgaacatgcatactataattatattgacatataaaaaacacagtcactgaaatactatcaaagctctgatatcagggcttaaggaagactttacagagagagtaaaatgaggggggtattaacagatgagtgaaattaagagttccccaggtggaaagaggcattccaggaaggggagattgaatgttcaaagacccaaagaaaggaaaagaaatatgaagaatagagatgtcaaagggattagggtgtggttaagtaaaggagattggcaatcaaggctagaagataagtaagtgagaacctgaagggtttttaatgtcacactataagaagttgagtttgggccggtgcgttggctcacgcctgtaatcccagcactttgggaggctgaggcaggcggatcatgaggtcaggagattgagaccatcctggctaacatggtgaaaccctgtctctactaaaaatacaaaaaattagccgggtgtggtggcgtgcacctgttagtcccagctactcgggagacttgaggcaggagaatggcgtgaacccgggaggcggagcttgcagtgagcccagatcgcaccactgcactccagcctgggcgacagagcgagactccttctcaaaaaaaagagagaagttgagtttgttttatatttgggagaaattgtaaggtgattttaagagctggggcatcaatgataaaatagatttttttttttttttaaggaagatacatctgataggagtgttgagcatgaacaagtggctagtagccaaccaaactagaaggtggttatgatagtcaaaaattatgtgaagagtcaggaaattatgtacaggctcatgcctataatccccagcactttgtgaggccaaggcagacggatggctttagcctagaagttcgactctagcctgggcaacatagcaaaaccccatatctacaaaaaatatacaaaaagttaatcaggcatggtggcgtgcacttgtagtcccagctactttggtgactgaggtgggaagatcacctgagcctgggagttcaaggctgcagttagctgtgattgcgccactgcactccagcctgggcaacagagtgagaccctgtctcaaaaaggataataataatttttaaaaaattgatttgaaaaatgatgtaaggtctgaactgagacagggacaatgtagttgtaaaaaatatcccagatttgagtgagatttctgctataaatttggcaggactcaataaccctttacatgagaatgaagaaggcagtctcaggaaaggatgttgttagatgatttacagtatcctcagatgagcttcaggtaagatgagaagtagatttgtagttgtttctataagcagttctaatttatgagttctagctcataaattagagatgtgttttatctcctttagggataaaacacatatataccacatttgaaacacaagtaatttgagagaaaaaagtactgaattttatcaggaaaaaataaaaaatctgaatccccaaaccagataagtttctaatacttatagtggtattacatattccaagtaatatatttgtcaatttatttgtaaattgaggtgggctctcaaaatatgctaaatggattgtcagggaatttatgtgttagggcatttgaatgaatcagagtgcttcccgttaccatttgaaaaatatcccacatgcagtgcatgtctgccttctcttatccattgtcctttacatttttgtttttttaacagtttattataatttcttttatttaacaatctaggaagttggcagccatcagcagttctagtgctatttcaggtgcagttgggaattcgggaactcagtggagctgttagtgtagcgaactttgtatgtaaaatacatgcatactgccaggcgcggtggctcacacctgtaatcccagcactttgggaggccttggcgggtggatcacgaggtcaggaggtcgagaccgtcctggctaacacggtgaaatcccgtctctactaaaaatacaaaaaaaaattagccaggcgtgggggcgggcgcctgtagtcccagctacttgggaggctgaggcaggagaatgacatgaacccgggagattgcagtgagctgagatcacgccgctgcactccagcctgggcgacagagcgagactccatctaaaaaaaaaaaaaacacatgcgtacttttgatagcacgtgtgaaggtatctctctaaaattgacctcattggtttcattctcagcaaactgagctgggccactcaacatggcttttatcatgtctgatgttaatgcatgttctctttttacagtaaattcatggccatcagatgatatcaatttcacatacctggcatcagggccttcacagccaccataggttttctcttccccatccattttgttcttatgaaatgctactgtgcttccccaggaacttcagtagtttcctagtgaggcgaggacgcagagtgtgtggctcacttccgtctggagaagtgtcctttacattttttagtgaattagagatagtatgttttactttcacgtctcttgccaaaaatttagcagtagctaatggaaagagtttttgtgtttgtttgtgctatttgtttttacagcagctaaatgcaaattatttttaaagttttgtcagtgcctataattaacttttgttcttgtcagttgaaattctaaccagattatttaaaagaagacttgtataaaatttctacatggattatgctatgctggattactggttttatgtatttgttatggaactgaagaattaatttgagttataaatgtctcattggatgttaagtgctatgatacagtttaacaaggtttgtaagtcaaacacttggcacaaacattaacccctaaatcattcgaacaaagttgagcatctctcatagtagcatgcatttatgtttaaatgttttctaaaggctactatttatatgtggtttttcattcagtattaaagaacaaaagcaatatatctctgatatgtagttttagacccatttatgttattaattaatataaatttaaagccaatacatgctaggattaaagattatcatattttttacttatactaaaatataccccaaaagcatttggtttgctcgtaaagtcattatttgtacttaagaatataagtactattttttttaagcacttctagtctttttagattaagaagacataccataacctcttgttccactcactgcttttctgtactcataatagatatgaaggtaggatatggttagaattactaggtcttcttacagtaacttcccttgagatcagaaatcttcatcaaggcctgtcacaggtataatgagaatgcttaaatttaaaaatttcttgaagttttgtttttaacgtggggtcaacataccttttcaaccaacatgggattccctgaagtttaatacaaaactttgtgtgaatgtacctttttatgccaggggagaaagactagttttcaggagatctcaaaatggttcatgagcttaaaatgatttaagaataactggattagtacatgtattctcatgcttagttttgtaattgctataacaaagaactgagtgccaccaagaggcaaccttaatatattatgttttgcttttgccttattgaatttttagtttaaagtgaagttgtatccatgttgattatgtgtctcccttttctttcattgtttgatgtatttacagtgcattgtaacagaagatggcaatcagcacgtatataagaaactctgtctgtgtgctggagctaaaccaaagttgatatgtgaaggaaatccttatgtattaggaatccgtgatacagacagtgctcaggtaacattttaaggttggatcgtgagaaggaaaataaaagaattttctacatttgaattaaagtgttccacttacaattcctaaactgtaagggcagaagggaaatttttgtttcatgaccagtaaaccacagagtggttatgttttattcctgccaattttctttctttttttttttttttttgaaacggagtctcgctctgttgcccaggctggagtgcagtggcgcagtctcggctcactgcaagctccgcctcccagtttcacgccattctcctgcctcagcctcccgagaagctgggactacaggtgcctgccaccacgcctggctgattttttttttttttttttgtatttttagtagagacagggtttcaccatgttagccaggatggtctcgatctcctgacctcgtgaccgcccacctaggcctcccagagtgctgggattacaggcgtgagccaccgtgcccagcctattcctgccaattttatatttttagttgacactatgtttttaagttcatgctgatgtgttatcagcgtgagataacccagatataatgactgtgctgaatattaacaacttatattacacacacattcattactctacttggggaatatgtgatttgcaacctaaataatataacaattttttccaaaaaggtgaagcgtattcaaaatgtactgatcttattctccagcaaaaaaaattcaaaagatctttgtggtacaaaatcatgatagaatcatagaacagaaaaggtcacttggcttattgttctgccctagataaactatcccaataaggtgaaacatctgtttttggagcattatacaaattccttttggtaatttaatttaattcagggcttattaacccttattgccaagaagctcttcctggtttcacaatactatgtctaacctcaagttcgttgttctgtctcatgacatgatgattttgcattaatataatttatattctgaaaatttaataatgttttctttcagcctattctcttaataattaggaattgagagaaaattaaaggaacttgattatcttcttataaacaatttaagttcatattatcagagattgagctcataactgttttagctcggtcctctacatacatgaactcattgaatcctcatgataatcctgtgtgacgattattactcccaatttacaaataggaaactgaggtcaagagattaagtatgtatctatactaatttagctgttaagtctatcagatacacaatttaaacttgtgcttttcacctctaggtccagtgctcttgcagatgtttcttaaattgcaatatcctcaatgaaggacaaactgaaataaacttcagttgtttttttcttggagaattttaaagatgtcagcttcagtgaatattataagtttggagataaatttaatataaatttagtaggagggccagatgtcattctgaagcagtgggactattctatacttctgaaagtgcccaaagaattaccactggcttctctctctcttttttttttaatatatctatatttattatactttaagttctagggtacatgtgcaccaagtgcaggtttgttacatatgtatacatgtgccatgttggtgtgctgcaccctttaactgtcatttacatttaccactggcttctctaagctcattgtgatcttttttttctggggggtggaggcatcaatgtatctgtcttagaatgttaataacatttttttttttagtagaagtttgacattattgggtgcgtgctactcctaccagctttgtctgtgtcatctcacataatccttacagaaacattaggatatatagtcccttatttccatttatagttgaaggacctgagatgcagatagggtaagcaacttgcccaaagtcattcagttagtaattgctagagccagtgcttccagagtctgtgctcttaaccactatgctgctgagcttctcattcctagaagttttaagtgttgagtaactctagggaaactgagagtctaggtgaaaagaaagaataattgatttggtcaaataattgggaatgtggtaagttaatagtgcctcctgccgaaattctgaagtactgtaaatgtaatgacctaaaaggaaaggaaaatcaggagaggcattgctataaaggcagcttgggataaagcataaagggggacttttgttatattaattgagaggatgtaccctgatacagtgggaaagtgagattcatttttttcctttacaaattcaataaaatatttacatttttagaatattatcgaagcctcatatttcagattattgcccactattacaaaatactacctcattattttctttttaacataggaatttcagaaacagcttactaaagctaaaagaataatgatcatagggaacggtggtattgcacttgagttagtgtaagtatatatttttaaatatgataacatttaaattgtttaaaaataatttgtttttaaattaaacaattgctttgtgattcttgtgatttgttggcagactggaaaatgttttttattctgaaaatcaaagataaatataattttcatatgttttcaaggggaaaaatccaccatatttttttagctcttgtggaatccgtaattgtagaaattttattataaaatatatatgttttgggaatgctttaggtctcaaggtgattggccaaatttggcccataaatgtgttttataagtatattttatgtttaaaaataattcaaatatttacaccttttgagatttctagtgatagccctcaccactttttattgcttatatgataaatcctgctacactcatttatgttacctgtctggccagtgtcacccaaaatgtttgtgactcctgttttaggatatgtggttcttgcagctctttttttggtagcttgggaaatgtgaacacattaattaattttcatcttaagacgatattacaagttcaaaaaccattgagaaatatcctgctgtgtcctgcagaagattgattcacttcatgattttatcctctagcagatgattgacatgaaatagtctggatctttttcaggccataaagttgagtcaaaccacaaagaggacaaatttgaatcaaaataaggactctgccaaagccatatctttgctcacttgcattcaatccaactctcagactaggtttttgcccctcttttagcggatgatctcacccagtggaagcctgtaagagttcttaaattgcctgagtactatgggtaacagtcattattgttattatgaagtttgtggcattatatggagaaatacagagaaagggtcaaaaccaaaatgtgggccaagagggaagaggtatagatttattgtaaatggggcttcaaatccttgtgtatagtatatacatgccagattttctctatcagctctcaccaaagtatcacttactattattataattgttatttacatttaaaaattttatgttcaaaaatgttcagagtcttacatttaatcctattcatcattttctttaagttggagattgaagactgtataattggataaaactcatagttttgtatttagtaagctcttctttggtaattaaaaatggacccacataatgttattctctgacttgaggtctgctgcgtgattaggtctttgtctctcgtgaaacttggcatacccataccctttctacactgtgtttcagtgaaactaatactaatgttcttcattatacatttatttcagttattatctgttttctcctttctaagtgtaagttaatcctttccttttcaaacagatactgtttttcataacttcacaaaaccgtaatatctcattgtctgcttctgtagagtcattttcaaaatgaaagcagtatttcccctctgtgtgatgataatcgtcaaactgtgcatcttgctgagaacatagttcaagtcaggaaaagaggattagaaggtgtcctaggaggtagagcaagtactgaagtttcttgtggttacttgtaataactttgtctgctagtcagtcatcagtatgctgaagtgcactgataggtgttatagtgtaatattactttaaatttaaaaatggtaatatagagaaattcccagtttttcaaaaagaaagcattacatgataactgtatgcctgtatgtaaattgaaatacaaactttattaccaaatttgtgtgtattccactttccgctggtcagtaatgctatatgaccagagtaacataaaatagaatgttcacccaataatcttctatgtttactgacatagaagagctggaaaaacgaagacttattaggtaaagcaaggagttccttatcaccatatgttgaaaagtatgaatatcaagtgacctggattcagatgtactaaaccttttttcgtaatctgtttattgattagtcttgaaaagtcgtgtaacctatgttatatcagtctgtgaaataaagatgacaatactttgtaccgtaaagaaatgtgaaaaattaataccttaactttttacagtattttattagtatcgcaagtttagataaaatcctattatagttaggatggccatatatcttgtttgtctgggattgtctccatttccaccagttgtaccaaaaatgattattagtagcagatagtatcccaggttaggtgataaattatgtgatcaccttaattataatggacttcagggactttgtgaaaggaatattgttaggaaaaccacttcttagcatctaaacctagaataaaatatcacatgcccattaccttacattagtggtaaatagtaatagaaggtggcttatatataccattttcattctttccttcctctaagatccttgatccttgatcttgatccttaagatttttagcttataactctgattctttccattttctatccctttccgtaatgtgctttgaagatataaaaagttgttaccaaataagtgactgattctcaatattatagctatgtgccatccatccattacttgattacactataaccagattttttaaaaagcactgcttacccctgggggccattcatataataagtgtattgtagaaattgaacattttctaatgatgtacactgtaatgaaattttacttgatattcagtacatgtatttgtcacttaaaggttctttctgtaaactgcttcagattcttttactattcaatttttaattcttaacatctgtaaagaacgttaatattcctctttataatcaatctttcccagttagccttaaaaatgtattccctacttttgcttcaggagatcattatttgcaaatgcaaagattttttacttagacttttgaaatcactcttagtaactttaacattgtttttaggtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggtaagtgtagcacctagctcattaattctcatacaaaacttttttaaaaccatatagaaaagggctacaagaaaatttaataaaataaattttggaaatagtaatatggatatttatatatctttacatgaagttttcagattttctattttatatatatgtatgtattttatatatatatatataattaaaacaagaaatttaaaataaattgaataactcagcccatctgcatctttgcaaacagatactacattttggcaatacctgaagaagttttgtaaaaaatgcagtgagttgaaaaactaatacaaacttcatatttttttaagtttgatagctttgaaaaacttttagattataaaattaaacaagagttttgtacattttggaggtgctaaaaatatataaaattataaaaatttgaaggctaattttcttacccttccagttaaccgtgtaacatccaaaacgtaagttgagtgtgtttatactcaacacacaactgaaagattatctgttttgtaactctacatcagaaaaatattaatgactaaaatgattaatatagataacataggttagtcatgctgtaatgtatgtatatatatgaatcattacattgcctaaataaaaaacttcagaacactaacatatttctctatctggtaatttttatattatttaatttcatctctttaggaaggaaaaaggaagctagaagcaaatctaaagcagataatgtaggaagtgcattgggaccagattggcatgaaggcttgaatcttaaaggaacaaaagaggtatcttttcatatactaattggtcatgtctaaatgtaattttaaattcttgaaccatttattaaagactggtaataaatatatagtcaacgaactgttaggtcactttacttaaaatccatagtgttaggaaaagacctccaatgcagttggtccatttggccaccaaagaaaactgaatgtcaaagcatcgaagactggatctcagcctacgttttaactcttgaggtgtgatactgtaatatatatacagtcataccttggagtattgcaggttcagtcccagaccatcacaggaaatgatataccacaataaagtgagccacacgaatttttcagtttcccagtgcctgcaaaagttatgtttataacatactgcagtctattaaatgtgcattagcattgtgtctaaaaatacaatgcacataacgttaatttaaagatactttattgcttaatatgctaacaatcatctgagccttcagcaaatcataatctttttttggtggaaagttttgcctcggtattggtggctgatgactcatcagggtggtgcttgctgaaggtttgggtggctgtggcaatttcttaaaataacaagtttgccccatcaattgactcttcctctcgtgaaagacttctctgtagcgtgcgaagctgttttatagcattttgcccagagtagaagttctttcaaaagtcaattctctcaaactctgctactgctttaccaagtatatgtaatattttaaatccttcatcatttcagcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaaggttggagtaaacttctttcaagcttttgttaatgttgatattttgacttactcccttgaatcatgaatgttcttaataacatctagaatggtgaattctttccagaaggttttcaatgtacttttcccagatccatcagatgcatcactatctgtggcagctatagccttatgaaatgcatttctttaataagacttgaaagtaagaattactcctggatccatgggctgcagaatggatattgtattagcaggcatgaaaacaacattcatctccttgtgcatctctgtctgagttcttgggtgaccaaatgccttgtcaatgagtgtagtattttgaaatgaatctttttttttttttttctgagcagtaggtctcaatggtgggcttcaaatattcagtaaactatgtaaacagatgtgctgtgtattactccattctcacagtatataaagaaatacctgagagtaggtaatatttataaagaaaagaggtttaattggctcatggtcccacgggctgtacaggaagcatgactggggaggcctcaggaaactttcaatcacgggggaaggggaattatgcacttcttacatggccagagcaagaggaagagagagaagggggctggtgccacacacctttaaacaaccagatctcatgagaactctaacatgaaaacagcactaaggatggtgctaaactattagaaactgtccccatgatccagtcacctcccaccaggccgtacctccaacattggggattacaatttgatatgagatttgggtggagaaccaggcccaaaccatataatgctgtcatccaggctttgttgttccatttacagaggacaggcagggtagatgtagtatagttcttaagggccctagaactttcacagtggtaaataggcattggcttcaacttcaagtcaccagttacattatcccctaacaggagagtctgcctgtcctttgaagccaggcattgacttctcctctatagttgtgaaggtcctagatagcatctttttccactggaaggctgtttcatgtacactgaaaatctactgtttagtgtagccacattcatcagttatcaattgtatatttttgttgtagagatggcttctttacttaaacatcatgaaccaacctctactagcttcagccttttcttctgcagcttcctcacttctctcagcctttacagaattgaaaacagttaggggcttactctgggttaggctttggcctaagggaatgttgtggctgatttgatcttctctccacaccactaaaactttctccatgtcagcaagaagactgtttcgctttctcatcattcatgtgttcattggaataccactttagatttacttcaagaatgtttcctttgcattcacaatttggccatctgttcagggcaagaggcctggctttccatgtgccttcctcaataaccctaataatcattgctaccttttgatttaaagtgagagatgtgtgatccttactttcacttgaacacttagaggccactacagagtaactgattgccctggtttcaatattcttgtgtctccgggaataaggaggcccaaggagagggagagacataggacaacagctggttgatggagcagtcagaacacagaacatttatcgattaagttcactgtgttagatgggtgtggttcatgacaccccaagacaattacagtagtacatcaaagattactaatcacagatcaccataaaagatctaataatgatgaaaactgaaatattgcaagaattaccaaaatgtgacagagacacaaagtgagcacatgctattggaaaaatggcactgataagacttgcttgatgtgggtttgtcacaaaccttcaatttgtaaaaaacacactatctgcaaaacagtagtgaagcacaataaaatgttgtgtctgcagttttctggcacacaactcctaaaatttttggcatctccaaagtgatgtgtccttttgtatgctaacgagttgactggttagcccctaggtggcttcagaatggggactggtcacaggaaagaccaagacatgattagagtttagactttccaacctacaggaagggaaagaggttgaaggttaagccaatcactagcagccagtaatttaatcagtcacctacataacacagtttccatgaaaacccaaaaggactgggtttggagagcttctggatagctgaacatgtggaagttgctagagggtggtctatctggagagggcatagaagcttcatgccccttcttatatgctttgccttatgtatttcttcatctgtttcttcgtgacatccttgataataaaccagtaaatgtaagtaaagtgtttccccaaattctgtgagatattctaataaattaattgaacctaagaaaggggctcgtgggagccccttgatttatggttggttagtcagaccaactggtaaaacacccggggcatgcaattggtattggaagtggaagacagtcttgtgagattgatccctcaacatgtgggacctgatgctatctccaggtagataataacatcagaactgaattgaattagaggacagccagatggtgtcctgtgcagaattaattgcttgcttagtgtgtagaaaacaccccacacacatttggtcacagaagtattctgtgttgtgagactatagtaggagaaactgagtttgttttttcctatatcctcagatcagggatagagctttctatacccagactacagtgaatactcctgtcctattttaaattaatcttttctcaaaggtcacttcagatgcatgcagtaaacttacaaaagttattagatggattggaaatacacacttaataccctaattggataaggagatgatttgcttttcctcattttgttagatattttgattttttaatagttgttaaagggctgtgaaatctaaatgctgtaagaagcatgcatgcagtccttcgttactttgtgtgatttctttagagcattggtttttggctttcagtaggtaggaggggagctggctgcacggtgtatctaatttttgtgatggaaattacacaaagtcccttcttcttgcaccttcagatcctaatattatatttttaacctgagaacttcaacagtttaattcaataagcatttattgagtatttactacctacgtgggactttattaatgttcagggatacgacagtaagtcagaactgacctgaagaaaattttatagtccataactgttgtcattttttaaatttttatttatttatttatttatttattttatttatttattttttttgagacagagtctcgctctgtcacccaagctggagtgctgtggtatgatcttggctcgctgcaacctctgcctcccgggttcaagcgagtctcctgcctcagcctcccgagtagctgggactacaggcgcacaccaccaggcctggctaattttttaattttagtagagacagggtttcaccatataggccaggctagtcttgaactcctgacctcaggtgatccacctgcgcctcggcctcccagagtgctgggattacaggcgtgagccactgtgcccaacaactactgtaatttttaaaaaatgcatttgtaattatcaatgaggcctaggctaaaaagcattccctcgatgctatctgctaatgcagctaccagatctcttaagttactgaatgaatttttgttcactcctttcatgtgcatagagagacttattttagggcacccaatgtggtttcatttatattataagaattatgttttctatacatttctacaagtatacgttttttcttcatcattagtaacccgggttattctttctgtaagtattatgctaaccagtattttcttaattttagttttctcataagattcaccttgaaactatgtgtgaagtaaagaaaatctaccttcaggatgagtttagaattttgaagaaaaagtccttcacttttccaagagaccataagtcagttacagctgatacaggcaagtaatgaaataagaaaaaatatatataaccacttaattaaaaggaaaacaatttaatcctgctgtgttctattaaaaataacttcgtatttccatataaaatttaaacatgaaaagtaaaaataaaaccataatttaataacattaactcacttcatttcactgtctgttgttttctagtaaattaaatcgtatagggcattacatcttacatagagctgagtgttttgaccaacaatcagaatatattataaatcaaaataagacaaaaacctagagctcttaaaggtgacatgatttcacccaaatcagattgaaaatgtatatttttgggactaagatgcagctctcctaactccagttccacaactcctctgagaattgccatgatttgaagaaatacactcagttaactagcatatgaaatattctactgttctgaattctttgaatttttccataggaaaggggaatttgaatatgagtagtgagggaagacacctagttgaactaaacacttaagtggagtgtaaagtattacaaaagatttttagagaaataatttagaaataatttaaatgtactttgtcaaaatttatgtgtccaaatttgaaggaaaaacatttaaaatgccatggttttaaaattatacccaaacgagatgatgctaattgcattaaaattgctttagcaaatatgcctcataataattgctaaggagtgtgttacaaagttatctcttgcctttctttttctttctttgtttctagtcattgtagtcacatacactgctgtggtgatggttccatttacaaataaagtctgtttttttggtttttttttcttaaagagatgtggcctgtctatgtggaattgaccaatgaaaagatatatggctgcgatttcattgtcagtgctacaggagttacaccaaatgtagaaccttttctccatggtaacagtgtaaggtgaaatttttttgtccagctgtgaatatatttgaagtatttttgtgaagatctctaattctcaaacatgaataattattattttagtgtacaactgtaacttaacatggttggaaacagtttggttaaaacattgtcttgatttacagtattttttactgcttaaaatccttacatagttatatccttgcataagcgtcatcagtaatggtttataatgtacaatttatttatctaaatgttggtaagagactgacacctcccgtgacttctcaaaaatgattcttttagagaaaccatcttgtattttttgcttttcagcacttgaagcttacaaaaaaaaaaaaagaatattcttgtagttatggataaggtagtcacatggttattggatacttttcatgttgaaattctgacagttttatggatcagtcttagttggaatttgatccatggaaattcagctcaggtgtctaaactttgctgatatttttcattttctcattaaagatgagcatgcaaagtgtaacaatttaatttgttcttttactttaaaatggaaaaagtcgtttcatttttcttaacacttaacgcttatgaggaatgttgtttagtttgatctaggagaagatggtggcctgaaagtggatgatcatatgcacacatcccttcctgatatctatgctgccggtgacatctgtactacatcctggcagctgagcccagtctggcagcaggtaagctagcatatataattatatgttttcatcagagattctgtctgaaaataaagcggttgttaccaacaaatccaacttctggttttccaacttttctgcttaagtaggaagctagcacagttgttatatatatttaaaaaaaaaactagaatatttccctgtttggtaagttatcattataatggtagactgagacatcttttactttaaaagaaattatgggctattactttgtttttcattcttacctgcttatcagcactgtccaggagaactttctgtgatgatggaaatgtttaattcctcaccatctagtcaggtagccagcagtatgtcacatgagcacttgaaatgtggttaatgtgactgaggaactgaattatttttacttacttctcattaactttaaatatatgtggctacgatgttggacagcacaactttagattaaaaaaactactaagattgtaaattatatagaaaagcattctattcctttatgatcctattctgtccctgtggtaatcattactaaaaaatgttctgggcgcagtggctcacgcctgtaatcccagcactttgggagggtgagaggcaggtgtatcatctgaagttaggagtttgagaccagcctgaacaacatgatgaaaccccgtctttactaaaaatacaaaaaattagctgagcatgatggtgtgcgtctgtaatcccagctattcaggaggctgaggcacaagaatcccttgaacctgggaggcggaggttgcagtgagctgagatcgcaccactgcaccccagcctgggcaacaagagcaaaactctgtctcaaaaaaaaaaaaaaaaattcctgtagtaaacacctttcctgagccttaacaagtcccaactggatctagactttttcctaccctcacagctttacctacctcctcctaacggtggaacaaaaatactagaggaagataaagacagtgaccagaggtgtgcagaggggtagagacctaggtagatgtttgaaataaaggaaccaggcaacatttatctttgttaaagaccagctccacagttagggacattattcattcagattatgcagtgtgaagtaggagaagagctaaaagtatttcaagaggcagcaccatcattttgtgttcttacagacagtagagacatcagtaagaatggttccagcctttttgtttctaacctgcctcattctatgtcatttctgtggcaagactatcacaaattcttagagttggagtttatgggtttttttttttttaacatttttaattctctagggtaaattatatcttaatgtgttataatctgaaagaggggaaaaaatccgaaaataaacagatggccttgttttgagtgcaccttataggccccatttcttggcttacacaagcaataaggatactaatttatgcagttcaagatgcaaattttccggccacttgtattagctgttctctagttgttactgtgctcagtttattctgacccccagccataaactgcctttcacttcatcaaatctataataccttgtttacagaggagattgaaaaaaaaaaatctatcacttctgctagaaatgcttaaaactcatgtctatgattatgatattatttctgcaaacaaaagacagcattaagtacatatgcacatacagggaggtagaaggaaaccaagtgcttattatacgctaacctgtttaattctctcaatagttacagagtaggtagtgttatgtttacgtttcaggtaaatgaaccgaggcccagaaaagttaaatatatatgtagatctgttgatattaaaatccactgtgactcccaaggtcagtgttttttttttttattattatatttaagttttaggatacatgtacacaacgtgcaagtttgttacatatgtatacatgtgccatgttggtgtgctgcacccccaccccacaagagtccccggtgtgtgatgttccccttcctgtgtccatgtgttctcattgttcagttcccacctatgagtgagaacatgtggtgtttggttttttgtccttgcaatagtttgctgagaataatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgctataaacatacgtgtgcatgtgtctttatagcagcatgatttataatcctttgggtatatacgcagtactgggatggctgagtcaaatggtatttctagttctagatccctgaggaatcgccacaccaacttccacaatggttgaactagtttacagtcccaccaacagtgtaaaagtgttcctatttctccacatcctctccagcacatgttgtttcctgactttttaatgattgccattctaactggtgtgagatggtatctcactgtggttttgatttgcatttctctgatggccagtgatgatgagcattttttcatttgtcttttggctgcataaatatcttcttttgagaagtgtctgttcatatccttcgccgactttttgatggggttgttttttttttgtaaatttgtttgagttcattgtagattctggatattagccatttgtcggacgagtaggttgcaaaaattttctcccattctgtaggttgcctgttcactctgatggtggtttcttttactgtgcagaagctctttagtgtaattagatcccatttgttaattttgacttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatcccgtttcagctttctacatatggctagccagttttcccagcaccatttattaaatagggaatcccttccccatttcttctttttgtcaggtttgtgaaagatcagatagttgtagatatgaggcattatttctgagggttctgttctgctcgattggtctatatctctgttttggtaccagtaccatgctgttttggttactgtagccttgtagtacagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggaattcactcatgatttggctctgtttgtctgttgttggtgtataagaatgcttgtgatttttgcacattgattttgtatcctgagactttgctgaagttgcttatcagcttaagattttgggctgagctgatggggttttctagatatacaatcatgtcatctgcaaacagggacaatttgacttcctcttttcctaattgaatgccctttattcccttctcctgcctgattgccctggccagaacttccaacactatgttgaataggagtggtgagagagggcatccctgtcttatgccagttttcaaagggaatgcttccagtttttgttcattcagtatgatattggctgtgggtttgtcatagatcttattattttgagatacgtcccatcaataccttattgagagtttttagcatgaagggttgttgaattttgtcaaaggccgtgttcttttataccagggagtctcaaaacttcatagaaataaaataaaaatacaatagatgaattaatacggtcatgcaaaacaatttaaatgacttcccagaatcagttgctgagatatttatgttgtcttggtgaggcaccaagagtctgtctaaccactgaggttaacagcacagcagaccttaagtagtgcataaaaatgaaggttgctggaaaatagaacaaattcttcagtgataatttgacatctctgttaatggtgatgacaaatttttgaagaagggactggttaattaaaacatttttctcacctggtatagcttaatatagtttcataatatttaatagaaatgctactaaaacaggtgtgattggtatcatcttttaattttagaggcagtaatttagatagaattaacaaataccaaaaatcagtctgattagttatccattggtgactgcttctgtggcaaagatgacagaaagactgtcaaacattgaactcctttaagtgaatttacaaggttaacatttttcagataatgatcatgaaaaatgacattgtgtaacattttttcatcatttcagatgaggctgtggacccaggctagacagatgggatggtatgcagcaaagtgcatggctgcagcgagttcaggagactctattgacatggatttcagctttgaactgtttgctcatgtgacaaaattttttaactataaggtaagatagttaagcatattaatgccttctctgcttgttagtcttatgactatgataaatcatgtgattttcttgcttgaataaaaacgtacatagttttaatcatctacaaaaaaatgacatttttcatttcttacaaaccaatacctggtattattgctagtcttaatccctaatcatctgataattatccaccttaccactattctattttagttaagagggaaaaaaatttctctctagatctgttacttgttggtgcatttttaacttttacttgtgattcatcctttctttgtgaggggaactaactgctgttgtactcaaaaataaaccaagagctttcctgtatctattatcttattcagtcctcttcacattgacaaaggttgttttgggtttttttttttccctaatttacagagaaggagaaacatattcaaaagcctcagggaaattaagaaacttttccatgaaagctctaattcagttccttgccaaatctttaaaccacgactccacatggtttaatgtatccacatcctacatatttatatatttactgtatagttttaatgttcatatagattggtagaatcacctacctatattcactagatatttttagtgttaaaatattaaacattaacatttgactatattcaccagaattttttaatgtcagtgtagagtgtgtgatagtgtcatctgtagaattaacgcatgctgttgaaacattttctttgggactctccccaataacatttttagttatgaaattttgtggcataagttttctgcggctattcaaacttgacacaaaataactacccattacattttctttatgatactcatgacaataacctttttatctctaaatataggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgagcctctgtcagtataatattgctttcaaaaagatagttatgtcaaaagaaaaaatatagctaagtatataaaggcataaaaaacttaagacgattgtatgaacttattctcaaatattttacatttaaagggttttacataaaaatttttcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaaaaaacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacgttgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattcaaacggagtcctcccattccaagaaactggaaacccctagtttatgttaaaaggccagtctaaattctttcacttacatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgcgtggactttgtcacttgcatagtaatagcatgtgcctcattgttcagaagattagctttaggtcctattttcaaatacgaaatggtagcataagctgtaaaactgtagtcttctctgcagaaaataaaggccaacaataagaaagcttttgaaggaatcacggaaaacaaatttataaaagaaataactatatgcgcagtaattcttaacacattgacttgaaataataaaatttacaagaatgcaaataaagcctttaaagaa

SEQ ID NO: 1626 - DNA, 32761 bp, Homo sapiens
ctaagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgagcctctgtcagtataatattgctttcaaaaagatagttatgtcaaaagaaaaaatatagctaagtatataaaggcataaaaaacttaagacgattgtatgaacttattctcaaatattttacatttaaagggttttacataaaaatttttcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaaaaaacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacgttgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattcaaacggagtcctcccattccaagaaactggaaacccctagtttatgttaaaaggccagtctaaattctttcacttacatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgcgtggactttgtcacttgcatagtaatagcatgtgcctcattgttcagaagattagctttaggtcctattttcaaatacgaaatggtagcataagctgtaaaactgtagtcttctctgcagaaaataaaggccaacaataagaaagcttttgaaggaatcacggaaaacaaatttataaaagaaataactatatgcgcagtaattcttaacacattgacttgaaataataaaatttacaagaatgcaaataaagcctttaaagaaaatattttcgttacttttttttatttatagtgattaaagtttgagtgttttaggtaaattactttctatagcatttaaaagttcacacaaaataactgcaaaaccgtttattctgttgcaatttttaaaaaaaaaccataaagacaacctgaaagaataatgaatgagtttgtacatacttaagatactgctgtattagaaagtgtgcaataatcttctccagatcttcacgaggaagtgtgggagccacaacacctgctactctcagttttgctgcaccctttcccatccaagaatcaatcagtttcaatggagtgagtttttcattcagttcctctgcctgcttcaggatcttgattagatctctgcagtactctgttatgttctttctttcaaatgctgtaataaaacaaatatggtagcaggtaattaggatttagaaatgagggcaaagataggctatcttaagtagttaaactggtttaaagctggttatcaatgtgagccaccctaaacattgatttttaaatgtattctgaattaagactaggctattcctcaagtctctgtcactagaccaagttatggtctctgtaagcattgtggggtttacagtgatatatataaaaaaaaattggttatcagaagccctgccatatactctagaaatcagaaagtgtctgccagacatgattactaagttactaagaggtgtgttttataggagaccctgtctgttctagtataggctcctgagtgaactctgatttagcaacaagaatgtcctcaactgataacccaattattaagagaccagtactctgatttatatataacactcttgttattttataagatagtctaataaactcataaatttctctgtctgcaaagttaaaaatacagtggcttccacctaacaaggcatcagaactcagtaaggtcttaccatgaggtactggctagtccagatcttgaaatacaacacacggatgaaaaaaagttaaaatatagtgccaaaatgctgcaggcaaatccgaaaattgggactcagcccaggagggttcccagtttcatgcaagaaacaatctgagagcaagccaacagagtaaagtgaaagcaaagcaagtttattagcaatagagtataggaaaatggcggctccatagacagagcagggctaccccaaaggcagagtggcactgtacattgctcactagcggtatttatagctgctccttagttatatgctaaataaggggaagattattcatgaatcttctagaaaaggttagggagttcctagaaccatgtaattttcgggcattgtcacggcatttgtaaactgtcatggtgctagtgggagtgtcttacatcatgcaaatacattatattttctagttctaacttgtttgggccagtttctttgctatatcttgttttgaccagatcctgttttgatcagcagggttgtgaccaatgctcagaaaacaaatcctgctgatctacatttaaaagaattttaagtaaatctccgatgactagccattaactggatcaaaagtgattctctatagtctctattttgcactaaattttcttttcaattagtgactataaagtattagagattatcacatggtttcccttttcttatagaatagcatttctattcagaaaaattcaaatattttccttcatttattaaaaatttcacatcctcagtatagcaatataaaatgtgtgcatacacataagacttttccttttattcacctttgtttcaaaacttcatgttgatagttttaattctggaaaatctgattcacactttaatcttttaaatccatttggaagtctaatacttctctcatgtcccagctgtatatacagttttgtgccacataatattttggtcggtgatggaccacgtatatgccagtggtcccaagagattatataataccatatatttttttttgagacggagtctcgctgtcacccaggttataataccatatttttactgtacttactctatgtttagatacacaaatacttaaccatgtgttacagctgcctgcagtatgcagtacagtaacacgctgtacagattggtagcctaggatcaataggctataacatatcacctaggagactataccatctaggtttatgtaagtacactttgatgtttgcacaatgacaaaatcacctagtgatgcatttctcagaacgtatctctgtcactaggcattatgactgtattagcctataaaggtttacaaaacaacaaactcaccactgtctttacagcagttatcgcacattttgttacatgcttctgagttccatacttcatcaaaatgttgagccatcaacacacgacgacatctgcaaacacatttaaagatacaaattattaaaggatataataaagttttaagaatctctatttcagcttacatagttatatactgtattagcttcctataactgccataatattaccataaacttagtggctttaaacacatttattcttacatttctgtggtttagatttagaagtgtactatgggtttcactggatcaaaatcagagtgtcaggttcttctcacatcacacaatctaaaataatctccctattttaaggtcagctaatgaacagtcttaattccatgtgcaatgctactttccttttgccatgtgaggtaacatacaggttaggaattaggacgtgaacatctttggggggccattgtgcccccgacataggacttttttccccacatattcttgataaacactgtttaaaaaattgtctgagttccatttttaaattcaatgttttgcaactattaggagaatattcttgacagtaaaatagtttcttatattttaataaagtagcaatatttgagttgaaaccttaaaatatgcttcatgagactctactggcctttggaagacattttcattttctcatttcttttaactagattattgtagtatctattggaaagaaagaacatttctatcactgtctggctgctatttaccacctcgacatttctgagcacttcttatgtgataggcaataaaagcacaaagataactatgacagaaagctttcaggaagctatctagtctaaagccaccctaagtagatttaaacttacttcttaaggagaaacttggtatttcattgacacatgagctggcaaggtggcacgttactgagcttgactctcaaaatgcctatcttaaccatagaccttttcaaaattattaaatcatgtaactgtacagcagtgccagagaaaaaaagccttcaagttgctatcaatgtgtctcaaaaaccttcaattaaaaaagtagttttggaggattatctcaaagatagggcatcttttcttgaactaaggcagatcatacaggttgatgtgctggttcctaccctccaacatctgcttttatggatctgcactttggtgttccaccaatgtatttagtaagaacttaaaaacgatgtcatatactttcatatttgctttaattgataaaagttataaaaaggtatgtggcttacttgcttatgttttgacagtatgataccatctcataaagcttctgctgtcccacattttccatcaccaccattgaacttattctgaatatatctccaaagccgtagtacaaaatacagtctgctttcatgtcatctcgacctgtggtgtgagaaaccttgagattgcagaattacatttacaaattcaaaatatgcaaaaatgacatatggtaaaattagcaggcaatgttttatactacatctagaaattttagagatgtggaagttaatttgtaatgggtaccctcaaattaaaaaaaactctaaagagacatcaataatcagctctactaagttaaaaaatgtgtctataatccagttaagttatagatttgaaatcactaattaaaaattcaggaggcaaagatgaacatcaaattatcttaacacacataaaaagaaacaattcagataacagaacataagtaaaaatttctccatatgcaagtaagtgtcaaactgctaaaaatacattgttctaaaaatactatccaataaagataaaacatacagacttattaagcatttatcatgtattttttggaaaagctttctaaaaatttacttctggatttgagtcctacatacctgcacgtccactctcttggtaataattttccatggatttactcattgaatgatggataacaaacctcacatctggcttatcaattcccataccaaatgcaacagttgccactactacctgaaatattttaacattttatcagttaattaaatcaagtttaaatattttaaaggtaaattaggcttctatggaagatatagacctaacctgaatttcattggctgaccattttctatgaactgtggtcttatcttctggctccaaattggcatggtaagcacctgcatgaattcccagattctgcaaactaaccgtaacttgttcagagtctttctgagaaaaacaatatatgattcctgcagtaaaatatgtgcatttgttagatagatatggcatattcctggaagatggttttcaacacacacattcaggacattgattaatacaatgcacagaaggaaaaaaagaattatgaaaaatttcaaggccttgtgcatatattgacattttggtataattccagatttgagcaccagcttcctttaaagcagaaatgagcctgagccatcagtttttgttcctgttatctcttttctctctttaactttatctcccactaaacagtatttctcaaactgatgtctgtaagatgctaacaaatgtgctatgaatgcagtgttctccagattaattttgggttaatttagattaatttgcatgcaaattaatttggagaacattgcattcaacaaagttaaatgggtgtctctctttattttcagggatggtcagagcttctagtttgctgatacaccctgtgaacatccaggcagaataaatacctgcaacctttctcaaattcatttgaccctagaactccttttacccaggactacctcctgaaaatctatagaacagtttaaaatgctactttcacacaaattctttgcttcagtaacatttgcttagtcattaaacccagaaaaccatgtatatatactcacaactcgatctgtgcttaatctattcagtatgtactactggatttatttattgctttaacgtgtcctttactgtaagggagtatattttctatccctttagaatatcagttgcttaatccactattttgtacacagtggatacatactaaatatgtgctgttgataattaacattaagtcatcaggtctattctaaagcaagtgtaaataagcaaaaataaatcaggcaatttgacgactcataatctatggcataagcaaatgtcacacccaatttctaagatcaagtgaattaattttatcacgtattttcaagtatcttctgctatacattaattttttttggtgttattcagttatcagtataattatcaatatgatatgaagtcactttttgaaagttatctctgtctccaaagttggtttgtttttacattacctgattgccctttgtatctcccattaatgagctttacaatatcctcaataaaatcttcagtgtttgagggcttctgccgaacctaaaaaaaacttaacttattaaaaagtaaatgaatgagtaccatccaagtggctgtctatgtacaactttcaggatgcagttctttcatgaccatagtgttttttttcctattactctttcacttactcacaggattcaacccatctgactcatctgttcctcctcccagactcttcttgatctttatttttttaatttaccagagaagagcaagcacatgagcagtgaataacttgcaaggatgcagacttttttattttgcgatgctacttttataaaaacaaaccgtaacataaataactctttaatgaaaactcagaaaaatattaaatctattcttaaaagggtttagaaagaaagaaaagacagctgttaggttatttgattttcaagtttatcaaataaaattcaaatagaattggcaaatctttaatggcatatgaatacttctatcacttagtaattaatttgaacagagatgttattagggtccttagtatcactccatcctttctctccatctttatacaaaaaagaacatacagaaatttaacaaagatatatgacttactcatatgttttataaaaagtatcacctagcaggtgtcttccatttaatctaacaaaggtttatgtagcaaaagatacatgaatgaagccctaatcacagaatctacttataattacctcctaatgttaaaaatttttgtaagtacttaactgctcatgtaaataaacataataaaaaggcagatcccctctgcgtaattcttcacaaaagtaaggaattgacataaaaattacatacctcataatatagatttggcctattaaaagaagctgtaaaagtaaaacacttttcaatgcacaaaattttctgagcatccgtcaaaacgtgatttgttgcagttgcagtcagcccaattagtgatgcgttagggaactgccgctttaagataccaagtgccttataatctgaaaaaacaaacaaagtggccctttttctatcctttaagagttagagtaaattatatcttttaacattatgcagataatcgatgactactatgattttgtttccacagccatctatagcagtaaatttgcagttctgtgttagcctctttgatgggcaggctttattacgtttatttcagacattactcttggtcacggtggactcaagagacagtgggtatagccacagtgttttaatttattacaactaacaaaagataaaacaggccatcagacaaacccctgctaccacctagtgtcatcagaccaaaaaaatcttggtaagggcggcactgctttgtatataacctatttctcggaaaccattctaggctcaaacttgttataagcatctacatcactagataaattgtcacttaaactatttggaggaaactgaaaaaaatgtggtagaaattgcttacatgctaagtagaggactactatgaaaacaaagaggacagagcagctgcttgggaagtgaagatttcaaggagataatacttgagttgtgtcttaagagaatgagcagaagttcactaggaagagacgaacatcacgcagaggaaacagcatatacactgcaaatacactgacatgaaattagtatgttcagataacagcaagcagttcactggggctaagtcacagagtcttgtggtggatggatttactgtccaatccattaagctgtgaattacatctcccagaatctctttcctgttccaagttagagctgacccaaaagagggacttgtgcaagatttggtggcagaagtgaaccagctaacatcactccttcaaggtctttacacgcagagaggatgatggacagatgcagaagtgctcagccagttctaggtcatcctagttcttttccattcctcattcagctgttcctcccaactgcaggtcctgccaatcaacagcagacccacagaggcgatagctactcacaggaagtagcttaccagagacctttccacgagcttccctttaggggtcccctttgccactgtacatgccagctgcagatttccctacaagctccgcctcgtcctcctgcaccagtgcttaggtatcaatccattacttttctctaatcctccaactcccctcttcagacctgcacttccccagttcctcccacaattgttcaagatctacttcctacagtaaaaccgttatcccataacattcatcgtgactctgcttctctgcctgaaccctgactgacactgttatgtacaaggcaggtttaagaaaagctatgaacaattcaaccagttgattctaagctgagactttatcctacaggaaatgaggaatcatcatgtaattttttttttttttttttttgagatggagtctcactctgtcacccaggttggagtgcagtgacacgatcttggctcactgcaagctccacctcccgggttcacgccattctcccgccttagcctttcgagtagctgggattacaggcatacaccgccacacctggctaatttttatatttttagtagagacggggtttcaccacgttggccaggctggtcttgaattcctgacctcaggtgatccgcccgcctcggcctcccaaagtgctgggattacaggcgtgagccaccgcaccgagcccatcatgtaatttttaaagacctatgcttcataaatcatcttttggtgacagtgcaaaatacagactggaatagacaaaacactgaaggaaaaccagttaaaagatggcagtaacagaccagaaaacaaataatacagaatataaaatgagacatgacattcaggataaatcaaaaagagtaaagagacatacatgaacctacaggtcctagtgactactgggatatggaggtggcagggaagagggagacagtgctggatttacccattcatcaatagataaatgttgaacacctttttaattgtgtgccaagcatttccctaggcactgaagataaagtgatgaacaagacaaaaatgctatgcaaatgtgtctataattcaagcaaagaaacaagacaatacaaagagtaaaccaataaatatgccattagagagtggtaagtgctcataatgataagcccagtatgctggggcttaagaagagaggaagagtaggaaatcaggtagacagatgggggcagatcacatattaccctatgggccccagttaagaacgctgggttttattctaagtacacagtagctactgggtagtttaggtagggaagtaacatgatttgatgtgtatttagaaaatatcactggttgctctgtggagaatgaacaaaaagtgtaagaacggaatcaaagactacttaggaagctgctgcagtagaccagtggaagggagctcaactgtatgtaagacgtaggtgcacagagagtagacaaacttgagattcattctagaggcagagctgacaacacttagtggtggactggatctgcaaagggagggtaaatcaaggacggtgtgtcatccattttttttttgtcatctctaaccccacccttctatactgtgctttgggatgctgcaccaaggactctgcacactacgcatcagctttgcctgctggccctggatggaagacaccatggctgcttcctccctaactgcttcctgtgggcttgcttgtgttcctgtgactgtcacccctgcaaggcttctcatccctgcagcagcacttctttccttaagagcaactaaatacagttggcacttttctcagcctttggagaaccagctttatcacagacgtaccccacctctgcctctaccaagagactccagcaccagggagctcagttccacaagccctcttcattaagtttctaagtcttatttgttccaatcttttcttcctgttctcccagccctacaggtggttgttgcttcttccagtttttaactccatgatatcttcgttttctttttactttttcagttatctatttagctactttttacctagttcacaattctttctaaaaaattctctctgttcaaataactgtctcctgactggaacctaaatgataaagataactgctaaaattttggcttcagcaaacatgtgagtgagtggatgattttttaagacagagaagactgaaggggaaattgcttgggagtagagaggagaacggagaaaggaaaggcgaagaaaacaaaaagtttttggttagaatgtcgagtagagttatggggaaaatattcccagttgagaagaaaaagagcagttcttttgggggaatttagttttggtcatgctaatttagatacacatttctgataaacaattaggagtataaatttaaagtttagcagttagctaattagatatgggaataatgttttacactttggcagcagatccacagagacaacataagtcatggtaatacttaagcaagggtgataatcataagggatcaaaccatttaggttgaaaatagggcaagagtcacaaatcaggtaacttcagtggccaccaggtaacaactatgtggcgctatctggttaagaaaagaggggcccttaatagaaaggcgtatacatcccgtttaaggcatttaaatctatttaaaatatataaataaataaaaacaatgcccataataattctgtaggtagagaatgcagtcttcgggctacaagctcactatccctggagaaacgtaagaaagggtaaagactgaggtcagaaccctagggaacactaatatttaaaaagaagacaggaagagcgaaggaggtgagaatggaagggaagacactgaacagcactgctgtacagtaaccaagggagtagaatgtggcaaggtgagaggtgaatatataaaatgttactgaagtgaagtgggaagaggaatgaagatgagaccacttgatgaagtggtctcatctgggggtgggtcaccgatgacctgtttcagtagtatggtggtggcagaagcatgattcaatgagttcagaatgggttaaaggtgaaaaatggagatggtaagctgagaagtctgatggtgacagaaagaacagaaagaggacagtaacattaaaaggtcagaagggtgttttagtttctgtttttagggagaggacaaaagagcctgaaggtgaaggagtgaggaatttggcagtgcaagatcttaagaaggcaggaaaggatgaaacgggagtggtcatggttagccttataaagcagtggtcttttctgccttaacaaaagaaaaaaaaaaaagattactaatgtttgaaagtagaaagaggagctgttcatacctgatggcatctattttctgtgaagcagaaagcatctgctaagtacaagttagggcctgaatagaaagttaatgataggagacatttgttggaagaaatgtataaaggagttgaaatagggacaagtataaggacggctgaggataatgaaaagctgaatggagttatgcaatttttgtttttttgacaatgtttagtagccaagcagcaggaatggggaaagccaaagtctagatgaatccagcatctcaggcacaacgcctgaagcagactggcagaatggccaggcagtccagggcaaatataacagaagtaaggggcaacagcacagtgtctggacgggaaacagagtgattgctatgtagggacaggagcctggataaataagcagggattaaaagagggatccagcaaatcctaatgtgtgaaaagcttcagaaggaaaacaggttgaagccagggagtcggatttttgaatttaagatttttttgcatataacaattctgagtaacttactttaggctatgactgtaggattaggtggtggggtgaagaaaaaggtcactaaaaatatctcatcaaagtttcatgctgaggagttgtatgtgggtgctgaaaagaccctcagaatgatgactaaagatgacaactttgaaacagatgcaaattcttcaacaaatgtgaaggaatacctagatgtcataaatgccacaaagatgtccactattggctagtaaacatatgtgtccatatttgtccataattgacaagggcaattaaactacagactacagtggggaatgaaactaaacattctgcctctcagtcctcctcataatgaggcaagataaaataagtaatacaggttgatcatcccaaatccaaaaaaatccaaaatttaaaacccttttggttccgaacattctggataacggatattcaatgtgtaactacttgaggatgattttaatagaagcagagatttccatcatgccaagctgagtaaggacacggtctatgacatcaaaaagttttctagataaaacatacataccaggtctgaaatcatgtccccactgactacagcagtgaacttcatccacagcaattcgagtaaatctccttgcttcataggctttctctagtcttgacataaacattttgctttttgcaattttctctggagtcacataaatcagctttaactcggagtttttatttaccatttcagcatgaacccatttaacatgctcctattaaaagaaaaaaatagacacaatgatagtaaaactaagctagcagactgaaatactaggtggtaaatgaaaacgttcatttctccaaagcaataatagcctttggctcttctaggagcagatgtttagttcattaaaactgaaaccatgtctcagtacgaaacatcatggcagctgtgtaaatagcattctagttatttactaacgtctacattgttgatgactaaaaaaaactcacttgacaaaaaagaacacaaacagatactccaatgaagagcatttattctatgaaggcataatcctaaattgttcataatatattctaaaatgtgagctagatgcaattgttatggttataaaggtgggttttattaattttaacattatatttataatccctttatgtatgtgaacaaaatttattatttattaacttctcaaatgataccatcaaatcttttaatctctttatttaaatataaagaccatggggtttcacaaagtatcactcattaaattaagataataataataaatcttaaaaggtaacagttattagattcttagtactcatacaattctatacaatacttagcatattagatgtcattttttttccttctaatctaaagaggaccaaaaaagtataaaaacatgccagtgaatgagatagaaagagacagtcaaactactttcatcatcccagcaaagaagcagtttgttaactcctagatatattctaggatacagatgttctttttttctctctccaactttcaagagtagggatatatcatgaacttgtaattatctgcaactttctaaattactttctattactattatgttctttttcaattttaagaaagtacattattagaaggcagttttctccacagattgattttgttggaggaaggagcagttataatagaatgacatggagtttaaataaaacaaaaatatatgggtaaactaaaggaaccagggcttcttagaggtatggctgactctaggtctgggcaggaaatgcataaaatgaacatggattatcttactgcaaaagaaagcaaggaacagaagcaatggggttaagagaaaggattcaggaaccaacttaaagaggctctcactgcccaaggacaggactatttcagcattacatatatacatattgatatatatatatatatgattccaaaggtgaatcatattatacgtcaaagcttgtaagtttatagtgatacttggggaaagaaaaccttaaaaatcttgttgaccacctttggagaatgctagaaaaccaactctttctgaaaactcataaagaaagggaaaaaaaaatcaagcattttcatcatgcagagttaatgaggaaaaagtttatttttgtagaaaaagtataactaatacatgaagaaagagtgacagaattagatatcaccattttgcacctccctaatgaaatcatggctctcacggtgccactcagtggctgctaaaaccattagatgaaaaactgataaccagagatcaggcagacatcacttgaacccactgacgcttagcatcacaaaaagataaccaggtactatgtaccacttgagtgataccacagtaagtatactcttgcaaaaaaaaaaaaaaaagttaaagaaaaattccaaatacaatcaggcttttagatctaactaaaaggatccagttacctatgtaacaaacctgcacatcctgcatatggaccccagaactgaaaaaaaaaaaaagaaaaagaaagaaaagaaaagaaagagagaaagaaagaacaccacaaggacgcaatcaggaaaatgtagaaagatacaggacagttaacccagtttcttcaacaaagaatttgcatgggaaatataaaagatataaagagaacctatgggtatatcaaccaaatacaatacaatgcatgaatattatctgggctatatttttttttaaaaaaaacataaaaatgagatagaaatctgaattttttttataattctaaagaattgattaaacttcttagatgtgatgatggcacagcacttttctttaaagttagagatacgtactgaagaatttacaattaaaatatgatgtctggaatttgttctgaataaataaactaagaggaaaggggtagggaaaactggaggtatacagattaaaaaaaaagattagccgtatgttgataactgttgaagggggaaatggctacatggcagtttttatgctattctctctccttttgaagatttcagtaatatgctttttaaaaaagaatagctgggaaatgctttattctacagatgagggtaagacagtccattcctaaatacaagaaattccacaggtatagggtaacttcttaataattcatatttcatatttaattacactgcataattagcaattctcccttactattttagaatggataatacaaaacaggtcagcaaatgtttcctgtaaagtatcagacaaaaatattaggttttatgggctataaggtctctatcacaactactccactgtgccattatactgtaaaagcagccatagacaacatgtcaacaaatgagcatggtggtgtttcaataaaactttatttatggatactgaaacttgaattgcaaataattttcccatttcacaaaatattctttttagattttttttagccatttaaaaatataaaaaccattcttaactcatgggacatacaaaaatagacagtgggccagaactggccaagagcagtagtttgtaactcctgatataaatagttaacagtttataattttataagcaactcaactgcaggtaaagctcctatttcagtgaatagtttacattaaaaaaaaaaaagccactgaaacataccttagaactagaagcatttaacatggttgctgaaattcctaattgttttaaaaccattaattggtcttccataagagagatcaatgggcaaatgacgagtgtaaaacctaaaagagaaaaaaaaaaaaatctaccttaaactttacaccaccctcagaatcagatgcaaaccattcacgttttttttttttttttttttttttttttttagagatggagtctcactctcttgcccaggctagagtgcagtggtgcgatgttggctcattgcaacctctgcctcccgggttcaagcaattctcctgcctcagcctcccgagtagctgggactacaggcacctgctgccatgcctggctaatttcttttgtattttagtagggacagggtttcactgtgttgcccaggctggtctcaaactcctgagctcaggcaatctgcccaccttggcctcccaaagtgctaggattacaggcatgagctaccacgcccggcccattcaccttcttaacttgtgggcactggccatcaattcagattaatttttaatgcagctttagtaaagcttacttcttactctcattaattagatatgaataaatgaccaaacaaggtaagtagaagccaaataaacatacaactaaacagaactctatccttataaaaataaagacagatttttatcatttcaaatgtttaatttgctatcgttttaaataatcactattggtaatttcagtaagacaacatatatcagttcaaacactaaacagtttcatcagggaaaaatcactataaagctttccaaaaaaaccagatttttaattatacagtagtgtgtataattaaacatgatagttgcataagcattcttttactttttgtacgagattcatttatgctgagtagaaatcagtgaacagtttactgtctgaatgaagttatagtaatatgcccccttccttataattgaaactgtttaaagtacaaaagctattctacagttaaaattatatatggctttacgtttctgtagtttgtttcttaaaacaacctttggcaaagagcagacatgtttaaaaaacataatcaaattaagaccttattagggatttttcccagtcaattattctctctcctattattttcacttttccttactagcacctactcattacatttaaacatggtcaagtccctctcatcttggaaaacacccactatggtctgaaagttggtatccccacagaagtgattaagtaatgagggctctgctttcataagtgggattaatgccattttacaaaaagttgaagggagtgccctttctttgccgccatgtgagggtgtagcaagaaggtgccatctatgagaaacaccccctctctagacaccgaaatctattagcatcttgatcttggacttcccagcctccagaactgcaagcagtaaacttctgttgtttgttaattaactgatataaagtattctgttacagcagctggaatagactaagataacatctcatttatggcccactctcttcttcccttcatagtcattcttttccaaagagaatcccatactcaccagttccacttcctcaattcctacctgcttcaaaccattgctatttggtctccacccaaccatttcaataaaattgctctagctaaggtcatagatgagtcctttgtcattaaactcattgaaacttacatccttacgtatttgacattttgctaacagacatcactattaactactccctcattcaaacacacccttccctagccttctaataacatcatacaatcctggttatcctatatgttgctactctttctcagccttgtctgcaagccctttttctctgtttatccctaaactcttggtgttctggtttctgttctaggccttcttttcttcttatgctgctctgaaattcattccaatggcttcagtggccatctccacactaacaacccccaactcagacctctaacaccaggctttagacacaaacatcctcctactcataggacaattccacctggatgtcttaaaggcatcgtaaattcaacatgtcccaaataaattcatcatctttcccctctccattcccaagagttctttcgccaatgtaccccatttcagtgaagaacctcaccacttgtccaagcctaaaatttgagtatcattcttgactcttctttctcctttccccccaagcaataaataccaagtcccattgaatctatcttccagatgtatctggaattcatctaactgctagaattatccttctaaaccatgaaataatgagtctcttacctgtgtaaaactcttcaatggcttcttgctaaaataaggaaaagttttaaaaataagactctttccacatgtcttaccactgactgccacatagaaattcctccaggttactgaatacatcataatgtgaatgttctctcttgcttttggatctcaagtattgcttttctgaatgaacactcttccttccctgtcccttctgcctactcaccctttaaactttagcttaaatgccacttcctcagaacagctttccctgacagcccctagaccagatctttgtacagacttaattccctattaaaacctttatcccaaaattcttattgcaattgcttgcaattacctgtattctctaaaccagggatcaacaaagtaagggctggttgcctatttttgtaagttattttaatggaacacagctacacccatgtgtttacacattatctgtggctgcttttgtgctacaatggcagggttgaagagctgccaaggagaccatatggaccacaagcctatattatttactatctaccctttcaagaaaaagcttgctgatcccttgctactacccaatcagtaatatcagtagcactagcgaacttgttagaaatgcaggatctttggtctcacataaaatcagaatctgcacataatcaaattctcaggtgattcttatgtacactaaagtctgagaaagtgctactctacactatgagttctgtgaaaactaagaccacgcccattttgctcactactgtgtctcccagtgcctagcaccatggcagacactcagtaaagatctgggactagaattcaggtctactgattcttcttccagagctgcttctcctacaacatttttgggtttttttgccccttgtatcttctgttcaagtgttctatagcactgtagggtgaatatggttaacaataatttagatagggtttcgaaaagctagaagagaggattttgaatgttcagtacaatatgtttttaaatttatgtttcaggaaccagataaaaggattaatctcagaagtttttaaaactcctcctttagggagagaggagggcaagggctgaaaaactacctagcaggtactatgtttactacttggacgatggatcattagaagtccaaatctcagcatcacacaatatacccatgtaacaaacctgcacatatacccctgaatctaaaataaaaaataaataaaattcctcctttaagtgaaactttaaatttctattaatatagaagaaatcaaacaaaaatgcacttgatttttatatatgtatgattataaattattttttaaaagaattaaaaaggtatgatgacaaagcacttcttcaactcaaaattaatttttttagtacataccatctgaacataatgctggtaactggtaacataagctctttccacctcctgtaggcataacaagaaatacctcctttccagccattgttacgttaatagtttcaagctgaagtggtctgaacttttccagtttaaagacattttgcagaatatctttaactttaccagaccatggaaaatctaggaaaagaaagttaagaatcagacaaacatgtaagactattatagaagtttgataagaatgagacaaacatatataagacttctaatacttatagaccattaaacttttatgataatagttttgagattaactcactagctaagcaaagcaaaaacaagttaaatgatgtattataagacatagtaggcatggtggctcatgcctataatctcaacagttttgggaggcctaagcaggaggattacttgagctcaggagttcgagaccagcctgagctcaagcgatggcaagactctatccctataaaaaaattttttttaaagtagccaggtgtggttctgtgcacctgtagtcccagctactaaggaggctgaggagggaggattgcttgaggctgggagtttgaggctgcagtgagttgtggttgtgccactgcactccagcctgggcaacaaagcaagaccctatctcaaaaacaaaaaaaaagtaacaaatgtaaacatttgccagttgagaattaacccacacaagaaaggaaggtgtttgatcaggtatttaaaaaattgtctgaatgttgatcagggaattcacagcatcataaagtactcaaatatcatgaacaaagttaacaattatctggaatttttggtgtaaatatcttgttcagacgtgaatcattgaaaagcaacatccacaaaaagcacaatcccttctagagttattctaattattctattattctatttataattgataaacttgatgtttgataaggtcttgaatcatgaaaggtttgttcactagggcaggaaaatgatctaacctttggcaaggagtttgaattttttttcttaactgtttgttaatgtaggtaaaggaagtatctcattttctaaacatgatcaatgttgctgtaacaataactggaaaaaaatgtctgaataataaaagtttaatttgaagactacagaacacagggaaagaatgatccacctgcaagtttcccattccactggagaaatggccagtttcacctctaagcctactggaaagcactgtcccatcaagaattcattctagttttttaaaatatgagaagaaataaaactagcaaaaaaaaaaaaaaaaaagttaaccttctttattccaagcggcaggtgaagaatcatattcattgcttgccccggcatcagaatcctctaaacactgctttattttctttgtcaggactttttttttctgaataagctcttgttgcctttccgtaagttcttgaatttgaatttctactgcatgtagctcactggttatagaatccagttcctcagttagagctatgggaggcagcgcggatacaatgattagacagagtaaattacaactttaggtttccagattgatttctgggtgttgcccgccatatcaattacagacaaacttgaagtagtatagcagaatggttatgagcatgtttttgagtcatatagacctaagttaaatctcaggtcctccttttacctgctgagtgacctcagacaagatactcacctgcatccccatttcccttcctgtaaaatggggacaatatctaactttcatagtatttttatgaagagctagtgagataatatattaggagttctagacgcagtacctggtacacaaatatttaatacatgataattatttttattatgttgtagagaagtggtctaacaatctcctaaatcatttaagtaaagtatcagactttgaagcaaaaggaagctaattccctaattactttgctattactttatgaaggtattcctatttgggctcacttggtggtaaaaggagttggtaattataaacaagaggatgtaacaagtaagagaaatcaagtgtactattggaattggcattttatctcctttgtaactaatctataaagaaaccccagtgtatgattctaatcaatctaagtattaaagtcaaaaagtgagatgctttttgataccacatcgatggaagctagaaaaatcttaaagatgttcttggtgcattctcatatacctgcctgcattaatcagtatacaggtttaatgtgcttcttcatgagatataatttatggctgtgatttaaaataggatgttggggtacctttttattgtaccaactgccatcatcccttgtatcaacccttccctacatgactttgggttaggtttggccacaagtgaactctgcatgagatttacaaggcagaaataaagcagcagccagttttacattgggatggttggcctatggccaggtgcttctggagctcactcatgatattaggaaactgctgcctcactttgtggacgtggggcagaagccagttcccccagctcctgctaaatcttggtggaacaacttggcccacagattctttggcttcttggtcatgttgctggccaaccttctgtgacaagtgcaccagcttttcagcagggcaccagcatcctaactttgtcctcatgaatttcaacttatccttgcagcttccagctcatccataccctcccatacttcacacccatcttcctttctcactgctggtactgctgacttcaggaccagaagctgactcagggatagctgcttaaccagctcccatgatcacataagttttaatccccataataaaacttacagcactcataatggttcagcttacctgactgaaccctaaccaatacagaattttgatccggaagaacagaaacttaacaggttctctgaattgtttctgggccacatagaactggctttctgatctgattagatttcaaggcattaataaccctgtttccactgataaagggaacataactattctatgtcatcatgcagtgaaaaaagttatttaaatcatcatccatagacaccagtagaaaaataactagagaaggcaaggctgtgggtgacaaagtgtttgctgttacaaatgttttggtgagaataatggggttgactggttgcttctaagtgtgcaaagaactcaggggaaaaatgtaggatctgcattaagggacctcaaagtttctatgattgtccttaaaaaaaaaccttatcctctataggtacagggccaatattttggaaaaatagctgtaagtctaaatcctgcagatggctgaatttcaatacaaactgaattcccaaccttgcagggacttttatgataaagtcagcacactgactgggaaggagactgaaatttggaggggaacataagggcagattccaacgaagcaggttaccttaaaccactaaattatgccaagtctcttctaccctgcctcccctttctgaaacaatgtcctcctaactgaagtccccacaatggtccttgttgccttgtatgggactgctaagcctcctaagaatcagcctctaccatctttcagtgctttaagatccagaagtcctagaggataaaacacaaagatgtaacctgtcaaaagacatgatatgcaccaaaagagctgcatgtgccaaaatatatcaatagaaactgtgttcatccattttgcattgatataaaggcgtatccgaggctgggtaatttataaaagaaaagaagtttattttgcttatggttctgtaggctatacaaggagcatagcgctggcatctgcttcttgtgaggaccccaggaagcttccaatcatgacagaaggcaaaggggggcaggtgtgtcacacagtgggagatagagtaagaaagagaagaggcagtgccaggctccttgaaacaaccagctctcatgtgaactaacagagcaagaactcagtcattaccatagggagggcaccaaaccattcatgagggatcctgctccatgacccaaacacctcccactaggcccacctccaacactggaggtcacatttcaacatgagattaggaggagacacatatccaaactacatcagaaacctagagaatgtatatgggaatagatcataaaggtactgaaacagggtttatggaatacaatgtcgaattaagctaagtttattgatacgggctcactaagaaattctggatttaatgtcctagatagtggccaggagtggctctagtaatttgcttggctcattgcctgaaacctggcctcaaagatgaatgtcagaaaattgggatggaataaaacaggtatagagtccagtgaggctggagctctggaatttcctgggtatgctctaaaggaaggtattcagaggcttagagagagagcagtgccagagtggaagatcaaatagattgataatccactcccttgctgtcccccaggagaatccagaggacacttctttcaccaagactgtgaaaaatacagtcatgagcagagcgccagcatcagcggagctcttcagggatgctggggctcccctggctgttctctgtaagctaggaatgacagtgggaaatatcatcttccaagtagaccacctgattcaacgacaatgatggattccaaggtatgggggctaaccattggcaattgaatttatgacgaaaaataaagtagatgtggttgccatgaagggcaacagagctgaggcagcaatcagaatggtctgaccgacaagatcttggattgactagttgactgtgaagtccctgaaacggaaatagattacttgatttgtaacacgcagaatagaaagctctgattctggtaaacagaaccagaaacacaacagagagaccatccttcgacgaatttccagaattgaaccaccttatagaaccagaggcccttgaataaggcagaggttggagcctgttggggaaggactcaaccacacagctaaaaatgtatgtaatgaatcttcctactactcttcaccaggaagtttattagggtaactgtgcattagaaaaaaagagaaatcggccaggcacggtggctcacgcctgtaatcccagcactttgggaggccgaggcgggtggatcacgagatcaggagatcgagaccatcctggctaacatggtgaaaccccgtctctactaaaaatacaaaaaattagccaggcgtggtggcgggcgcctgtagtcctagctacttgggaggctgaggcaggagaatggtgtgaacccgggagcggagcttggagtgagctgagatcacaccactgtactccagcctgggtgacagagtgagactccgtccaaaaaaaaaagaaagaaaaagagaaatcacttctcagaaactactggacattagctctgaactgatgctaattcttagaaaaccaaaatgccatggtgatccaccagtcagagtatagactcgacttaagtgaggtgatcaatgcagctttggtttccagagatttaaaaggtagaaatgaagcagtagacatattttctgtatttaagaaagtcagtgtaagggcagggttggtgatctcattggcatggggcagcagcaggttcaagtccagcggctgctagtgatatacagtgggccttctaatctgctgtgtggttatttcctcagtttcagaatgtatactgagaacagatatattcagcaagtggcagaatccacccattggtctcctggcaaagtaactaaggattattattataggaaagatcaaacggaagccagcaaaactgcctttaccaaccaatacagcaaactaaaaatattactgcattcctggagggattgcagagattactgcctacatcaacggcatgaaagatatgagggtaatgatgacttccatgtcgcattcaactcacctatgtggtgtatgcagaagacaatggattctggagattgagaatggattatgccaaaattaataaggctgtggctccaacagcagccatggttccagctgtaatttcattaataagacagaacacatgccctggcatctggcttcagctattgatctgctgaatgttttattctccatacccatgtacctgttattatagcataggggaatagtatagcacagtaaaagcagtttgctgagccagcaatgtatctttattctcccacctcagagctatatctactctctagccctaatctaggctgcagggatcctgattcccttttcattccaccagacattacactagctctctgcattgatgatatcatgcttgtctgacctgctgagcaagaagcagcagtagcagctactatagacaaactgctaagagagacacttgccagaggatagaagataaatcccataaaaattcagaggcctgacaccttggtgagagtcaaagggtatggggcatgttgagatacctcttctaaagtgaaggataagtttctatatctggcccctcctattactaagagagcagcacagagcctaatggactacttggatttgggaggcaacatacacctaatttaccaagtaaccccaaaacttgccggttttgagtaggacctcgaacaagaggtaacgccatgatacaatcttctcttaccattgagccatatgacccaacagatttgatggtgctgtaagtttgtgatgaatgcagatgttatatgacacctttggcctatagatgagtcacaacaaagatgataaggattttagagcaaagctctttgccattatctacagagaactattaccctttcagaaacaacttctgggttgctcctgggtcttacaagagactaagttactatgtgacctgtgctgcctatcatcaaccaggtgtcatccgacccatcaattcatcaggcaggcctccatcatcacaatggaagtggtatgtgccaaagtgagcaggttctaagtgaaggcgtgaacaagaagtctgaatgctcatgcaccatgctcccctttgcctcctcctcctcaacctgtagctataacctcatggtgggattcagtgttactaagggaaaaaaaaatgcagacctaatttacaaaagattctgcatgatatattgtcactacctgaaagtgaacaactaaagcactctagcatctctccagagtgatcctgaaaaacattggagatggaaaattctcccagtcagcagtaagcagtccacatagttattcattttgccagaggaatacatccacactattataagcaatggttaatgattggcaggatggttagcaacttggaaggtagcaaataggaaaactggtggcaatgaggtctgaggaagagatatatgtatagacctctctgaatggtcagagtgtgaaggtatttgtgtccaatgtgaatgctcattaaaaacaacttcgacaaagtataatcataattaatcaggtagacaagatgacctggacattgaccacacttgtccttgcacaacgaagtcaagaacaaagtgccttctgcaacatggactgccactcacgaagacccatctggctacatccagagctaagtgctcaacctgcaaacagctcataccaaccttgagttccaatggaggcaccattctctgtggggacagacagatgcttgatggcaaagtgaccgcattggaaccgtctataatgaaagaggcagcactttgttctcactgatacagatgcttactccggatatgaatttaccatacctgcctgcagtgctctatcatgtccaccatccaggaattcacggaattcctactgattgtcatcgtattccccaccaaattacttctgaccaaagaactcatttacagcaaacaaagcacaacagaaggctaatgttcaagatattaactggtctaactatgttcaccaacaacctgcagcagctagcctgagaaaataatggagtggcattttgcagactcaattatgctgccagctgggtatcagcactttaagggctggactagtagcctccaggatatggcatgctatacatcagtgaatagtgctgtttctcccattgccacgattcacgggaatcagcggtggaaatgggagtggctcttctattacccttagtgatccgctagtgaaatttttgcttcccatccttgaaacatcggactcttgctggcctagaggtcttggttaccaagaaagaaatgcttgtaccaggggaaaaagcaatagttccattaaactggaagttgactgccacttggccactttgggttcctcatgccaacaaatgaacaggcaaagaaggcgattactatacttgctggggtaagtgatcctgactattaaggggaaatcagatagctactacactatagggataaggaagagtatgtctggaaagcagaagatcctctagtgcacctctcagtattcccttaccttgtgattaaagttaattgaaaactataataaccaaatataggaaactactaaggcaagtagtccccaccaagcaaagacccattaccaactgagaaccaaggaatacagaatgggtagttgaagaaggcagttataaagtacaaactatgatcacatgaccaattgaaaaacaagaactgtaatagctataagtctttcttgctttttaaaatttgtatataaaccaagtttgggtttttccttttatttggtccctctccgatacattacagtattaccaaggaggacatgattcagcaagaagagaaatgagcatcacccaaagacgaataaagataatttgtacctgctcttttggggaaggggtcagtgtatactcagcagtaagagaaataggcaaaagcatgattccgctattgcctttatttggacacaaataaggtaaaaattagacacaaaaggacaaatgttatatgattccatttatatgaggtacctaaaatagtcaagaaacagaaagtagaatagtggctatcagggattaggagaagagaagtaatggaaagttacggattaatgagtatagaattttagtctggatagatgaaaaagctctggagatggatagtggtgacgactgcacaacagtctaaatgcatttaatgccaatgaattattcacttaataatggttagcatggcaaagtttgtaatgtgtattttacttcaataaaaaagctgaaaaaaatcatttctataatcagaatttttaaaacaaactttttcaaatatcatacaaacagaaatagaacagaaggaagaagaaaatgtaatcattgctactaacctgaaacggacgccattctttttctttccaaatttgtttctaaaataatccaaatttctttctaaaaataaaagcacaacagtgacaacaagtttttaaaaatagtactattaatgatgttcactcaacagtaatctgtcattcctaagcacggaaaatgttagaaagtaaattatatattgcagtgacctttcaaataagaaccacatggttcttttgacactaattttttatggaaaactctatatttcagcttaataacccacaacactcagaacgactaactctctagatttcagagaagtgtccaaagtcacataaacgtatacatgacaaatacagtagcaatgacactcagcaaacatccacaagatacaaagtgatgtaacaaaaaacagcaaacattcaacaggtctagcaccaattgctatgtgactaaattactatgttaggcaaagttgcatatgctgttcctccaagcctctttccctacctgtaaaactgggaggatggcaatcttataaataagttggatagattcaaatgtaccagattaagcaaaatacatcaacataaataataaaattaatcatctaacattttattgagcccttgcgttaaagaattacaatataagcccaatcttaaaagagaaactggtattctacagaaaagctagattttctaagttagaggtggggggaggggaaaatggtttgtaatgatttctaagtatctatgaatgactaaaacctaagcatgcatatggacaagtggaaaatggggctggagagtagaaactttaaattccccataatcctaaaaacacctcttctatctctctaatatggacattttctaaaactaagatgctctccaaaagtcacttctgcaacacctatccttagactgctgaccttacgccctttctacacagaattctgaagccaccactaggccggaaagataggctgactcttttttgccttgctaaagaatgtggaataaccacaccattaaaagaaggctaaataggagagtaaaccaaggatttctaattcttgatctatacaaacatctcttcacgtaatgaaaatgtaacattccttccatagactgtaaggtcctttagcagggctggggttcaatctcttcacctttgtatccgcacagcccaggaaaatgccttgatgtagtgagggctcaggtttgctaaggtagcaggggctgtttctacccttatgaaaagacacagtctatatccaattctcccccacgattttaaatgactcctttgattatgcggttaaaagactgctccttcccaaaatgatgtgatttaacagcaaaagatatctcaacataaaatgtatccagaaattgaactacagcaggtctgtcactcagcagtataagctaggcatccacaggaagaatgttacagggtgacagccagtcatcaatgttggaggaaacgccactgagataccataggctaaatcctctctctccccgccacctgcatttagaggcaatagtaatttaatattaataacgcccgcccttccgctactgtgaagcagggggtggaagaagcatccccagtagtatttaccaacaaatggcagctgctaataaacaggctttggtggccaatcctcctgcatggaaaagaatggggagatcagaagaccggtcagcaggcgaacgtgcccctaaaggcccgagttctcagagcagggcagtgattaactttccggtttctcctccgccaatgtgtgggcgaaaggaagtgatccgctacagaccggcctcgccctgcagcaggaaagggaaggatgaaacaaaaagcgcacacccttgacccttcaaagctgtaacagtagttatcccagagcctctccccaccgagaagcccggtctaactctccggtgtttgactgtccggtgtccgactgtcctgtgtccgactctccgatctccgactctcggatctccgacaccaaagcacccaggcctcgagcagatctttccgctactcgggagtaaaatcttcccgccagccagctgagagcatccacccttccgggtcggtccgttcagccaatcacagat

SEQ ID NO: 1627 - DNA, 32761 bp, Homo sapiens; identical to SEQ ID NO: 1626

SEQ ID NO: 1628 - DNA, 1759 bp, Homo sapiens
tgttaagttggggaattttattcttttttttcctttgaagggtaaaaattttatttttgaggaacttcttactgcacattttccaagagagtcacataagaaagcaaaaatgttatcctcccctcatcctagaaataaataaggacataattttttttttaatcatgacacttggaggcttagcgccagcatccaaaatgaacaaaaacggaaaaaaaagcatttattttatatttcagatttctttggttggggttctccccatgcggtattaatattacttgtttcaatatctattacccaaacagtaaaaaccaggaaaaaaatataaacctagcgcttgctgaaactggggaggctgctctcttgtcttctgtgcaggaattcccaggttctcagtttgctggaaaaatttgttgacattttctttttgtagttgtttcttaaagaataacagcaaacattccaatgtccaaatcttggttcgtcttccactttattgcttggatgtttctttggtgttggtaaggctgtggcctgctttttgctttgtttctgaacggtcattaattctttaggtcaccctgccgatggtgaaggtgcctggggagcctggtgttactcagcactgctctgctcggtggatggagcagggttctcagttggtgcttcacctgccgtggcctctttgccatcttgtgaaggagcgttaggagaacgtgggcgacgccggtaattgtagggacgccggtatccacggcgaacaggcggctggtttggaccactggaggcttgctgattttctttatcttcagcctctccaactgctggggcaggtcgtgggcgaggaggtcccctgctatggtaccttgggcggtaagttggatttcgatgaaatggtccctgaagttgtgctccttctgggactccatccttcagctctccaatctcaacagcctgtattctgttgggatggggtaagaccggtgagcgacggtcaaacgtctgtcccacgtggtaaggcgggaaccgctgctgcctgtactgggggcgatactgggggcggcgcagccgattccgggccccagagaactgcctatcagtggtaggggggtcaaatccttcactgctgccgctcccttcttcctcctcctcccagcgtaatcccggggagggccatggcgccttccatagtagccacgtctgtaacggcgccaatcagcgcgtaacgactgccctccacaggaactccaccccggccagtcacactggctgcttctgcacccttctctccttaaaccacatcaaactctacagtttctccatctcctacactgcgcagatatttctgtgggttattcttcttgatggcagtctgatgtataaatagatcttctttggtgtcatttcgatttataaatccatatccatttctgacgttgaaccatttgacagtgccaaggactttggtggcgagaacttttttctccgcgtcttcgctgtcggcggcggtggctaaagaggcggcggccgcggtgcccgtggctgcgggggccccgtccccacccgggtttcctgcgacgagggcggcgggcgccggggccgcggcttggggtgcaccgctgcccacccggctcttggtcgcggggtcctggggagccgcggcggccgccaccgcaggagcctgctggagggtggtggtgatgatggtggcctcgcccgcctcgctcatgcctcctcctcctctgctctcgctcat

SEQ ID NO: 1629 - DNA, 2909 bp, Homo sapiens
tacatgaatgttcatagcaactttatttgtaatagcccaaaagtagaaagaacacaaatgttgttcaacaggtgaatagttaaactatggcacatctctaccatggaatactacacagaaattaaacatattgcattactgatatacacaacagtttggatgcatctcaagggaattgtgctgagtgacaaaagccaatctctatgtgttatatactgtatgatgacatttatataacaattctgaaataataaaattataaggatgaagaacagattagtgtttactagcttttatgggtgaaaaaggatgacagggagatgtttataaaggaatagcacaagggatcttagtggtgacggaacagttccatatcttgatcattgtagtggttacccaaatatacacatgtggtaaaattgcatagacctacacacataaacgtgcacgcacacacacacacacatacaaattagtgtatgtaaaactagagaagtctgagtaatgtctgtggattatacagatgccaatttcttggtttatatatgatactgcagttatgtaagttgataccactagaggaactagataaagggcatatagcacttccctatactctttgcatcttcctttgaatctataaatatttcaaaataaaagttttaaaagatcagttggaatatacacatgcttattcctatagtagtgttactatattcagttattaatatattctcatagctttcttcatatgaagataaggtatagggaagagtcatatctagtatttgggaaactgaaagaaaccccagtggacccacttgagtgtacatcatggcaggaaaaaaaaattgtttcagatgtattattttctggtaccatagataaagaataaggataatgcaatgggaacagttgaaatattggcttgtttacttgcatttgtatgtttgtttttaaatttttaccctgtgcattagttcattctcatgcttccataaagaaatacccaagactaggtaatttataaaggaaagagttttaactgactcacagttccgcatggcttcggaggcctcaggagacttacaatcatggtggaaggcccctcttcacagggtggcaggagagagaatgagtgccagcaggggaaatgccagatgcttataaaaccattggatctgttataaatcactatcatgagaatagcatgagggaaaccacccccatgattcagtcctccacctggtcccacccctgacacatggggattattacaattcaaggagagatttgggtgggaacacaaaaccaaaccatatcattctgaccctagttcctcccaaatctcatgttctcacatttcaaaacacaatcatgcccttccaatagtcccccaaagtattaactcattcaaacattaacccagaagtccaagtccaaagtctcatctgagacaaagcaagtcccttccacctataagcctgtaaaatctaaagcaagttagttatttccaagatacaatgggggtacaggaattgagtaaaaatacccattccaaatgggagaagttggccaaaacaaaggggctataggcccatgcaagtccaaaatccaatagggcagtcgttaaagcttaaagttccaaaatgatctccttaggctccatgtctcacatctatccaggtcacaatgatgcaaggggtgggctcccacagccttgggcagctcttcccctgtggctttgcaggatgcagccaccctcacagctcttttcatgggctggtgttgagtgccagtggcttttccaggtgcatggtgcaagctattggtggatctaccattctggggtctggaggactatggccctcttctcagagctccactatacagtgccccagtgaagactctgtgggggagctccaaccccacatttcccttctgcactgccctagcagaggttctccctgagagctctacccctgcagcagacttctgtctggacatccaggcatttccatacatcctctgaaatctaggcagaggttcccaaacctcaattcttgacttctgtgctcctgcaagcccaacaccatgtgtaagctgccaaagcttggggattgcactctctgaaacaatggcctgagctgtatgttggccccttttagccacagctgaagctgaagcagctggggacgcagggtaccatgtttcaaggctgcaaagagcaagggggggtgcctgaggcctggcccactaaaccatttttttccttcaaggcctcctggcctataatgggagaggctgcagtgaaggtctctgacatgccctagagacattctccccattgttttggtgattaatatttgtagtgataggaatattctatatcttgaaaggagtttctgttacatggtgcacgcatttgtcaatacacatgaattgatatacctaacaggtttgtatatgatacagtatataattttagctccatttctcccccaagaaatatagaaatattaaactctacttcctgatatgcatgataaagggtttaaagatgaagtgcattgatgtctgtaacttattttgaaatgcaaaaaaataattattttatagataagagcattaattgatggatatattttcataatgaaatgttgggggaaatacttggaagtgaatataatcaactaacttgcaaccgtaagttggagattgtatcaaatttgttagaggtgtggaccaagccaaattaaattgtaactataagttttttaaaatttgtgttgagctaaattgtaaggtaaactgaaagaagctgtgtaaaagaaccaaggatcatcatggtaaagagaatgaacatgaggtgtgtgtgtctgtgcatgcacacatgtgtgtgagagaaa

SEQ ID NO: 1630 - DNA, 35869 bp, Homo sapiens
atctggtttgaaaaggttctcaagatcacttttaaatgggtgtgatgtgtattttttttaagtagcaggttcattttaaaacaaaaaaggttagtgaagactctgtctttcaaaacataaaaatctgcgataaaaccaattattccatacagtgactacggtcagttctgagaaatgacacccaggttggcgatgtgtctcatggttggccttccatggggacagttccaggggtggtccatctcccccatgtgggtgatcagtttcttcatctcgcttgtgttaagagcagtcccaatcatcacctgagtgtgagacacaatggttcaacgttttagtagttttttgacgtcagaatggcagctcttcagaagcattcttctctaaaataaggctggacaagattacagctcaaaaactaccttccctgaaaaaccttcccccagagaagcctaggttctagatctcagccctccacccttctgtgaaatcaggctccttgtggctccttcaaggtggcaccgcctccactccagacgccgaccacacctgtctcagcagccaccctgccctctcaccctggcaggtgcagcagcctcccagcaggcctccctgccccactgcgacccctccgagccgctctccactcagcagccagtgattacttttaaagggctgtcaggttattcattccacttcacagctctccccctcacctgaataaaagcccccgtctgtcccctgacttggccctcgctgggctgtgcctgcacccccacctccaagcacgaatgcctcccttcctcaccccagctgcactgctactcccttcctcttgcacaggcccatcacgcaaacacctgccttgggactgtggcactcccgggaccctctcccccaatgggtgcaggcgtcactccccctctgtcgagctccgacctgctgcccatagcactccagccctggccctgctgcctccctgccatgggtcctctgacaggaaggagaggacacaagcctgaagcccaatgtcaccttctttcttcctgcagcaccctgagggctcgccatgtgccaagcacagtcagaaggctggggtgacagcaggttggagaaggacagacaatcaacaagtcaacagagaaccaagacaggtggcaccaggcgaggcggcctgctcaggtgtggggatggggtgaagggtgacggtggcaaacccaggtagagaggagagtagggagaaagggtgtaaggcagggaggagactgaggcgagcgtggaactggaaggcagctacatggctggaagctacatggtggggagatggggctggaagggtgggcagggctcaaagcaggagcctcctgggcaggcagtgacaacaccggagatggacgggtaggccagggcgagagggaaggagcagcctgtggttccccgggccactgagtcacactaaactcaggacatcaaaactgcccggctatgagctcagctccacgctctcactcacagactccaagactggaagatccatattatgtcttttattttggtgaggtcaggggtggtggagagactctgtctcccaggctggaatgcaatggtgcgatctcagctcactgcaactccgcctcccagattcaagcaattctcccgcttcagcctcccgagtagctgggattacaggcgcccaccaccatgcccagctaattttcgtacttttagtagggatggggtttcaccatgttggccaagctggtctcaaattcctgacctcaggtgatcaacccacctccgccttccaaagtgctgggattacaggtgtgagccaccacgcccagcccctattaggtctttatccaagaaacactgtggctagaagtcagactctgggccctcttctaattaaactctgcccttgagtcatttcatctaatctcatggctgtaaattacacctgaagctcacacagcaggctccatcccacccactccccacgtggcccccagctgctgctctcctcagcggccgcagccaccgcaccccttccagtctgttctctctccagcagctgcaatcacgggactccttcccgtctgttctctccagtggctcgtgccacacacagcacagacccccagggtctaggtatgaccggcaacactctacgtggctgtcctctggacgccgctctgctcactcccttcccctctccagggacacaatcagcctctggcttcagtcttgctacttccttcgcttggaaagttcttacccaagagggctccattctaccttttttttttttttttttgagacaaggtcttactctgtcacccaggctggagtgcagttgcgtgatgttggctcattgtaacctcgacctccctggctcaagtgatcctcccacctcagcctcctgagtagctgtgactacaggcacatgccaccacacctggctaatcttttaattttttgtacacatggggtctgcctgtgttgcccaggctggtctcttaactcctggcctcaagcaatcctcctgccttggcctcccaaaatgctgggattacacgtgtgagccaccatgcctggcttccatcccaccttttagatggcagctgagatgccacctgcccagatgccattccctgaccaccatctcacctggtcaccatgtttttctcttgtcatttcctgccccaaaacgctgttttaggccaggtgcggtggctcacgcctgtaatcccagcactttgggagaccaaggcgggcagatcatgaggtcaggagatcaacaccagcctgaccaacatggtgaaaccccatctctattaaaaatataaaaattagccaggtgtggtgggtgcctgtagtcccagctacttgggaggctgaggcaggagaatcgcttgaacctgggaggcggaggttgcagtgagctgagatcacatcactgcactccagcctagtaacagagcgagactccgtctcaaaaacagacaaagaaaaatgctgtttgaatctcttgactgtgcttactggcatctaatgcgtgtcatttatttgtggtgatgcctatttctccccactgtctgctccacaggggcaggggctgcagccgccttgttacctctgtgtcccgagcacctggagcagggcgggccccacatcaggggctcaaggagcacctgctgaataaataaaggaatggcgtcctggcccttcccagtggccagctgatacacagtcacttttcttggacatcaggctaatccccactgcaggcagaaccactgctgccaccttcccacaccaaccgaagcagcggcagtgacgccacgtgcaatgacaaccacggcaccccgtgaagcacctgctgcctcgatgactctgcagaatcgtgtccaatgtcgccgagtcctggcagcagcaaatctttatctcccaatgttgttatgacccataaggtccatagacgaacaaggtacctcaaacgctaactgcgttggagtcaaccaaagctcggagatagaatactggccgggccaggcacagtggctcatgcctgtaattccagcactttgggaggctgagacaaggggcaaaaggagaccatgtttctacaaaaaatttaaaaattagctgggcatggtggtgcatgcctgtggtcacaactacttgggagacagagagaggaggatcgcttcagcctggtacgtcaaggctgcagtgagctgtgattgtgccactgcactccagcctgggggacagagggagaatctgtctaaaaaaaaaaaaaagaagaattctgggttttttttgtttttttgagacggagtctcgctctgtcgcccaggttggagtgcagtggtatgaacttggctcactgcaagttccgccttctgggttcacgccattctcctgcctcagcctcccgagtagctgggactataggcgcccgacaccacgcccggctaatttttttgtatttttagtagagacgggctttcaccatgttagccaggatggtctcgatctcctgaactcgtgatccgcccgcctcagcttcccaaagtgctgggattagaggcttgagccaccatgcccggccaagaatactgcttaacagaggtaacaaaagagcaataattatgagttcaaggtcacagagaacgcagacgacacagatgctcagctacgacgctgcacgtagctctctgtgtaaaatgacccctggcaatcacaaaggcgtttacaaccttgaccaaatcaggagctgggctgagaccttcctcgactgcaagcttgagcagctgagctgacagccaggctttctttacttaccgacttccggcaggctctggaggcaaacatctgcttgactcgggaaggccggcacatgaccccagggctgtcgctcagcatgaagatcagttcatcgacgtcctggggtccgaaggtccagtttttactagttggcaaggaaatcagtttagccctttcagtgactggagctaaaagaatacaattttgagaaaaatccatgacttgacaaacacgtttcacttgaaagctacttaggatgaacatctgaggccgggcgtggtggctcacgcctgtaatccctgcactttgggaggctgaggccagcggatcatgaggtcaggagatacagaccatcctggctaacatggtgaaaccccgtctctactaaaaaatagaaaaaattagctgggtgtggtggcaggcacctgtagtcccagctactcgggaggctgaggcaggagaatggtgtgaacctgggaggcggagcttgcagtgagccgagatcggcaccactgcgctccagcctgggcgacagagcaagactccatctcagaaaaaaaaaaagtgaacacctgaaagagaggaaactcacaaaatgctttttggaggaactttttaatcttttataaaattaaaaaaaactggtctatatgacctgaaagattattcccagctctaaaaagacaagaatctatagttctgatttttttttttttttgagacagagtttcactcttgttgcccaggctggagtgcagtgacgtgatctcggctcactgcaacctccacctcccgggttcaagcgattctcccacctcagcctcctgagtagctgggattacaggcacccgccaccacgcccggctactttttgtattttcagtagagatggggtttcaccatgttagccaggctggtctcaaactcctgacctcaggcgatctgcccgccttggcctcccagagtgctgggattacagacgtgagccaccacacccagccgctatagttctaattaataacttaccattttcatcgataacaaaatcaaagccattctttctaaatatttccagattttctatcagaacagcttcattaacagcagttaagttgagagtctgaggtctgaaaaacacaaaaatgattcaaaccatatcctgaagtcaaacatttagctttacagcagaaatgaaatgaaaacaacaatactgtattttgaattcatgtcaaaataacaacacaaataacaacactactcagctaagtgtcacaaaacttcctgagaagttccttttaattttctctttcttaaagttctttttagaagttaaagtagctacaggccaggtgcggtggctcacgcctgtaatctcagcactttaggagcccgaggcaggcagatctcttgaggccaggagtttgagaccggcctggtcaacacagcgaaacactctctctactaaaaatataaaaattaggccaggcatggtggcgcacgcctgtagtcccagctacttgggaggcttaggcatgagattcgtttgaacccaggagggaggcagaggttgtagtgagagccaagatcacgccactgtactccagcctgggcgacacaacaagactctgtctcaaaaaaaaaaaaaaaaaaaaaacacccataaaaacaaaaattagctggaagtggtggctcatgcctgtaatcccagctactcgggaggctgaggcactagaattgcttgaacccaggaggtggaggttgcagtgagccaagatcacaccactgcactccagcctgggcaacagggcaagactctgtctcaaaaaaaaaaaaaaagttcaagtagctacaaaagtagtttgctttttcctcagcctgccacgccaatgactcccactttttctgaatcctttccttaaggataacagtatcacaaaaatgctatttttcctccttctaatacagaatttgaaacactgggttaggtcattgccagcatttgtaaacagaatgaacagacagcttttattttgctatcctgttccttcctctgcctgtattatatctccatccctctctcctcctggatttactgtttgtttttttttaacctttcgttatttttttcaaagatagagacagggtctcactatgttgcccaggctgctctcaaactcctgggctcaagcgatccttccacttcagcctcccaaagtgctgggattacgagtgtgagccactgcatctggtcctgagtgctggataagacaaacactgctcaaggcaggagacagctggtgagcaaacacaggcttggtcctggagccaacagattaccggggaagaaagacgttgagcaaatactcaggcaagtcgattatgatgagaaacgacaggaaggtcaggaagaaaaagcagccagtgtcatagagagacttcaccctggggtcaggaagtgacctttgagctgagtccggggataagagagttaatcaggtaacgggggagaagtgggtgcagggtgcaggacaagtattctagacagggacaacaatctgtgccaagccccaggatggaccgctgatgtttgcagagccacacataaagatatccttcattctgcttagtggccacatagggattcatcaggcctgccaagggaaaaagaaagacagccagagaggcttgagtacagggaacaaggggaagacgaacgggaaaagctacagaggtcaacagggccaccctacacaggggctggcagggcagggtggaactgggtctttatcctttaatcttgaagtgtggtccatctgggaccctaagtggtctgtgattacctgggccaacttgaaatgtcacagatgagaggttatctttgccgaatggctaaaaaatacaagacctcagccgggcatggtggctcacacctgtaatcccagcactttgggaggctgaggttggtggatcacctgaggtcaggagttcaagaccagcctgacaaacatggcaaaactccctatctattaaaaatccaaaaattagccaggtgtggtggcgggtgcctgtaatcccagctactcgggaggctgaggcaggagaatcacttgaacccgagaggcagaggttgcagtaagccgagatcacatcactgcactccagtatgggcgaaagagtgaaactctgtctcaaaaacacaaaaacaaaaaacctctattaagaggaacagggaagggatataaagtagcttactaaatgtctattattaccattgcctcctactgagaataaaaacaattcacgcattccacaggagagtactcagcaaactacacaggagagtactcagcaaactacacaggagagtactcagtaaactacacaggagagtactcagcaaactacacaggttcagtggtacatttctccatgtgggatctacttgttgggatctgagtttacttcactacgtggtttaatttcccacacgaaaatccatgacctcttcttctaactttgctgaagacaagactttggttttacatgatactatcacacctgacctttgtgaagtagtcagggtaaaacattccagtttggccgaggagagagaaataccaaattctgcagtgactatcttaaaataatttttaaattttattttattttatttattaatttatttgtgagacagagtctcactgtctcactctgtcacccaggctggagagctgtgcagtggcacgatcatggcagcctcaatctcctgggctcaaacgatcctcccacctcagcctcccgaatagctgggaccacaggcacacaccatcaagtctgactaattttttacatttgttgtagagacaaggtttcaccatgatgcccaggctggtctcaaactcctaagctcgagggatctgcctgcctcagcctcccaaagctctgggattacaggcgtgtgcccctgcatccaacctgcagtgactatctgacttctgattactctactgtcaatcaacactggcgcacaggctgtctgtctttctgaacacacacattccatacactatgcatactaatactccatactatcaattgccctcatcagaaggatcttctggctaaccagtgatcaacatttttaatagcgaaaaatacctgatacttagagaacatgttaaccacgtgaactggggcaggttactcaacctctctgcatgtgcctcagttttatcgcttgtggaatggtgatggtaacagtaacaaccccataggtttttgaggattaaaggaactaatacacatacattatttcaacagtgcctggcagattctaggcactgaataaatggtaactatcactattatgtaaaaagtataaaaatctgctatatgaatacttatggaaaaatacatatatacatatagacacacatataaactattaggtctctttttttttttgagatagaatctcgctctgtcacccaggctggagtgcagtggtgcgatctcggctcactgcaacctctgtctcccaggttcaagcgattctcctacctcagtctcctgagtagctggaattacaggcgtgcactgccatgcccagctaattttttgtatttttattttttatcattattattattttttgagacggagtttcactcttgttgcccaggctggagtgcgatggcacgaactcggctcgctgcaaactccgcctcccgggttcaagcgattctcctgcctcagcctcccaagtagctgggactacaggcgcccgccaccacgcctggctaattttgtatttttagtagagacaggtctcaccatgttggtcaggctggtctcgaactcccgacctgaagtgatctgcccacctcggcctcccaaagtgccgggattataggcgtgagccaccgtgcctggcctttttgtatttttagtagaggcggggtttcaccacgttggccaggctggtctccaactcctgacctcaggtgatctgcctgcctcggcctcccaaagtgctgggattacaggtgtgaggcaccgcgcctggccaactagatattttttattttttacacccctccttcctagatctcttcttttttaaagtagatacaaggtcttgctgtgttgtccgggctggtctcaaactcctggcctcttgtgatcctcctgccttggcctctattagatcttcaatttgagggggagtctgggaatgaacactaaacacactcacgctatgagcctctgcccctggagcacggtgtgctgctgcagcatctcgaagttatacttctcgtccgtggcatgctggtccactatgaagatatcctcattcagtttggttattataaatcccaggttaaactgaccaatgatttccatttctgcaaacatcgttttactgcaggtagaaaatgttaattatcagacattttacaagattatttttctgattatgttatagaacactgtaataaaaaaaaagtcaaacaatacaaaaacaaaataaagtccctagccatcccgctttctttttttttgaaacagagtctcgttctgtcacccaggctacagtgcaatggcacaatcttggctcactgcaacctccacctcccgggttcgagtgattcttctgcctcagcctcctgagtagctgggattacaggtgcgccaccatgcccagctaatttttgtatttttagtagagacagagttccaccatgttggtcaggctggtctcgaactcctgacctcatgatctgcccgccttggcctcccaaagtgctgggattacaggcgtgagccactgcgttcggcttaaccatcccactttctaaagataacattaattattcattcatccaactctccggagaagacatcagttgctactattaacgatttaaatggaatatatccttctagacccttgtctccatatataattttttttaattttaaaaaacaaaaatggaatcttaattctccattctgtcatcacttaatgcatctgaaacaagttttcagacctgtacacatagatctacttcattattttttctttttttttttcttttaagacggagtctcactctctgttgcccaggctggactgcagtggcgtgaccgtggctcactgcaacctgcgcctcccaggttcgagcgattctcctgcctcagcctcccgagtagctgggactacaggcatgcaccgccaagcccggctaatttttttatttttagtagagacaaggtttcaccatgttggctaggctggtcttgaactcccgacctcaagtgatccacctgcctcggcctcccaaagtgctgggattacaggcgtgagccaccgcacctggcctacttcattctttttaatggccacataggaattcattgcatggatgtaccataatttgtctgacaaatcccctactaaaggacatttcagttgtttccaatttcaatagcgcactcaaagctgcaacaaatacttctgtgcataaacctactcatctgtgggtgcatttccgtgagacagacgctagagggagaactacatatgtacttcttgacgggaaatctgtgaaaagtcacactcccaccaatggtgtgtaagagcacctttctgccaatgctggatatcaatccttctcatctttgccaggcccaccactgggtcctttgcgggtggcttcaacatctaatgtcattaaatactaacttagtcaatctggacaaaagacagacaccaccgctaaccttcacacgagaaattgacactgtcattctcagtcccacacaattaaatccggtgaaaatggattttccgcagtatcagcgcggtgatgacaagaaatggctctgttaaagcagccatggacgttttctggttctcacctggtggcctgagctgaggatgaaagcagctgtaatgtaatcccagcactttgggaagacaaggtgggcagatcatttgaggttgggagttcaagaccagcctggccaacatggtgaaaccccatctctactaaaaataaaaaaattagccaggcatggtggtggacacctgtactcccagctacttgggaaacgaaggcagaagaatcgtttgaacccgggaggcagagcttgcagtgagctgagatcgtgccagtgcactccagcctgggcgaaagagtgagactcttgtctcaaaaaaaaaacaaaggagctgatattgttgtttctttctataagtgctccaggaagacccggtcccatgccaccatgctcgtcaccatcacaatcaaccacaggggacagtttggtgaactgtgagacctccacatggcatggattactgagcccacatttcctatggtgaggggctccacacagagctcaaatccaagtcataaccaaaccagtccccaaatcctatctttgagggtctgtttcctggtaccaattccagatcaggcagagtgcaatcaatcaagagacaaaaaccacaccagtgattttaacagggacttttttttttaagacagggtcttgctctgtcacccaggctggagtgcaatggcatgatcatagctcactgcagcctcaaactcctgggctcaagtgagcctcctgcctcagccccctgagtacctgggactacaggcgtacagcaatgtacttagctaattttttttttttttttttttttttagagatggggcctcattatattgcccaggctggtctcaaactcctagcctcaagtgattctcctgcctcagcctcccaaagtgctggaattacaaggtgtgcaccaccatgttaggcctgaggaggaaaaatgtataataaggcattacacaaactagtaaaaggtggttaactactatgctaagaaatacaggaatggaaaatgctactatcctagggaagagggagagtcctcagaaaaggaactctttttttcttttttctttttcttttttttttttttgagatggagttcgctcttgttgcccaggctggagtgcaatggtgcaatctcggctcaccacaacctccacctcccgggttcaagcaattctcctgcctcagcctcccaagtagctgggattacaggcatgcaccaccatatcccactaattttgcatttttagtagagaaaaggtttctccatgttggtcagcctggtctcgaactcccaacctcaggtgatccacccacctcagcctcccaaagtgctgggattacaggcatgagccaccatgcccagcagaaaaggaactcttgtaagaggctcctacccactcaggctgagtttcagacctccttggagcaggagtggccgcagcctgctggatggagagaagctgccagagtgagtgatgacacaggaactcctgccgcacaggagggaaggaaaagaacatcccagaagcatcccagatgccagcacaaataccacctcccctggcgccgatcccaggctctcccaggaattgtctgaatatgccctggttcccagtacatagataatctgctcaaaagctggtgctggcctaaaagacccaagtcttccatgtgtttggagtctgtgtcctgccacagagaacaggatctggccaggcgcagatgccggaattacaactgcgcactaccgcgcccagccaattttattgtagagacgaggtctccctatgttgtccaggctggtcttgaactcctgggctcaagtgatcctccctccttggcttggcctcccaaagtactgggattacaggtgtgagccaccacacctagcctcaaaatactcttaagaaaaaactttacctggccgggtgtggtggctcacacctgtaatcccagcactttgggaggccaaggtggctggatcacctgaagtcaggagttcgagaccagcccagccaacatggtgaaaccctgtttccaccaaaaatataaaaattagccaggcatggtggcgtgcacctgtaatcccagctactcaggaggctgaggcaggagaaacgcttgaacccgggaggtggaggctgcagtgagccaagatcatgccactgcattccagcctgcgcaacagagcaagactctgtctcaaaaaaataaaaaataaaaataaaaattttagataaaaagagaaaaagtaaaaaattaaaactttaccttatctcttttcttagttcatcttcggctgcttgattttctccaggacaaatctttgccctaaacttcctgtaattctgttccccttcactttgctgtgcttcatgatgtaactgctttattcgtttagctaaagaactcatagaaaagtccaggggcacaactttcttattaattttcacagctacatcaacctgagaggctgacatgtcctgagtatttactaacttttgacaaatgtcagaactggaaagaatttcttcttttttaaaacgctttgtgtttggggttgcgagattagttggctgaggcaaaactcgaaatttacatccggtatcttcctggtttgaatggcagtccacatctgaaaaagagtcgtcagttttaggcgctttctcctgagagtccacatgttcctgcgagcccctgtcccctggggagctggccgcatactcgctgctgcagtgactgcccgtgtctgggatgctgaacccctcagaatccacggaagtgctgccgtgccccgagtccttctccacctccgctctgtccgtagggtcactgggtccgtgactggaactcactgcctctttctgaggtctcaggacgcctttgtcagagatggcacctgaagtgctagaagacagcataccccttttctgtcctagagggctccttcttggttctggagtctttgggctgtgaggcttgttctctgttgtgtgacgaagagaaaaggcctctcgcagtctggaaatggacacgtcttttttttcttctccagtccttaatgaaggggattgatcctgcttttctaccatgggcttttccaaatccgctgcatgcatttttattaagttacctaagcaaacgtggacggagaagagggtcagggactatcctgaaatggtgagaggacgtgcttatgtgaacagatacttcacaaaagaggagatccacatgctaattacacagatgaacacagttcaatgttcaaaataaaactataatatgggccaggtgtggtggcttacgcctgttatcccagcactttaggaggccaaggcagggggatcacatgaggctaggagttcaggactggtctggacaacatggtaaaaccctgtttctactaaaaatacaaaaattagccgggtgtggtggcatatctgtcatcccagctacttgggaggctgaggcacgagaatccctttagcccgggaggcagaggttgcagtgagccaagatgccaccactgctctccagcctgggtgacagagcaacactctgtctcaaaaaaaaaaaaaaaaaaaaaaaaaaccacaacacaatgcaatatggccatatactcaccagaatggtaaaattaaaaaaacaacaaatgctcacaaagatcaggatcaagaggaatgcctgaatacctctggtaggaatgaacctggtacagctgctttgaaaagttctctgggaatacctcctaaatctgaatgtatgcacacctgcaacccagcatagctactcctatcagaagtgcctattggccggcacagtggctcacgcctgtaatcctagccctttgaggtcaggagttcaagaccagcctgaccaacatggtgaaacctcatctctactaaaaatacaaaaaaaaaattagcagggcatagtggaatgcacttataatcccagctactagggagaatgagaatgaggcaggagaatcacttgaacctggaaggcagggttgcagcgagccaagatcactccactgcactccagcctgggcgacagagtgagactccctctcaaaaaaaagaaagaagtgcctatctatgctcgtcaaaaagacgtggatgaggatgttcatgacagcattcttcattatagccccaaactggaaacaattcaaatattcacaaatgatgatatctgactataatggaacactgtatagcgaacgaataaatgaattttgccacatgacttgggtgaatctcacaaacaaaataatgagagaaagaaacaaatcacagaaaaggacagactgaataacttcaaattaaaaacagattaaactataccgttttgggttttttttgtttgtttgtctgtttttttgagacggagtctcgctttgtcacccaggctggagtgcagtggcacaatcttggctcactgcaagcccctcctcccgggttcacgccattctcctgagtcagcctcctgagtagctgggactacaggcgcccgccaccacgcccggctaattttttgtatttttagtagagacagagtttcaccgtgttagatagtctcgatctcctgacctcgtgagccgcccgccttggcctcccaaagtactgggattacaagcatgagccgctgcgcctggcctaaattctactgttagaagtcaggaaatcccagcattttcagaggccaaggctagaggactgcttgagctcaagagtttgagaccagcctgggcatcatggagaaaccccatctctaatgacaatacaaacattagccaggtgtggtggtgggcgcctgtaatcccagctactcaggaggctgaggcaggagaatctcttgaacgtgggaggcttcaaggttgcagtgagctgagatcgcatcattgcactccagcctgggtgacaagagcgaaactccatctcaaaaaaacagacatgacaagggagttaaaaatgcagtcactgcagacttcttctaatcatatatcttatatgacttcatccgtttacagtttacaaaaaactagaggtacttggaggcagctacttgggaggctgaggcaggaagatggcctgagcccaggagtgtgatgctgcagtgagctacaatggcaccactgcagtccagcctgggtgacagagcaagtccctgtctcaaaaaagaattaaaaatgataaaataatataagagactttgttttcatgtcaaaaaaaagtttacttggaaaaaataaggaaacacattagctaaaagctttagaagctgtttgtacactgtatttttcttaccttcaacatccagcagtggctgctgactgacatttagcttgttgacatcactatcaaacattcctatcaaagaggtctttaaaactgccaacaaaagcttttcctcttgtagcaaaatttgccttttatctggagtaacattgatatcaacgcattctaaggcaaaaaagaaaacatatttattatgtttaaattcacttttattttatttattaattattattttcagacagcgtctcactctgtcgcctaggctggagtgcagtggcgcgatctcagctcactgcaacctccgcctcctgggttcaagtgattctccctgcctcagcctccgaagtagctaggattacaggcaagtgccaccacactggctaatttttgtatttttagtagagatggggtttcaccgtgttggccaggctggtctcgaactcacaacctcaagtgatccacccgccttggcctcccaaagttctgggattacaggcgtgagccaccgcgcccagccaaattcacttttaacaatagaaatttccccatctattatttcattcacttgtatttatcacaagtgctattaaaaacattacagtgtccaggttaagattcataagttatgaaatcagctttttcaaataaatgagcaaaagacaatttttgaatagacaaaatacggaagggcttaattaggtaaattgttaaaggaaaagcaaataaacacataaaaataattttaaatatgcaaactaaaataagatattttaatcccctactgaatttagcttaacaattataatacctagtacattataggtaggtgtgtaaattggtacatctagaacacaatacagaaaaagccttaaaatgatcatattcactgacccagtaattctactcccggcaatttatattcagaataattaaagatgtaggctgagtgcagtggctcacaccctgtaatcccagcactttgggaggctgagacgaacagataagttaaggtcaggagttcaagaccagcctggccaacatggcgaaaccccgtctctactaaaaacacaaaaaattagtcaggcatggtggcaggtgcctgtaatccgtgctactcaggaggctgaggcgggagaatcgcttgaactcaggaatcggaggttacagtgagctgatattacaccactgcactccagcttgggagacagagcaagactctgtctcaaaaaatatctaataataaagatgcagataatgatttaattataaggaaagtatttataatttccaaaaactaaaaacaatttaattttgaaaaatttaaaaattaaaataccaaactataaccatgcattggaatataattcacctattaaaaccacatttctgatcaatttctaataacatggaaaagaaaacattcacatctaaggataaagagcagtatacaaaattattttctcatcccaaagaatatgggagtaggggagagagagagaaagagagagaggacagaagatattttttaaggtatgtacatatgtgtttctaagtatctagaaaaaatactcaattacaataaaccaaaattttaacaatcagaaaaaaaaatctatatgaaatgaattatttatgaaattaggaagaacatttcatctactttctcccttggttgacattaaaaaaaattacattttcctaacaatataattaacatagtctcaagtagaaagcgggaactctgtttaaaaaaaaaaaaaattatagggccaggcacggtggctcatgcctgtaatcccagcactttgggaggccaagacgggcagatcacgaggtcaggagatcgagaccatcctggctaacacggtgaaaccctgtctctactaaaaatacaaaaaattagccaggtgtggtggcacgcacctgtagtcccagctacttgggaggctgagtcaggagaatcgcttgaacccgggaggcagaggttgcagtgagccgagatcacgccaccacactccagcctgggtgacagagcaagaccccgtctcaaaaaaaaacaaaaacaaaaaacttacatgaccataaattgttatctcattccagtcatagcagagctgtagaatttcattttattctttgaggcattagtcactagttgtactgaaatgccaatggaacttacctgaatcaacagaaatgttaagaacaacaaatggatactggtgtcgattatacatgtggtagacctcattcacgagtctgcagacctgcacaaaatacaaggagtagaaaagaataaatgacaaatgttcccagccccccgcattctaacaacattctattctaaccaaccagcatgttcttagaaggggatacttttttgttttttttttttttgagtcaaggtctcgccttgtcacagcctggagtgcagtggagcaatcatggctcactgcagcctcaacctcccaggctcaagtgatcctcctgtgtcagcctgacatgtaacttggattacaggcaggatttttttttctttttttttttcaacggagtctcgctcttgttacccagactggagtgtaatggcacgatcttggctcactgcaacctctgcctccggggctcaagtgattatcctgactcagcctccagagtagctgggattacaggcacacgccaccatgaccagataatttttgtgtttttagtagagatggggtttcaccatgttggccaggctggtctcgaactcctgacctcagttgatccgcccgcctcaacctcccaaagtgctgggattataggcgtaagccactacacctggcctaaggatacatttttttaacagctttactgagatatgactaacatggaataaactacacatatttaaagtgtgcaatttcataagttttgacatatacacaaacacctgtgaaactatccccacaatcaagataatgaatatatccatcaccaaaagtttcctcacaatctcaaagtgatatttctctaatcatagattcctaaaactgaatatttttccaacttaaagttgctctatgagaaattctagtgaaatgcaagtgcagcttaaatgttcataaaacatattcaatgtacatagaaaagtatctatgacattaaaatgtcattagaaataaaccaaaatatcacattattaatagttataattaataattatgaatccatcacactataggttaaaaaatttagaagttcaaccacatctggcagattacaagcaaactctaaagcatcattgaaaaacaggggctgggagcggtggctcacgcctgtaatcccagcactttgggaggtcaaggcaggtggattgcctgagctcaggagttcttgactagcctgggcaacacagtgaaaccccatctctactcaaatacaaaaaattagccaggcatggcagcatgtgcctataatcccagctacttgagaggctgaggcaggagaattgcttgaacctgggagggagagcttgcagtgagccaagatcacgtcactgcactctagcctgggcgacagagctagactccgtctcaaaaaaaaaaaaaaaaaaaagaaagaaagaaaaaaaaacaaaatattactgaggtacaatgtgttgctaagatacaaactcaaaaaacccatgtcatcatatcaagatgatcaatttaaatctgaggcagaagtaatctgagcccttattttcctaggaaaatagaaagaagagaaaatatagaaatctatagaaaatatagaaaccatgggccgggcgcggtggctcatgcctgtaatcccagcactttgggagacagaggcgggtggatcacgaggtcaggagttcgagaccagcctggccaatgtggtgaaaccccgtatctactaaaaatacaaaaattagccgggtgtggtgatgcgtgcctgtagtcctagctactagagaggctggggcaggagaatggcgtgaacctgggaggcggtgcttgcagtgagcagagatcatgccactgcactccagcctgggggtgacagagcgagactctgtctcaaaaaaaaaaaaaaaaaaaaaaaaaggaaatatagaaaccatgtaatcagtctatactgaaaggtgacatagaatgttataaaatgtttagtttcttcaaatagttttagtttttacaataataaatatactggtaatatgtgtttatatatttatgtatctatacacacaacacatataatgtatatatgcagatacaaacacactcacgtatatgcaatttaaaaaactatacagaggccaggcgcggtggttcacgcctgtaatcccagcacttcgggaggccaaggcaggcagatcacgaggtcaggatttcaagaccatcctggccacatggtgaaattccgtctctactaaagacacaaaaacttagccgggcgtggtggcgcgcgcctgtaatcccagctacttgggaggctgaggcaggagaatcgcttgaactcgggaggtggaggttgcagtgagccaaaatcgcaccattgcactccagactggccaacagggcgagactccatctcaaaaaaaaacccaaaaaacaacaacaaaaaaaactgtacacagatagatgcgctccttaacttatgatagggttatgtcctgataaacccataagttaaaaatattgtatctgctgggcgcggtggctcacacctgtaattccagcactttgggaggccgaggtgggcggatcacgaggtcaggagatcaaaaccatcctggctaacaaggtgaaaccccgtctctactaaaaatacaaaaaaaaattaaccaggcgtggtggcaggcacctgtagtcccagctactcgggaggctgaggcaggagaatggcgtgaacctgggaggcggagcttgcagtgagccgagaccacgccactgcactccagcctgggtgacaaacaagactccgtctcagaaaaaaaaaaagaaagaaaagaaaatactgtatgtcaaaaatgcctttgtgataacctaacctactgaatgtcccatctcagccttgcctcagaatacttacatagtctataggcaaaataacctattttataataaaatgttgaatatcttctgtaatttattgaatactataccgaaaaacaatggttcaataggtacttgaagtatggtatctactgcaaaaaataacttctgcaacaaggtaaagtagtagaaaaaaatatatatatatttttttgaaacacagtctcgctctgtcacccaggctggagtgcagtggcataatctcggcttactgcaagctccatctcccaggttcaagtgatcctcctgcctcagcctcccatgtagctgggattacaggcgtggaacaccatgcctggttattttttgtattttagtagagacggggttttgtcatgttggccaggctggtctcgaactcctggcctcaggcaatccacccgcctcggcctcccaaagtgctgggattacaggcatgagccactgcgcccggacagaaaagtcttcagttgaaacatctgaagctgggggccatctgcggtagacttctgtaaatgcacaaaataagataatgttaaagccatgtttctcaaagtcccgagctccacgtaaactgcctattatcagaaaaaagttatcaattaaaagtcaaaggcataaagaacaaactaacacaaaaaaattttaaatacctttgctgggtcacaaggccgccggttgataaagaaaaactgtctgtctgttgaactccttccaactccatgcgtgcattgtgaaatgaaacctgagatgctattcaacattaatatggtaagggcaggattccagagtgaaagggattagaaatacgatcacatggcacattcttaaagtgaaatgaaaacaaaacaccaggtgacatgctgataaggatcactattgcagttcacgggtatctgtgctccaaatcttgatgagtcatcaaagaaccaaaccttctggaatattctaaagctcctacagtcaaccaatgcaccacaggtgatgcagtgcgtccaaaactgatgtgttgcagctctccttacccttcctgataaatcctcagcctctgtaagtgggtctcgcttcaaatgcattctcagaacctccgtgctgccacccctggtttgtcaatgaagtctaaccacttgtgctcagaattttgcccacattccctcccctttcaaaacctcccgggtaggacgcttatatctcatgtcttggtaaagcgcttgcttcacatgagacccaccccagggataccggcatttccagaagaacaccaccttcacataaagacataaagctccatgtttaccatttcaggcataagccaaaagcaagtggaggaagagtaagaaatatagatctcaaggcaacaaacaaacaaacaaaaagaaatacagatcttaggctgggtgtggtggctcatgcctgtaattccagagccttgagaggccaaggtgggtggatcacctgaggtcaggagttcaagaccagcctgggcaacatggcgaaaccccgtctccactaaaaatacaaaaaatcagccgggcatggtggtgaacacctgtagtcccagcttctcggaaggctgaggcaggagtatcgcttgaacctgggaggcagaggttgcagggaggcagaggttgcagtgagccaagatcacggcactgcactgcagcctaggcaacaaagcaagactccatctcaaagctaaaaaaaaaaaaaatatatatatatatatatatatacacacagatagatagatatctttacaggaccaatcctatttatggaagtgtctattttcttatacgaaaagtaatgacactgaactgccttcatcagatgccaggaaagtcaaaatcatttaaaatgataaaataatttacaagttagtctaactaaacagagccttaaagaagacctgctcaacagaaaaccacctgaaatataccacttactcaaaacatggtttgaattaagcaactgactcctttgtataaatcatctttcttagccacagcattgctcacagttttataaaggacataaaaaactattatccctagccaggcgtggtggctcatgcctgtaatcccagcactttgggacaccaaggtgggcggatcatctgaggtcaggagttcgagaccagcctggccaacatggtgaaaccccgtctctactaaaaatacaaaattagccgggtgtggtggcacgtgcctgtaatcccagctactcaggaggctgaggcaggagaattgcttgaactcaggaggtagaggttgcagtgagccaagatagcaccattgcactccagcctgggcaacaaagcaagactccgtctcaagaaaaaaaaaaaaagacacgaaactattagccttagaatcactatctttaaaaaaaaagctctcaggataaaatgttcaattgtagttctcttgccagcaatctacttactaaaaaagattatgcagagcatcggaacagctcaaaccgtactcttcacacacggagtcactagggggcagctgaacaaaaggaatgaggctttgcaactgaaaaaaaaaaaaaaaaattcacagttacttcctaataaagacagagtggacttaatctgttttctttcttagtcaagctattgacattacaagcgcaaaaaaaattaaaagaatcttttgttttgttttgttttttgagacagggtctccctctattgcccaggctggagtacaatggctcaatcatacctcactgcaatgtcaaactcgtgggttcaagcaatcctcctgcgtcagcctgtcgagtgagtagctgggactacaggtgcacaccaccacacctggctaattttttaatttttttgtagagatgggatcttgccgtgttatccaagctggtcttaaattcctgggctcaagcgattctcccacctcaaaattgttggccgggtggttcaaacacataatcccaacagtttcctctcccagagtgctgggattacatgtgtgagccgtgggaacaacaattttgattttatgatataagaaagatgaaacaagtacctacttattcagaacccacacattgcccacaataacttatatttttttcagagagagagtgaaaagacgcagtatacgagtgtctctggaagaataaaatgaaacacattcagctctcaaacatcaatttttgtgataggtactttgtttttttttttttttttttcctgggatggtgtcttgctctctcgcccaggctgcagtgcagtggtgcaatctcagctcactgcaacctccatctcccgggttccagcgactctcctgcctcagcctcctgagtagctgggattacaggtgcctgccaccacgaacagataatttttgtatttttagtagagatggggtttcaccatattgatcaggctggtctcaaactcctgacctcgtgatccgcccacctcagcctcccaaagtgctgggattacagacgtgagccactgcgccgggccttgtgataggcactttaaaaatcaattcttaatctgggcgcagtggctcacgtctgtaatcccagcactttgggaggccgaggcaggcggatcactagaggtcaggagttcgaggccagtctggccaacaagatgaaaccccatctctactaaaaatacaaaaaattagctgggcctggtggcatgtgcctgtaatcccagctactcaggaggctaaggtaggagaattgcttcaacgcgggaggcagaggttgcagtgagccaagatggcgccactgcactccaacctgggcaacagagcaagactccagctcaaaaaaaaaaaaaaccggccgggcttggtggctcacacctgtaatcccagcactttgggaggccgaggctggtggatcacgaggtcaggaattcgagaccagcctggccaacacggtgaaaccccgtctctactaaagatacaaaaaattagcctggcgtagtggagcatgcttgtaatcccactactcgggaggctgaggcaggagaattgcttgaatctgggaggcggaggttgcagtgagccaagacaacaccactgcactccagcctgggcagcagtgcgagactccctctcaaaaaaaaaaaaaaaatcaattctaagattttattctccattctactggaagggacaatggaaacccgctataatcactagagcaataagaggcgttgaagtaaccggccatcactacctgcttctgcccaaacacagagccgatattttcctttatgctggggcttccacctgtgcataccacaggctgtcgttttccttgtccaagctgattggtgcaacttacacggatgcctgctgaaatgatacagtatgcatgtaagacctggaccattttggcatactcctgtttaaaaaacacaaacacaatattctacattactttaatattataggaattacacagctcaagttacaacatccaacgcaaggttctcacatcatcgcacaaatcaagggaagcactgttgacagaatgatctgtaaagaggtgtcttcctatattctacagaaaggaacgcagagcttttggctcctggtcacagtcctctcacttcccaatgtgccatgcatcctggtaaaacaactaaaaagtacagcctgtaatcccagctactcaggaggctgagggcaggaggatcacttgagaccaggagttcaagaccagcctgggcaacacagcaagaccctgtctctacaaaaaatttaaaaaaaaaattagccgggcgtcatggcatgtgcctgtagtcacagctactgaggaggctgaggtgggaggatcgcttgagcctaggagttcaaggctgcagtgagccatgattgcaccactgcactccagcctcggtgacagagtgaggccctatctctaaaaatgaaaattaaaaaactgaaacgtacattgtgtttgattttataatctctccttttgaaatgtatcttcgtataatagaaacactggcacaagcattttggtatgcaaagagatacacaaaaatgttcactgaaacaatctctatgaacaaacagaaacaacctaagcaagcatcattgaggagttgattaattatggtatagccatagcgcagcagaatgacaacaaataaggcagtgtgcaccgactaaaaaagacaatcacaatatgctaagtaaaaagtcagttatagggccaggcatgatggttcacacctgtaatcccagcactttgggaggctgaggcgggaggatcacttgagcccacgagttcgagacctgcctgggcaacacagaaggacccatctctacaaaaaaaacaaaaattagccgggcatggtagcacgggcctggagtcccagctacttgggaggctgaagtgggaagattcattgagcctgggagatcatggctgcggtaagctgagattgtgccactacatcccagcctaggtgagagagcaagaccctgtctcaattaaaaaaaaaaaaaaaaaaaaaatacaactttcaaccacatacaattctgtattacttgcatgttgtacattctatattacttgctttcattatattaacttatgaatttatcttgaaaattattccaacagttataaacacatgaaattaaaagcagcctgaaaagatatacaaactgtaaataacagttatctctgacaaatagaagttctacattcctgtattctgctaaggcactaatttttttaccataagatacaaaaaaagagtaagttttctctactttagaaaatttaaatttgtgaaaaaatgtaataaagttaaaattagcagccaagtgcagtggctcacacctgtaatcccagcactttgggaggctgaggcaggtggatcacttgaggtcaggggtgcaagaccaggctagccaacatggtgaaactccatctctactaaaaatacaaaaattagctgggcgtggtggcgcacacctataatcccagctactcgagaggctgaggcaggagaatcacttgaacccaggaggtggaggttgcagtgagccgagatcgcaccactgcactccagcctgggcgacagagtgagaagactccatctaaaaaaaaagaaagttaaaattagcaccaaatgctttacaagtaaaaaaagtttttagctgcatatgtttaagtaactttttagattatgaaaaacacacatacaaaatgggaaggcacaaagaagacagcaaaaactgcatgagatctcacatccaaggataactgctgagaacatgaaagtgccgagtcttccagcctttatactatacacatttaggcttgttgttttgttttcacaaaattgtaatcaaataatacagacagttctataatctgctttttaaacacaacgactatataacatttagctattttcatttgcattcaaattcataagggttctaatagctcatttctcagaaaaccaagagaaatattcttttttttttttttttgagatggggtctggctctgtgcccaggctggagtgcaatagcttgatctcggctcaccgcaacctctgcctcccggattccagcgattctcctgcctcagcctcccaaggagctgggactacaggcacatgccaccatgcccagctaatttttgtatttttagtagagatggggtttcaccagtttggccaggatggctttgatctcttgacctcgtgatccacccgcctcagcctcccaaagtgctgggattacaggtgtgagccactgtgcctggccgagaaatattcttattaaaatataagtacataaggccaggcatggtggctcaggcctgtaatcccagcactttgagaggccaaggtgggcagatcacctgaggtcaggaattcgagaccagcctggccagcctggacaacatggtgaaaccccgtctctactaaaaatacaaaaattagccagctgtggtggtacacgcctgtaattgcagctactcagaaggctgaggcaggagaatcgcttgaactcaggaggtggaggttgcagtgaaccaagatcgcgccaccgcactccagccagggcgccaaagagaaactccatctcaaaaaaagataaaaataaaaaataaaaaatatatatatatgtatatatatttttccagacaggatcttattctgtctcccagtcttaagtgcagtggcgcaatcatagctcactgcagcctcaagttcctgggctcaagtgatcctcccacttcagcctcccaagtagctggaactacaggtacatgtcaccatgcccagtaaatttttttttaaaatttttcatagagacagggtctcactgtgttgcccagtcctaataaacactatgtgatgaaaagaaaaaagtaaatcatcctaaagttaagtctttaatgttaaatctttaatgagaaatgcaaataaagcatttctcaataatttatgggaagagaatcaactgaagaataaacatctttagtaaatcttttgctcatgtgcattaaccaatactcttgaaaaccaggattaatttactgtaccttcttaatattcctttgaaattccttatggcgcacaggtagtgtggaaaataactgctgcacgctgactgtggtccctctggggcgggggtagggggttttctggataattttcccattgtgatcaaacatcagtcgagttccaaccttcgccgatgcgtggcaggtagaaatggtgacatcgctgtgagagaataccaggcatggtgtgttcagtgagagacccatgatgttgggcactgactactcttttcttcacttgcttttctctcaaaattttcttaaaaagctgacgatccctctgagataatcaagatctaaatggttgaggagtcatcataaaatctaaggtttggcatctaaaagacagtgagacagagagcactaaacatgctttgctttgataaaagctttgatttcgtttttcaggttgaactgcaaaaccataaatgatcttaagatttatttattcacaaacacagatttgttttgttattactcttcgaacaaattttttttaaagaatctaacaaatattataattaaaatgtatatgtagggcagagcgtggtggctcatgcctgttatcccagcactttgggaggccaaggcaggcagatcacttgaggccaggagtttgagaccagcctaggcaacatggtgaaatcccatctctactaaaaatacaaaaattagccaggagtggtggtgcatgcctatagtaccagctcctcaggaggctcaggcacgagaatcacttgaacctggaaggcagagattgcagtgagccgagactgtgccactgcactccagcctgggtgacaaagagagactctgtctaaaaaaaaaaaaagatatatatatatatatataattatttataaaaatttcatatctgtgctataattaaatagtgctttggtgaaatgtttccctaaaaattgataatgaaaaccaatggtaactatcatttattatctacatgttaggttaaaattgagaattactgttttaataagggtaaccatctttttaacaatactatttgcttcatttcattcatttattgctcacatttcagaagtactatgacttagattggcagcgagacaaaacagaattcagaagctagaagttgagatgttgagatagaaaactgaaaataataatgattccaattaattttcagagaggtttctctaaggggtcaagtgagtggataaaaatattgtatcacctcagtgcacaaagtgagctcagagcttccccccgaaagccaaaagtttcaacctgagttaggtcggcaaactcttgaatcttagatgtgtgatgtttcagagctgaaagagagtgtaaagtaaggactaagatatctcaagtgctataacaacaaaatatacatgatatctagtaactggctttaaaaaactgtttttgcatttcccaagacagtgttactcaaaattctgagacatgtgacccaattattttataataggattagaaaaagtcaacttacttaagccttcgaagttttcttcttctaccccacatccattgtctgaaacttcaataagatccactccatagtccttaagctttagatctagaaagtttaaaatatttacatatttattaaaaacggacccatgctatcagtttttatattgacattatttataacatatgcaaatttaagagtcataactatacctttagttaaacatactagtgtcattttgtatatttcattgttataaagtcctttctggctatttactagcccagactaaatagtttagctttttctttctttcctctttttttttccctaggctagtgaagtgaagcagttggagtggagaaggaacaaaaaaaatctgtaactggtggtgatcaattagctgtaaaccgcgttgcactttgaccatccttttcttttgaaagaaataattttaacatacccaataaagagaacggggaccgggtgcagtggttcatgcctgtaattccagcactttgggaggccaaagcgagcagatcacctgaggtcaggagttcgagaccagcctgaccaacatggagaaaccctgtctctactaaaaatacaaaattagccaggcttggtggcgcatgcctgtcatcccagctactcaggaagctgaggcaggagaatcacttgaacccaggaggtggaggttgcagtgagccgagatcgtgccattgcactatagcctgggcaacaagagcaaaactctatctcaaaaaaaaaaaaaaaaagagaatgggttctggaatcagacttcctggatcctattttatcagctttataatctcaaaaaaaggaaatttcctatcccctaatttcctcatttgtaaaatagagaataataagttctatctcataaagttattctgcagattaataattctttggttttttttattttattattcttttcttttcttttgagatggagttttgctcgtcacccaggctggagtgcagtggtacgatcttggctcactgcagcctccacctcccaggttcaagcaattctcctccttcagcgtcctgaggagctgagattacagccatgcaccaccacatctggctaatttttgtatttttagtagagacagggtttcatcatgttggttaggctggtctagaactcctgacctcaaatgatcagcccccctcagcctcccaaagtgctggtattacagatgtgagccactactccagccctattttgttttatgtttttgagatggaatcttgctctgtccccaggctggcatgcagtggcacgatctcggcttactgcaacctccgtctctcggcttcaagcaattctcgtgcctcagtgtcccaagtagctgggattacaggcttctgccaccaggtccagctaatttttgtatttttagtagagacagagtttcaccactttggacaggctggtctcgaactcctgacctcaggtatccacccgccttggcctcccaaagtgctgggattacaggcgtgagccactatgcctggcctactttatttttcaatagagacaaggtctcaccatgttggccaggttggtcttgaactcttggcctcaagcaattcccccacctcggcctctcaaagggctaggattataggcgtgagacaccacgcccagctgttctgcaaattaaatatttctgtgcaattcttagcataacacctgcctggcacaccgtaagaacacaataaaagctgttattattattactacctagctaagtactaggcacataataggtgctaacttcaacttaaaaataataatttattactacatcaacacttgatagtcttatttcaataacaaatgtttcttaactacaacaacattcacagatcatttcttgtggcttaaaactctcccaaacttaccaatattagtggcaccagcatccagactgttttctactaactcctttaccgcagtgcttagactcagtaccacctgcccagagcaaatctgatggactgacttccgatcaataggtttgatggccttagcaggttctgtactagagaaatcagttacaagaaacaaatcaagtattcagctatatattttcatcctgattttaactgtgggaaatgactcaacactgtaaataatttatgggtctaatctattcatttattatattagcaaatacatttattatatccagaaatagaaacactgttttacaatccttaaacatgtacccaaaatacttctggatagatacttcaaattcaacagatccttactatctaattatactaagatccacatggagaaaacatacattgtatctctcaaattaccaaaatctttggcaacaatggtgtcttctttcttgaaaagtgaaagcatggctggctgtggtggctcatgcctgtaatcccagcactttgggaagcagagatgggtggataacttgaggtcaggagttcgacaccagcctggccaacacggtgaaaccccgtctttactaaaaatacaaaaaattagccaggcatggtggtgggcacctgtaatcctagctactcaggaggctgaggcaggagaatcgcttaaatccaggaggcggaggttgcagtgagctgagattgcggcattgcactccagcctgggcaacgagcaaaaaaaaaaatgaaagtaacataatttcccaacataattagaaaaaccaacagtatgctgggaaatacacaatgtttaagtcaaaatcatctcagaaattgggtaccagttatataactattccttatacacagttgcctttgataccccactccaaactgaagctgccagctgctgtcttagcaaagaccctcaaagctcttgctgtactagctttaagagttttataaaggttttatctccccttattccctgctccaatacatcctccactctatcaccagagctatttttgaaatcacaaatctggtcaaataatttttctgcttaaaaatttactagtgccccacttcctactatatgaaagttaaaatttagtcatcattggggccaaaactaccttcttttcagaatctctctaatcctttcccttcatcaagtcccctacattattattattattattattattattgttattattgttattatttgagacagagtctcaccccgttgcctatgctagagggcaatggcatgagctcagctcactgcaacctccgcctcccaggttcaagcgattctcctatctcagcctcccaagtagctgggattacaggcgcccaccatcacacccagctaatttttgtgtttttagaagagatagggtttcaccatgttggccaggctggtctcgaactcctgacctcaggtgatccgcctgcctcggcctcccaaagtgctaggattacaggggaccgcaaccagccatcccctatattgtagcacagtgaacaactgtcctgaacatcacaagctctttgagacactacagtgtataagcaggtctctgtctaaaccgctctcctcttcctcctctgcccaaacaatgtctgctcaaagaatgtatcccgtgtgttcattaacttagcaatttccagcaaacagtttaattgataacttgttaagagaaggcaggaaacctccatgaaagagaaatcactgggtatttcctacagcatttaacacatcgtaggcctttaataaacccttctgaaataaacaaacctctttactcttcattccaccttgctaagaatctcacctaagtctgtctaccatgtgaaactgcagatgacctcacagaaaatggaaagaagtatctctaaaaataagtttatttggcagcacactataggctacaggtccacttctgatttttttttttttttttttttgagaccgagtcttgctgcgttgcccaggccggactgcagtggcacgatctcagctcactgcaacctccgcctcctgggttccagcgattctcctgcctcagcctccaaagtagctaggattacaggctcccgccatcatgcccagttaatttttgtatttttagtagaaacggatttcaccatgttggccaggctggtcatgaactcctgacttcatgatccacccgccttggcctcccaaagtgctgggattataggcgtgagtcaccgctctcggcccacttcagatatttattttgaggagggagcgcatttagacacagaccccaaatttatttaaatgtctcaatacatttaaatgtagttacctaaatatatctaatatatttaaatgcagagagcaaatttgcgtttacaaatctgacatggaatgcaaatgtgctagccaagattcggtgtagcttaccagccagaaatcacacatcctaacaggtagaaacgtattgcatttttaaaaactgcgcagctatgcaaataaggatgtgtctggacgctctaccgtccccaaaataaccttaattttttaaaaaggccaggcacggtgcatcatgcctttaattccagcactttgaggggccaaggcgggcggattgcttgagctcaggcgttcgagaccagcctgggcaacgcagcgaaatccccgtctctacaaaaaaaaattaaaaataaaatactataaaaataaaaataaaaggggagagagaacaggtagaaaggaaatgcattcagtctatggggatttcacgctcccgcttcaagtccacggccctgtgatgggatgtgggcaaggcctgtctgggacaggccgaacccaactcctcacagggccgaatcctttgcccgcagcccaggaccccgaaggagcttgcctcggcctcaaggcgcacccaaggggcacgagatcgctgcaacactgaggtcgccactccggggcctccagggggctgcctcgccacgcgcctcggccatgttccccccatttccagggaggttggaatgccgtgggtctcaaagagggcgcgcgagaggggacaccggaagactgcgagccccgctcacctcgagctctcagctcgctccatggatgcaacacccgatccgcctcggggactgggaaagttccctccagggctcccacaggcgctccgcctcctgaactcccattggct

SEQ ID NO: 1631 - DNA, 35869 bp, Homo sapiens; identical to SEQ ID NO: 1630

SEQ ID NO: 1632 - DNA, 98008 bp, Homo sapiens
cggttcgaattctgtgctgccggggttcgctggttctccgagttgtgtccgaggcttccacgcgcaggggcccgggaaagggtcagaggcttcctaacgcagactcgagtgcgaagcgcgcagtcgccgggtgggtctctccccagcgacgatttgggtggtgagcgactgcgccttggcgtggggaaaccggcttacctgggggagttctgttcctttccctcccggcaccttggatgcgctgggactggtcctcgtggttgctgagcatgctgctctgaacggttgtattttatttgatgaaaaataggaggccgggcgcagtggcttacgcctgttacctcagcactttgggatgtcgaggcggaaggattgcttgagcccaggagttcgaggccagccttggcaatatggcgagccactgtctctataaaattaaaaaaaaaaaaaaaaagaggaaactgtcacttccgtcccccacccccgcccccgcttctttcagacggatgtaagattagctgtgtcaagcgatcttgagacaggagactactacataaagttatgacttctttccaaaatgaggaatctttttcgactacagcccattgtatcacatacatagggtataaaagaacacttgtccttcgtttgatgggtgtgcgtgtgcaaacctacaaacacattgttaattagggccgaaagatgatgttgttaaggtcggtgagtaggatgatgtgcttttctaggtatgcatagtcagtgaagatagccttttttgggtaactactgtaaattgaagttaaggacattcatttgacagtaaatgtcccactaggaaaatgaaaacattttagtatcaaatatattcattgctactgcagaagagttagggagttctttcttttttttttgagaccgagtctcactctgtcgcccaggctggagtgcagtggcgcgatctcggctcactgcaacctccgcctcccaggttcaagcaattctctgcctcagcctcccgagtagctgagattacaggcgctcgccaccacccccggctaatttttttgtatttttagtagatacggggtttcaccatcttggccaggttggtctttaacttttgacctcgtgatccacccgccttgacctcccaaagtgctgggattaccggcgtgagccaccgcgcccggactgggagttatttcttgcatggcaatacacagatgttgaactaaaacctgatttaagatgaaatatatagtaccaaatggtattatagaatttgcccaattttctctacccttttctccttcaccatcctacagagagctagagatgttgaataggtaaagcaggatggggacctgatttattgacttgtctgcgagagtcttgtcacttaagcagaagcaaatttgtggaaacaaaaaagggaaagaggatagaaccagtttgtctattaagattacatagtatctcatttaatttcctgccactttctttccataaggtgggagttttctttttaatcttcctccctacatctgagaatttttgagtggggaataaatgtaacataccattctaactggatgagggaaggaaggacagtttagtattcgttaattcattcaaaatattgagcttctctaagtacattgcggtcctgaacgtaatgcacaggacttttaaccttttggaacttgggatgggatcagaatgctaagaagggcgttgaaggagatgctacagtgaaaaaggtaaatgggatctgaaagaggaatgtaattttaagattgcgcagaaagctctgtagtagtggagattataaagctttagttttttattgtattaattacaataataaaatgtgatgctttattgtgatttttatatgcaaagaaatttagtagtttcacaaccctagagatactcatccactgaagaaacaaaagcttttcttcatttctatgagttgacctgccaaatgttattttgatccctgtggttgtgacttgtaaatgtgtctttttaaaattttataactattgggcgtaggaggaggagacagcttttatctggtaataaattcccttctaacaaaatatgaatgtaatgataccatttaatcagatgtccagtacttgtaatgtaattatgaaagttcaaacacctcatattgaaattgatatgtaatatgtaataaagctacaatgcgacataatttaatggtctttgcatcctaatgacttggattcaaatcttgatttcaccatttacagtttgtgtgactttgagcaagttatttaatgtctgattcttagtttccttaacatgtaatgaaaataattaacaattgttaggaagatcaggtatgcttacaaaagagaactataataactagaccctggctaaaatgaaaaattcattcattgaaattgtattgaattcctttatggctttacactacagataaattcattattattgattttttgttttgttttaaaccaccatgaaagatttcacaacatttaaaatagaaaactaatgagttaaattctattcatgtgagtattttgactgaaactacagaatctttcagacaaggtacaagaaattcattttttttttaagaaatggaatctagttcatcagactactataataaagacaatgaagaggaaagtttgcttgcaaatgttgcttccttaagacatgaactgaagataacagaatggagtttgcagagtttaggggaagagttatccaggtaagtaagtaaaatcacatatagaattcactgtgccttaaatacatcaatgtaaaatgtgtggatttcattatgatgtattgtttctaacctgcctctggaataagaaataattttcttatactttttaatgtaactttcagtttagggaaaaataaggaatattagagaagcctctttgcatattaaaaacactttcagtgtattagaactcagtataaaatatatattttgggctttactaattttttatgatttttttgaatcttaagtaatcttagcgtagaggctttagaaatacagtttgctagtttaaaagtaattatgatttatttaaaatttagtggaaacattgccttatgttcataactgtgaatctgcttagcagcatttcaggttttctattttcttatttaatgtatagcaatttgtagtgaataaactatccaagaactgaaatatgttttttcttttttctctagtgttagtccaagtgaaaattctgattatgcccctaatccttcaaggtctgaaaagctaattttggatgttcagcctagccaccctggacttttgaattattcaccttatgaaaacgtctgtaaaatatctggtagcagcactgattttcaaaaaaagccaagagataaggttattgtttttagacctatctagttaaaagaagttttggttttaggcctgtctacttaaaaaaaattttttttaattttaaaattaaattaaagaaaaaaattttttctttaaataccttattcatggtttccataatcttttactatggtactcaagaatttaaatataattgttctttttatgttctaacaagaaagtagttatcttggtgtattactctacttttaaacttacatatttattacctttttgcagttaaatgtcttcttaagtaaattataatccccttgattttaacactacatcttatacataataggtaatcaattgtttattaagtagttaaggtatacccaccatttaaagcctggatcaagtactttggatagtatggcactgttctcttttcattatctattttgtcaatgatgttagagatctttgcttggtctgaaactctcttcctttttcttattctatcacatatttatctccctgcatttatccctcttcctcactcaactcttttatctccttttacactctcttcctattctttgttcccccgactccctacatgtatatacacagatatggttgcacataatctttttggatatgtatttgctctttccacttcggaaagccaaccattaagagctttcctttttgtaacgaatctgcttaatgaagctgtctgaatctactttttagaaacaaattcaaattccatgtttacatggtatgtaattctaagaaatttgatctctatcctcattcaaattgctgatcattcttattgtatatgtgccttaattgggaaaacaataatgataatgccgatcaaagacaaaaggctaatctagtgtgtaaagatctcctagaaattgagaacaaaaatatcagtaacccaatgggcaaaagacatgaacggaaaaagaaataaaagtgatatccaaactaatgaaaaggtgtccaatttcactcataataagataaattcaaagtgaaactatacctaagtaccttacctagttcttacctatagaattattaaacattcaaatgtttgaggtgttattttattggtgatattgggtacgggtacattgcctagtgggaatgcacagtgatataaccccaactgagatgcatttggcaatatttaccaaaattacaaatacatttaccttgacttggaactcccacttctggaaaaacgatactgtagacaccctgcaggatatgaaattaggcattgtttatcatatcaaaagattagaaatagttcaagtatccagtaatagggggttagttgaataaactaatggtttattcatacaatggaaactatgcagttgagaagaaaaaaggagtttgtcaatgtatttattatggagagattgccagtgtatattgttcaagtaaaaaaaaaatgcaaggtgcagaatgttatatttaatgtgctagtttttgcataaggagaggagggaagtgggtaatttatattgcttatgtatgcatgtggaattaccagaagactaaacaagaaacttataaaagtggttacccacctattaaagatgggaagagacttctgtgtatactttttcttttatatagtttcaagttttgaattgcataaataaatcactcaaaataaagttaattaaaagaaatgttttgaaaatcacaatcctcatgaaaattaaatgtattgtaaaatatatataaaaagaatataataaaaatatttatacagatgaaataatattttacctattatccattttgttggtggtggacatttgggttcttcctatttactatctctggacaatgtagctatgaatagttttatatctgcacgtgaaaaagtacaaaagtttttatcaggtttatgtctagggatgatattattggttcttagcatattcaactttgctggataataccagccagtttcccaaagtgcaccactgttttccaggttatacttgtatgtacttccaccagcagtggaagagagagtattgattgttccacatatccttgtcaatactcactaagtattttaactcattttctgagctgcttcgtcattttgttaataattgctcataattttccattaattacatgtaacccttaattgaaataattgaaaatatatttgttctttttcattctttcagatgttttcatcttctgcccctgtggatcaggagattaaaagccttcgagagaaactaaataaacttaggcaacagaatgcttgtttggtcacacagaatcattccttaatgactaaatttgaatctattcactttgaattaacacagtcaagagcaaaagtatgtatcttgaaataagtttgccaacagaaaatagttgttattttaagatttataattggaaaaatattccttgtattgccacattgccttaatgtgttatgggaagtaattttcattataatactatagtatcaacatgttgtaaaatcaatattgtatgaattatatctgaaaatgattgaagggaactttacagtttttgcatttagataagtcagcttcttaaggtgttaagattaccaatttgtgtggttttattttttatacaaaggaagtataacttacttatcttcccttttaaaataacacattgtcattgttgaaaattttaaaagtagcaaaaagaggaagaaagatcacccagagtttccacctagaaaccactttaccagtttaatacgtagttgaatccagactgttttaaatagttttggtgttttctgttttttactttatatatagtctgtgcattttctgatgcatttacatagcttttccattgaacattttttatggtagcattatatttcatgtgattatatcataatttagttaataattcctgtatttcagtggtttcctatttttttactaaatgattggtattacacaaaaaattagaagaaaccaaaatgtccagtaatggagacatagtaaattatggtatacccataagatagattgcaacaaaacctttttttaaaaaaatgaggcaaatatactagtactaagatgcaaagttgtttgacttgtatggagcattataaggtttaaatgatataatatatgtagtcacttaaaacagtgtctatgtgtagtcagcactcaaaaacaattacctaatatatttagtggcagaaaaacattacagagcagtacacacatgtataatactcttagttttcctctttataagaagtgtgcatgtgtctgtgtgtgtgtgtttgtatgtaaatatatatacatgtgatatattaaggttagaaactatgcttcacactgttgataatttcgagagagactggaaggttggagtgaggctttcactatttacttttataaacattgtatacatacattatatgtagttttaaatagaggagttatgggaagactttatttttcttttctgttttttcaaacaaaacaaaatgctattagggattatttcagcacaggaaaaacaaaatgcagcaatgaacataaaacttctttggtgtttgagattatttctagggtagacttacagaggcagaatgaccaaattttagggaaataatgtttttcaagcatttacatttggttcctcatcttttcttggtcactttgagggaaaaatgctgtttttcttgatttcttacaaaatgtaccttttcagtatttctttgccatttagatttctttgtgatttgtctgttcattttttctgcttatttttaaaatttttcttcaactgtagataatctctctttttaaagtcatgattgcttagtgatttaaagtaagaaaagagacataaagataatttaataactacgaactaatagcattttgaacctttctttttaggatataaacataccagtggttatgtgagaaagtaagatactagtattgtatttctcagctcagcattttcaaagttgttgaaatattttttagggaagccacctatttcaggccatgtatgagcttttgatgttacatatatgcccactattgagactgttttgcagaaatcaatcaatatattcataacttacgtctggcaatggttgtacttactcttctggagcctggcatcctgctctttctgagctttttgccctctacacctgctgtccaactgctaccctgggacttctctttggtgttgttctaggttggagctactgtttcctgaattctattttttgttatttcctagtttattctttctgtatttggagcatatcttccagttacttccttgcctgcctgaaaatgtcttaatttcttcttcactcgtgattaaattccagtttgaaaattatttaatgtcagaatttttagggcattactcccttctatcttccagtgccactttgaaaagtctgttgccattgtgaattactttttagcatgtaatctcttttttccccccatttgtttgtttttcactttatggtagatggtagttcttaggaccttcccattctggtgttttaaaactgcacaacaagttgtctttgaataggcctttattactcatattgggtatttgagagccctttcaggctggaaacttgtatcttttggttctggaaatttttctgtttcttaatttttatttttaatttttgtgggtacatagtaggcgtatatatttctggagtacattaggttttttgatacaatcatgcagcataataatcgcatcatggagaatggatatccatcccctcaggcatttatcgtttgtgttataaacaatccagttaaactcttagttatttttaaatgtacaattaagttattattgactatagtcaccctgttgtgctataaaatagtagttcttattcattctttctatttcttgtacccattaaccatccccacctctccccaccccaacaactgcccttcccggcctctggtaaccatccttttactctctgtgtccatgagttcaattgttttgatttttagatcccacaaataagtaagaacatgtgatatttgtctttctgtgcctgacttattttacttaacataatgatctttagttccatccatgttgttgcaaatgactgattcttattcttctttatggatgaatagtactccattgtgtaagtactacattttctttatccattcatctgtgatgaacacttaggttgcttctaaatcttggctattgaacagtgctgcaacaaacatggaagtgcagataccttttcaatatactgatttcctttcttttgggtatatgcccagcagtggaatttctggatcatatggtagctgtatttttagttttttgaggagcctccaaactgttctccatactggttgtactaatttccattcccaccaacagcgtatgaagattcccttttttccacattcatgcaaacatttgttattacctgtcttttgaatgtaagccttgtttttttgtttttttttgagacaaggtcttgctctgctgcccaggctgaagtgcaatggtgcaatcacagctcagtgcaaccttgacctcctgggcacaagtgatcctcccaccttaacctcccaagtagctgggactacaggcacgtgccaccatgcctggctagtttttgtattgtctttttgtagagatggagttttgccatgttgcccaggctgattttgaactcctggactcaagcgatccacccacctcccaaagtgctgggatgacaggattgagctaccgcgcctggccctgtgatttttatttaggaggtattctcaacattattttttgcacttctattaaatcttttattttggctgtcatacttttttcggtttctgaagtttttttttgttccgattgttttgtatttcataacatactaatgtagtattctctcttagcactctgaagatttaatgatttttttttcatgtttgctttactttcctttttcttttgtttaggcctctgacttttatgttagaagcttttgggccgggcacggcggctcacgcctgtaattccagaactttgggaatctgaggtgggcagatcacgaggttaagagatcgagaccatcctggccaacatggtgaaaccccgtctctactaaaaatacaaaaattagctgggcgtggtgatgtgtgcctgtagtcccaactactcgggaggctgaggcaggagaattgcttgaacccagaggcggaggttgcagtgagccgagatcgcgccactgcactccagcctggtgacagagtgagactccatctcaaaaaaaagaagattttttcaggtgttagtattttagctattcatatttaagagaaaggcatttaaatgcagattggtggtttgttgtccagtggactttatttctgggtgatggttagggaggtggttcttttgtagggaaacacctgccagcccccaaacagtatcagtatgagatgtttttctttccctttttttttttttaacataaactcaagattttattgtcttcataataaaacaaaagataacacttagaactgggtcacttggctctttctgctcttacctcctcccagttgagaaagcttgcatcttttaatactcagcattctcttagatctgcagttgggctcagtgcactcaagccttagcacaatcttctttgtagtttcagcctttttctggaaaatctacttagtctgcccaccataaccactctgcttcctgtcatatcgacactttccctgggcatacagagaatccttgcccttcttgtactgtgtcactttctagggttggtgcttgccacacttcttacagaaagtcctgcaggttttaggaatgttcaccatgtttgcgggagtgctatcagcaaggagattttttttttttttttggagcaattgagtttctccagcaaagaatcctttagtttctcacctgtgggataacccaaaatgaaattgagtagtaaggtggggctaaccgttttatattaattcccttgttacagctgtacttcattcctgctcattactcttagtgtctcacagtctcaagcttcttctgttcagtttcttctgataataaactttctgcctctttcctagtatgccaacaccttgctattggtgttctgggagtgggaaaaagaggatgactgttacttgcagatactttgaactgtatccctggtttttcattgggtcctcacttctgccctctacagtaccttgtgccttcatgttctaaacttctttttcagtgatagttatcttattgatactctcttctataccatttagattgtgggttcccaccctgctatagtagttgtactctctttattatacagattgtagggttattatgcttttctgtatttagattcttcctagtaagcatgtattctataattaggtttttaaatcataaaaattcaataaatattttcttttataattgtttatagtttgatattttatgtttaattttctaatttatgtaaaataaatcttgctagatgcttatcaatagagattctattttctcccctaaataactcttcagttataagttgaaggtaatgccaggagcttacatgccaaggctggcttataatgatgatatgcccatgtaaatgttgatcaaaggaatagatgggaagctttatatctgaccaatgatttgggagccctattgaacaccctcatctgacaggaaaaaaactaaggaccaagtaggttaatttattttctgaaagtactataaaagttgtttttatgttttaggtttctatgcttgagtctgctcaacagcaggcagccagtgtcccaatcttagaagaacagattataaatttggaagcagaggtttcagctcaagataaagttttgaggtaaatatactttttatagctctcaaagttttattttctacttatacattttattatatcttgttaaatcttgttccccacacccaataaatttacagtaacctaatggtgttcagctgtcttagaacttgttgaatctatttttagtcaatcataactcctcttggctgtaggttgcatgtagtatataggggctaaaaagactaaggtgagatgcctatttacatgcttttatcaaacatgaattagttcatttcttcacctacatagaagtatatactcagtgtttcaaagggagttcaagaaataaaatgtaaaggagtcagacacttttattatttttacagaaagggtctcactgcgtcacctaggctggagtgcagtggtacagtatggctcactgcagcctcagcctcctgggttcaagtgatcattctgcctcagcctcccaaggaggtgggactacaggcacgcacccactgtgcccagctaagctttttattttttattttgtagagacagggtctcactatgttggtcaggctggtctcaaactcctggcctcaagcagtcgtcctgcctcggcctcccaaagtgttgggattgcaggcatgagctgccatgccttgccatcaggcactttataatttattctcttctgctttgaataaaatgggaaatatatgcatattaaataacatattactctgagtgattccgaaagtatagttaaaggaccagcagtagtagcatcacctgggaacttgttagaaatgcaaattctcaggtcttatctctggcatactgaaccaagttgggaggggtttcacaagttctgcaaatgatgctgctgcacactgaagttgtcttttatgtccatcagagttttgtaattttctttgtaatacatatattattttaaatttgtaggtattttatatttttggcaattgtgaattgttcctactttgttcattgctagtgtatgggaaggttaccgacttttgtataatataattattttgtaattggtagctaatggtattatcagcaaataaaaaaaattttgtttctgagtcaaagagtaggaaaaagaaagaaagaaaaaaaattttgtctttccttttcagcatttatactacttattaccttttcatatttgctttttgcagtgggtagaactgtcagaaaagttgttggatgtgggggtgataacagtcatctttatttagtttctgaactatacaggaatgcttctggtatctgactataaaatacgatgtgagttattacttcagatatatttatcatctggtggaagtattcttttattctttaaaaaactcttaattaacaagtgatgaatatgcctttttctctatctctttttgtatattgtttctcttaactcattgatttaaacaaatataattcctaatattaaattattcttgcatacctgggataatctctttagtagtcttaaacaaagtatcctttattttatagagaggcagaaaataagctggaacagagccagaaaatggtaattgaaaaggaacagagtttgcaggagtccaaagaggaatgtataaaattaaaggtggacttacttgaacaaaccaaacaaggaaaaaggtatgtgtttttaaagcaaatacatgtttttgaaagggaataaaaggaaatattacctatttaaaattctagttaatttttgaagtgaaaaaatttcagagatttggcaataaattaacttaatgttcttttttatctattaatttttttaaattttccattaaaatgtttatatgtggaatttatgttattagcatcctggattgggcttaatttctacaaaactgataacgattatcagtttaatgatacttatttctgaaattaagttctatggcctatttgaaaccagtacactgagtttaaaatactaacagggaaaaagcctgtaaattaatattacctctaataaaactaaataaaatgttgaatgaactctttaaaagaaaattttgcctcatagagaaagaaactcaatgcctgtgaatgtgtgcttggatcttcctttagaaatatataaatagtacaaaaatatctattttgtataaattatatcttgagatcaagtcttttaagtagctctgtccaaggaaccattaactctgaatgccagttcacttttaaactgataaagatttaaattttttgagtttaaactaataagattttataataaaataggattatagcagttgttatacagtataaagtcataatctgtactaagcaattttgcaattttgcaattttgcaatttgcaatattgcttagtagaaaatgcgtaggttttggagttagaaaatttttagattttacctctcattggctttgttaccttggccaaatgatataaccttttgaaatctcaggtttttttcatctgttaaataaagatgatattatcttgatatggatagaaatgaagagtaaatgaaaaaaagaaatgtacctcttaaaaaatactaacaatttaactattttataaactttgtggttaaatactctagaattcacacttcacttactcagataagctttgcacgtggttagttaaaatagtgagataataatacatgaagaccacattcacaatatagctgccaagaaaaaataaagaggaagagctactagtttcctctatgcaacttagataagagatgacttttaggatagagtattgactttgttgttgttgttgttgtttgagatggagtcttactctgtctcgcaggctggagtgcagtggtgtgatcttggctcactgcatcctccgccccctgggttcaagcagttcttctttctcagcttcctgagtagctgagattacaggcatgcactaccacacccagctaattattgtatttttagtagagactgggtttcaccatgatggtcaggctggtctcaaactcctgacctcaagtgatccaccctccttggcctcccaaagtgctggaattacaggcgtgagccactgcgcctggctaaatattgactttggcttcacaaagtgagtaagtgggggacagacacattctgggcagcatgtgcaaaggtatagaagtataaaagggtattattgctgaagaactcttaagtaattttatgttcttataagtaaataggtgtagtgggagatgagacaagaaagacaggctggatccagactgtaaatggctttgtgtgttataccaaaggatttgtattttaacctggaaagcataaatagccaattgagatttttaggtagaggtatgacatgaagactcttggagctttttgaagaactaaaatgaatattgactttctgctatggtttgaatgtgtccccccaattttttgtattggaaacttaatcccaacgcaacactgttgggaggtggggcattttagaggtacttaggtcacaagggctctgctttcgtgaatggattaatgccattataagagggcttgacagagggagtttgttccttttttcctttctgtcatgtcagaataaagtgttcctcctccttggaggatgtagcatttaaggcaccatcttggaagcagagagattaggccctaccaaactgccagtaccttgatcttggacttcccagcctccggaactgtgagaaatacatttctgttttttataaactacccagactatgatatttattctagcagcacaaatagactaagacacattctgagattgaaagatcagaaccttttcaaggactattgggtggagaagattaatcataatggattaaaaagccagtgtaaagaaagggagagattgtttagctttatgctgtttgtaagagattacctaaaacataaggacacagaaaaattgaaagcagactggatgcggaggctaacacctgtaatcctagcactttgtggggccgagataggtggatcacttgagctcatgagttcaggaccagcccgggcaacatggtgaaaccccatctctacaaaaaatataaaaattagcctggtgtggtggcacacgcctggagtcccagctactcaggaggttaaggtgaaagggattgcttgagcctaggaggcagagattacagtgagccaagattgtgccattgcactccagcctgagtgacagaggaagattgtgtctcaaaaaagagaaaaaaagaatggaaagaaatgtttcagataaatactcaccaaagcaaagttgatattactatattaggatcacacagaatagacttcagtgcaacaagcattaccaacattaaaatgactcatataatgtttaacacttaaccaagaagatataaagactctaaaccagcaagatataaagactctaaacttatatgtatctaataatttagtcccaaaatacataagaaaaataacacaatttcaaggagaaaagaacaaatctgtagtcatatggggaaaattctttatacatttatcaggaattgttaagtaacaaaaaattaaggcttgaagtgttgaataagacaattaatattcttgatctaatggatgtgtatatggaaccatgtagtcaacagtttgaaattgacattctttcaagcagatgtaatctgttacctcactatgctagaaagcatgaatttgaacaaattccaaaagattgatgtcgtatgtattatcttctgcaaccacagttcagttaagttagaatataactccttgaaatcctgtatgtttggaaatgtaaaaccaggcttactggtgttcattgacctactggtgttcattgaccattgaataaattagaaaacctttagaactgagtgatataaaaaatgcacatcactgcatgtaggctgtacctaaagacactcttagaggaaaaaatttaaccttatatacatgtattatatcatgactgaaaattaatgaactgaaatagactattgtgtggtcaggaaaaggaggacatcagaagaaagaatgaacatcaaaagaaaatagaagtaaggaaataataaagataaggatgaaatggatgaatagaaaacagtgaaacaatataaaggattaccaaaacctaaatgtggttattttcacaatgaacaagaaaatgggcatcagacaagattaataaaggagaaaaggcacaagtgttgggattggcaagggactcccaaattacagatttagctataaatcggtaagcaataagaaatatataagaaataaggccaataactgaatcattttaaagatgatacatttgaaaacttagactaaataaaattctcagcaaaataaaatttaacaaaactaactttaaaataaatgaaaaacctgaataaatatatgtgtgtgtgtgtgtacatatatatgtgtgtgtgtatatatatagctattagggttatcaaatcagtaattaaaaatctgcccacaaataactaaactagtcaaaacaatggtgacaaaaggaaaggaaacatcaggcccactacagcccatgatgactaaaatggaaaagactctcaaaaacaagttatggcaaggatgtggaattgaaactctcctgcatttcttttcttttcttttttttttttttttttttttttgagacagagtctcgctctgtcgcccaggctggagtgcagtggcgcgatctcggctcactgcaagctccacctcctgggttcatgccattctcttgcttcagcctctctagtagctgggactacaggcgcccaccaccatgcctggctaattttttgtatttttagtagagacggggtttctccatgttagccaggatgatctcaatctcctgacctcgtgatccgcccgccttggcctcccaaagtgctgggattacaggtgtgagccaccgcgcccggcccactctcctgcatttctaatggaagtgtaaattggtagaaccactttggaaaactgtttgtcagtagctgctaaaggtaaacataagcctgccttatgatccagcattcatttcaacaaaacttagtccctgtattaaaagacatgtacaagaatgttagagtaattttattcattgttaaatgttcatcaacagtgtaatctataaactgtggtatgttcacataattatacacatcagtaaaaaagagcaactacaactatgtaacaacatggattattatcacacatataatgctcagcagaagaagccagacacagtagaatactgtataattccatagcaaatcaaggataggcaaaattaacatatgttgttaaaagtccaaatggtgcttacctttttggggtaaagaatattcactgggaaggtacacaggggtgctggaagtgttctctatttgattgggttagtagttaagtaagtatacacattattataaacttctctcatttaggatttctgtactttactcaataaaaaattaaaatcaaataagaaaaactataagaaaaaatctacagaagatatgtatagtcttaatttttttttaaagaaatatggtattgctttgttacccaggctggagtgcaatgctgtggtcatggctcacagtagctcccaactactgggctcaagtgatcctcccacttcaggctcgcagatagttaggactacaggcttgccccaccacacccgactaatttttaaattttttttacacatgggtctcactgtgttgcccaggctggtcttgaactcctgggttcaagtggtcctcttgctttggcctcctaaagtgcaagtattataggcatgagccactgtgcctggctttaatgcatgttttaaaatgtatttggggtttgttttaatcaggtatggtaagatacagacacaggactgacatggagaaagaaatttttatacttacagatttctagaagtaggaggggcacaatatgctgttttgggatccttggggtgttgcttcacgagccagaaacctctgtggccagtggcacctttgcccgagttttactctggcccagtgggctcattctgcccactcagcctggcaggctgcgcttggctcgtgctaccaccctggatcccacacctgccaagggtgagctaggtgcagaatggcaaggggtgtgtgaacgaccatagggtccagccactatacatagccaggcatgccggctgtggtggtgtgagcagctccaggcgccagcacgggcgccagctccctgtgaggctgtggctggaccaggtatagcataagcagcttctgtggctgacaccagggaacggggtggtactggaagcttggagacaccaggaaccacagagccctaaagagggtgtcacagccctggctcgggaagctcataggtctgggctcccctgaagggctgtagctcttctctccttctcttgtcttttcttcttgttgcctgcaacgtagtgagcagggggcgtgtttcagccatttgtgttacagcattttaagccccaccattcagtgggtcctgagttcttgtcctgcatccaggaagaatgaggtaagcaaacaagtggagggtgagcaagagaagctctgttgagcgacagaacagctcagaggagacccacagtgggtagctcctctgaatggctacccccacctcatttgcgttctggtacatgtggacacagtcaatgcagcagtacccgatgtcaattgccaccttcacagcttcagttacctggcccaagggggacttgcaggtgcccagccccagtatgagcatctaggtgctgttgttgagcatgaggtagctggccgtggctgctgcactttacagacccccacctggaactgtcttattttattttatttttttttagagatagggtcttgctctgtcacccaggctagaatgcagtgttgcgatcatggctcactgcagcctcaaacccctgcgttcaagggatcctcctgcctcagcctctagagtagctgggactacaggtgtgcaccaccatgcccagttaactttttgtagagacgatctcactacgtttcccaggctggtctctaacatctggcttcaagcaatcctcctggctcagccttctaaactgtttggaatacaggcgtgaaccaccacacccagcacataacaattttagagatgttaaaaatgtgaaaacatggtaagactataggagattatttaaaaaaaaaaaaaaagcgagaacaggctggacacagtgactcactccagtaatccaagcacttggggaggccaaagtgcgagtattacttgaggccaggaattcaagaccagcccgggcaaaatagcaagaccccacacacacaacaaaaagtgaaaacaatgtgtctcttagaatagatgaactgtgatatatactatttgtgggtgtaggttaacatgaatgtacaaaataaaaaacaccaaaatcaggatagggttacctctgttggaagaagtcaggggaatgggatttggaagggacacataaggacctcaactttatttgtaatattttgtttgtcttctgtagccttttcagacaaagagtgaagattcattaaaacgtgattgggagtacatggtaatatttatccagactttttgatgtggctgaaatatgtcattactttttacaaattggaagtgaggaagagtagataagtgtaaagcggataagtctggcttgaaaagaaggataatagaggaaagcacaatacgtgggaaggtttttgtttgtttaagtgagaaatacaggtatcctttgatctgaacagtacctgtgcacactcaggaattgattatattcctacagattttcagagaagtcctttgttgtccttactttcctttatctgaaactttggagtcaaatagacgtacttaaccacatagactcagaaagttaggagtacttttacttgaacttgtttatacttgtggcaaaataaccaacagagagaatgaaaatacagaagctagagtgtatttctgaagggttaagagttaagatctagactataaatagagtaattcaccctggataagaggagggtcactaacctcacttacattagaaagaatatgatgggaataggtttaaatattaaaatatttttaggtgtgagagtgatattgaccaaatattctcaatgtattgtgccccaaattttcatttcattgcaagaagcataaggaactaagagatgaggcaacaaggttcggcttaaagagtggttggtggtggttgtgttttttgttgtctagatttttatatctggtatcaatagaagttaccattttttgaaataactatttgaaatttatttgacctttgcaaaggtcacagaatttactgagtatatttaatattctagacaatagactgattctgtaatacctaacctttgaaaatgtatcatccagcctcaggctatttccctaatctgtcttttccagatagggaaaaaaaaaattgccaacacataagaatttatatatatttcgacatttatgtttattattgttttgtgttttatttttcatattgatagagtgagaaaatttttgtagtatgatctacattcttcattttatactttaagcctaatactcctttttagtgcagagaaatttgtttctctccaattattccttataattaaagattactttggaacttaactcttcaaatgcagagcattcttcacttttattcattatctctttttaaattttagagctgaacgacaaaggaatgaagcactatataatgccgaagagctgagtaaagctttccaacaatataaaaaaaaagtggctgaaaaactggaaaaggtaaaaggcagttgtgcaaattcagtgttttgtattactgtctatattccaacagtaaaggtaggaataattaaaatatgtttatggttgagacagagagtaatttttatgatcttacaaaatcatttaaataaacaatttgtaaatgttagttaaggatgatgttcaccaacccttttattatcaggagaaacttttttatccaaagagggaaaagagtagagagaggagaaggaacaaaatacagagaaggatggaatgtgttaacagagactggagctaaagaagtagaaaaaagaaattcatttttatcacttcaatgaaaatgaagatagattatgtagctttcaactggtctccctcagtctgctactctgagaggggcttgcttctgcctctcggaaggttccttgaactgatttgatatagaaataatagtgagtttattacattcatttattatattcatttattatctttaagtaatatcacatggtaatgaaatgtgtatggaggaacaccacagttggatattcagatattgagctcaaaagagaggtctggtaaagagatactaatatgggagacttccatcttgagatagcaatgaaagcagaggaagtttatgattctgatccaagaaaggtagaaaggcagaggaaggaatgttcaggtagaagggtagagtaagaagatgggtgttcatttattaaacaatcatgaaattccttttacatgccaggtactgtgctagtctctgggagattcggtgatacataacacatgatacctatcctaaagagctcactgtctagtaagattgacaagtatgtaaacaaataatttcagtattttggaataagtataatatagaaataagaggtaggtgtggtagggtgggtgaaggtggcagtggttaataaactctggtgggcccaaagaaggcttcacagagtaggcaatgcttgagctgctaggctatctcaaagattgtgatatatctttgaacagtgttaaccagggaaaatgatcaaaatctatgttctaggaagctcaccctgatgtcatgtgaagatgcatttgagaggtgagagacaagtcaaggagactttaaaagacaaggcaagagatattgaagatgaaggagctgagtaggtagctatgagggatgttaaagttggggaatcagtgggatctagtgaccacttgaatgcattagaagcgggcagtatgagaaagaagaatataggatatttttaggttgctggtttgagtgactgctggatgattgcatcatgaatcaaaatagacagtttaagaaaaaaagttaatgagttctattttggaaatgtctgtagaatatccagttataggtaggcttttgtatctataggtctggatttagacatacaaatctgtactagggctgtagttttgagaattaacagtactgaattaaagtggtagaagccttggacattgacagagttcatatagaatgagaacaagatgaaagataccctgggagataaagaacaggtagattagcttttgaaagatatcgagaagtgatttaaaaaaattagagaatcaggaaagtataataagaaaagccaaggtgatagaacattttaaaaagaaggtggtgatcttcagtgccagatgttgcaaattggtcaagaagaatgaggactgaaccaggtgtggtggcttatgcctgtaattccagctactcagcaggctgaggtagaaggattgcttgaactcaggagttagaggctgcattaagccatgataatgccactgcactcaggcctgagtgaaagagcaagaccctgtctgtaaaaaatcagaaaaaaaaaatttagaaagatgaggaacaagacagggctattggtttttataatcagggagtcattggatactttgtagagagcaacttattaaagtagaaggcacaacctctgaaatgggagaaatggaaagggagggggtagaggtagctaacagacaattctttacatacggtaggtgaagaggaaataagtgtgtgtggtgggttgggagaggcagcgaatggaagggtagaaagaagctaagttaaggtgaagaagctgtggtaaagcacctaagggtatcctgaacatattagtagggggagattgaagatgctagaattataaggaataaaagatggcacaagggtctgaatgatatgcaagatgatagtccaagagcagaagtgagattcttttttttaatgaaataggacatttctttatgggaaaaaagtggataaaaacagaaaaaagttttaggtggaaggaaattgaacgattttgaattaaatgtctttggtctcataaattaagatgttgcttaagtgattttcatagcgtaaggaggataggagggattttggaaacttggggtgagtatttctcataatatatttgcaataaggaaagccaagaaatttgctaaacttttgagagaatatatggaaagaaaagagcagtcaggaatgatgagttaataaaaggaagcaaggaaaacaagagtggccagagtcaagtgtaatattatcatgacagctacatgataaaatattttagaggagaagttaccaacaatattaaatactgagatcaaggagaaagtctgcagttgattacaaagtggtcattcctttgcagtaaaactgtgagtatcacttggcagtgtaaaatattaaggtctcactaggtactgaaatcttttttttttaaattttattattattatactttaagttttagggtactgaaatcttaagtgtgaattagttaatcagaacgctgttttgagagctaaagagggtccttgtgggaatgaaatatcttagaagggatttttaataaggtgatcagtaaggggaggtagaagacctagtaggaggaatatgcttggggagaagaaggactttatggagaaggagagaagaatgtaagagacaggttttgtttttttacacttaggattatcaattgcaaacaatgctcagcaaagccctatagttaggtggatgtaacagggtaacaaaggaattggggcagatctacccaatcttctcctctcaacagtgtatcttgggtgcttttttctgttctacattttgggctgtggtttcgttggtaaattttgtggttcaaatttcaaaagtaacttctctggaatatttgcactgaaattaacctttagtaactcggacgcagcagctgtagatgaatttttgacttcagttgatgcaattgcctatctgttacaggttttctggacaggtagtagtgtctttttctctgtcctttgctactgcccaggaacttcactttgcttcttttcactacaaggctggggacttaaatgtatgaaattcttagtctactctcctgcttatttctgaaatcactactgacatttttagcttgaaacacctaaaacttacaaccacattagtatgtccacttaaattattgttttaggttcaagctgaagaagaaatattagagagaaatctaactaactgtgaaaaagaaaataaaaggctacaagaaaggtgtggtctatataaaagtgaacttgaaattctgaaagagaaattaaggtacagtattctgttgtagaaaaaggatttttgtgtggacatggaaaaaactgaaacactttaaaacacaatattttattgttgtaattataggcttacattatatagaaggataggcttcatgactgaaactgttttctagctatagagttagaattagaagtgaagtaaaatgtgttaatgctaataatatttgtaaatacggagacatactgatcaacatatttgctttgcatatatttagagaaaattaatagatataatgtccttgatgtataaccacattaactcactagtaaaatgtgtataatatccgatgttctaaaaaaaagtgtttttcaaatcataaaaaattacctagtccagacttctcattttataagtaaacagaagccccgagagtagccagaatttactgaaggtctgaaagatcgaagtcttctgactccaatgctctcttttagtacatcatgttgtcctctcaaaactaacacccatcaactttcagaggttaatattaaccagtctttatcacttcaaactgttaatttaaaaaaaagggggagcaggaagcaatcaatgactgatttgtctaattttgccatactttccttaaggtagtctgtttagtatttttgccaaggaggaggaagtaaagatactttttactagagtattttttagaatcggttatcgattgcaagatatacttttaagaaagaaagatgctgccaattacactatgatgcaatcctttatcacttaaaatttttatacttcatgaaagaattcttgtatttgtaattagatatgatttcttaagtcgttattttcatatttttcaaaaaagttattctcatatttcaaatataagtgaaataaattggttaagatatttttaaaacttcacatttggagtctaaccctctaaaatgtctaagtttttcctcacagtatctcccagtgtgccattaagacttgttgatgcagtatttcttaaaagaatccttgtaagaacagaaagtcattgatgctgggctcttaagctggttgtacaattatgtagagccagtttactttttctcctgttttaggaatccaaaactttgttgataatgtgaaatgctatgtcagggattttgaagttagatttcctgtcttatataattaaacagggagcagaaatgcttttaagacagtagggctgtccttccctaccatttactgtgagacactaggaaagttatataacctttttgtgcctcagttacctcatctgtaaataagaagtaataatagtgccaaccatataaagttgtgagtgcctggcatgcagaaagtaggtatttagtaaatgtgagcaggtattattttagaattaagcttcaaaaaattttaaaagtgagattaaataaatatgattaaaatgaatgcatatatattttattttcatttttattctcttttcttcataggcagttaaaagaagaaaataacaacggaaaagaaaaattaaggatcatggcagtgaaaaattcagaagtcatggcacaactaactgaatctagacaaagtattttgaagctagagagtgagttagagaacaaagacgaaatacttagagacaaattttctttaatgaatgaaaaccgagaattaaaggtccgtgttgcagcacagaatgagcgactagatttatgtcaacaagaaattgaaagttcaagggtagaactaagaagtttggaaaagattatatcccagttgccagtaagtatgtgtgattacgtaatggaaaagaagaattttactaaagtgttttagaaaagactatcattttgtggttgctttattagcttctaatttctttttctctatacttttagtcatgaatttctcttctgtctaaatctctattttttttcctgcacttaccattctacacttttccccagtttctcagatgccatatataagaatggcacagaattttttttaaacagctttgttgaagtatcatttatataccataaaatttgcctgttttaagtgtactaatctatgatttttagtaaatttataagttttgtaacaatcaccatgatccagctttgaaacatgtctgtcatccccaaaaggtattttggacccatttataattagtccctgtactcacttctacccctaggaagacactaatagtttttgcatctgtagatttgtcttttctggacatttcacataaatgaactcgtataatatgtgctcttttgcacctggtcttttgcattcttagagtcgttcatgttgtgatatcagtatttcatttctttttattgctaaatagtatttcattatatagatatgttatattttgtttatccattcactggctgatggacatttggattgtttccactttgggatattatgaataatgctgctatgaacgtttgcatacaagtctttggacatgttttcatttctcttgggtagatacctaggagtagaattcttgggtcatatggtgaatttattccaaactgttttccaaaatgtctacactattttacattctcaccagcaatgtatgagggttcctgtttctccacttccttgccaacacttgttcttgtctgtctcttttattataaccatcttagtgggtgtgaagtggtatcacattgtggtttttctttttttttgtttgtttgtttttttgacggagtctctcactctgttgcccaggctggagtgcagcagcatgatctcagctcactgcaacctccacctcccaggttcaagcaattctcctgcctcagcctccctagtagctgggactacaggcacaagggacggggtttcaccacattggtcaaacgggtctcgaactcctgacctcatgatcaacccaccttggcctcccaaagtgctgggattacaggcgtgagccaccatgcctggccctaatttacattttttttaatggctcatgatgagcaacttttcatgtacttattagaatggcatagaacttaaaattttttttctttttttgagatggagtctcgctttgtcgccaggctggagtgcagtggtgccatcttggctcatcgcaacctctgcctcccggattcaagcgattttcctgccttatcctcccaagcagctcaaactatagcacgcaccaccatgcccatctaatttttgtatttttagtagagacggggttacaccatgttggccaggatggtcttgatcttttgaattcgtgatccccctgccttggcctcccaaactgctgggattatgggcgtgagccaccatgcccggccttttatttttttgaaacgaagtttcactcttgttgcccaggctggagtgcaatggcgagatcttggcgcactgcaacctcagcctcctgggttcaagcgattctcctgcctcagcctcctgagtagctgggattacaggcatgtgccaccatgcccagctaattttgtatttttagtagagacagggtttctccatgttggtcaggctggtctcgaactcccaacctcaggtgatctgcctgccttagcctcccgaaatgctgggattacaggcatgagccaccacgcctggcctaaaatgtttttataataatggtctaccaccttttctcttttagtaatatttgtgaccatatatataaatgagattaagaagaaggtaagtaaacctattcaggaatttgtaatcaataggtgtaaaatgaaggaaagatcaggggaaactataggtaaatatattatggttggtttcagatatgaatgtatggtagactagatggtagacttaccaatgttaaactgttatgaactgtggaattatgaaccaaaaaaatctcagaaatcatctgattcaatactattttattggtgaagaaacctagacccaagaaagtaaataacttgcccaactggtaagtagtagaatttaaactagaacataagatcttagctcctctgatatctgctttcccaggatgctgtttatttgcttggatttttaatgtactgtttgcttttgaaattagaaagtaatcatatacagataacaattttaatttggcattctcatttgtgtatcaagaattatttcatatatggtcaggcacagtggctcctgcttgtaatcccagcattttggcaggccaaggtgagaggaactcttgaagcaagagttcaagaccagcttgggtaatacagtgagaccctgtctctacaaaaatgcaaaaattagctgggcatggtggcgcatgcctgtggtcctagctactcgagaagctgaggtaggaggattgcttgagtccaagagttcgaggctgcagtgagctctatgatcataagctccagtctgggtgacagagtgagaccctgtctctcaaaaaagaatcatttgagatatgattccgaatgtggtaatgtatgcttgatcgtttgtttcttgtagtgctaagaatgacacgattagaaaatgtgatttttttctacttctaggaggtgtgattcggttatagtttgaaggtagaagtcattaaatgctaaccttgctcctttttataactgtcttttaaaattctgtattatccaaacatacagaaaggtgcatatgctagtgtagcaccttatttgtaaaatttgggacacatattgtcttatcaactctatgtttttttagaataaaattttacaggtaaatcttctttgtgtaccttgtcagatcccaattatcttcctctctcctcagaaatggcaattattctgaaattcatgtgtatccttctcgtccatgttttaaatattgtcacatatcgatgcatctagaaatatatatatgttgcttagtgtttttatgaaaatactgtttgccactataatttgtttttcactcaatattgttatgagatgtatccatactgatttatgtgactcaggtttatttcttttaactattgtagttttccaattatcttaatatttcttaatgtatttatatattctcctattgatggacattaagttgtttccattaaattcatacagtttttaaaatttgaagttctgaataaaaaagcaaatgcatctcatttacataagtttacatatgtttgtttttaaacttgcagttaaaaagagaattatttggctttaaatcatatctttctaaataccagatgagtagcttctcaaacaaggaagaccgttgcattggctgctgtgaggcaaataaattggtgatttcggaattgaggtacaattttcagattctgcagttatagcaaatagaatgttttttattggtaattaagacccttaattggccgggcatggtggctcatgcctgtaatcccaacactttgggaggctgaggcaggcggatcacgaggtcaggagttcgagaccagcctgaccaacatggtgaaacctcgtctctactaaaaatacaaaaattagccaggcatggtggtggcacgcgcctgtaatccccactacttgggaggctgaggcaggagaatcacttgaacccgggaggcggtggttgcagtgagctgagatagtgccactgcactccagcctgagcaacagagtgagactccattaaaaaaaaaaaaaaaagacccttaattgaggaatttaaaaaatatacagaaaagctcagagaatattataacaggtatctgtgattccacaactaagaattgaatcttcttaaccaggattgattctccttaaaatttgtggtatttgttttaaatctgtttctccaaataaaaaataaaacattacaggatgaataatgccctttgatccttatgactagtcccatttttcccctaagtatccaccatcatgaattggatatatatttctctattcatttttgtatgtttacacacatgtacacaaatatgtaccgtatactgtgtgcaattttgctttttcactcagcagtatttaaaaaattcattcatattgagatagagtagattaacaaatggatttgtgtaattacttttaatagctgtataggattctgtcctataacagtgtcataatttatttgttcctttataggtatcttgtttctgttttctgttacaaacagtgctgcaaaggacatccttgtacatgttttcttatacatatatatgagagtttctgtagtatatattcctaacagtgaaattgctgggtcatacagtgtgtacattttcaattttactaaataccatcaagtttgtaaagtggctgaaccaatttataattctacagtggtatatgggagttttcatatcctgcctaaagagttgactaatattagaattctaattttttaaatcaacttgaaaggtgaaaaatagtacagtatgagtttttttatagaatctttctaataatttttcccttcttttcttttgtgccagaattaagcttgcaataaaagaggcagaaattcaaaagcttcatgcaaacctgactgcaaatcagttatctcagagtcttattacttgtaatgacagccaagaaagtagcaaattaagtagtttagaaacagaacctgtaaagctaggtggtcatcaagtaggtaagtatattgagttattttaataaattatattcagagttttggatgatagtttttttttaaaaaaacttttatttaaattttttttttaatttaagttcagggatacatgtgcagatttgttacataggtaagcttgtgtcatggaggtttgttttacagattatttcatcacccaggtattaagcctagtaccccttaattatttttcctgatctactccctccttccaccctccaccctctgatagaccccagtatgtgttgttcccctctatgtttccatgtgttctcagatgatagtttttaaagaacaaatttatcaactgtttggtttctattatcaaacatacttgataatctgttactagttgtggtctgataagacagcaaaagttatttcagaattattagactttgtatcattcgttaatgaagtaaaattgatatccaatagaacagtggtccccaacctttttggcaccagggactggttttgtggaagacattttttccatggaccagggacagggtcagggttggtttcaggatgattcaaacgcatgacatttattgtgcaatttatttatattattatcatattgatgttgaaataattatacaactcatcgtaatgtagaatcagtggtagccctgaccttgttttcctgcaactagaaggttccatctgggggtcatggcagacagtgacagatcatcaggcattagattctcataaggagtgagcagtctagatcctgcgcatgtgcagttcataatagggtttgtgttcctgtgggaatctaatgctgccgctaatctgacaggaggtagagctccagcagtaatgcgagcgattgggagtgggtgtaactacagatgaagctttgctcattcgcctgccactcacctcctactatgtggcccagttcctaatgggccatggactggtaccagtccgtggcccaggggttggggacccctgcagttaagatgcacccattttaatatacagtttgatacgttttgtcaggtgtttgtgttttaatgtttaactcttgttaccatcaccacagtcaagacataagacatctccaccaggatcctttgtactttttcccagttaacttttaggcttaattttctctctttttttttttttccaaaaaaaccacaaaacttttcttaaagtttagattattgattttagacctcttttcttttctcatctaagtatttaaggatagaaacttccctttaagcggtgctttgggtgtattccactactttttttaatgtgttgtattttcattttcattcagttcaaaatagttatctcttgtgatttcctctttgactcataggctgtgtgtgttttatttccaaatatttggaggtttttccagatatttttgtgtcattcatgatgatcagagaacatactgtataggacttcatttttaagaatgttttgagatttggtttattgtccagcgtatgatctatcttggtgaatgttccaagttgagaatactagtaattagaggtggtaataaatataatatgttatagattcttttacatcaagaacagagccaataaaaagtaaatagcctagaaagtgaaatattatagatgtagagaatttatgagaaatggctactgatgcaaatcttgaaggcaaagtgtatcttgtttccacatctgtgtgttctcatgtaatcatctacattatgctttttaaaagcacttctgaaggcttacttaccttggagtgggagatgtgtatgtttatagtggagaaggggcatggtcaagtaactacctctgataaccctcagtaatttttttgagacaggatcttgccatgttgcccaggatggtcttgaattgggctcaagtgatcctcacacctcagcctgttgaatagctcagataacaggtgccactgtgcctggctaccctcagtaattttttttaaagcatcactgaattctcattagctagtttggagagaaagacgatggggtcgggaaggattcactctttggagcttttgaacctgcttctgtgtgcagtacataaaaatgttcttaatgatctcaaactgtccaaataaattttatgattaccttcagtttaaggaaacagggcaacttaaaaaaaatttttacaatgatttctattaaaaaatggaatttaaaaggtggagaaggattcttacatttctggtacaaaggaatagtcttagctacctagaaaaatgagtgattcagaacttttctcctctttgttacgtatttaatttagagagcacattacttattctttgatttccttaatgaatgtctcattctctgtcccttttagtactctttagatcagaaactaaactttgtttatgactaaatctttcaactatttaagtaggtttttattcttgaagtcctattcagaacaattttccttttatgtttattagcagaaagcgtaaaagatcaaaatcaacatactatgaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaagtaagcttggaattagcttggtatatatgttaatttttgaactagaacaaaaggtattattttagggttttataaaaattatatgtttacatccagatttaaagtttttaaaaaatggtaccacataagttataaattgttttaaaattatatttggaaacctttgtattttaacttattaaaagttaaagttattaaaagtaggaaaaactgtagtgggtaaaagtctcaaatttggtggaaataatattgcattgcagcctattatttcttccatagtataagttaatatggttaatatacatttataaataaagactttggattatgctgttggaagaaaaggagtgataataaaggatttcaaattttagcaaaccccaaaccacctaggaagcctgtttaatatgcatatttctgggtcctgttccagcaatttctgattcagtatatatgggcacaagagtctgcttttttcttttctttttctttttttttttttttcttagagacagggtcttgctctgttgcccagtctggagtgtggtggtgtgatcatagctcactgtagctttgaacttctaggctcaagccattctcctgcctcagtcttccaagtatttgagactgcaggcatgtgtcactatgtccagctaagtttttttattttttatttgtagagacagtcgctgtgttgcccaggcttgcctcgaactcctggtttcaggtgatccccacctcagtatcccaaaatgctgggattactggtgtgagccaccacacctagccggaatctgtatttttattttttgtgtatttctgctgtttaaagagtctgtatttttaaacaactgcatgtaaacctgaaacaactacgcaaggaattacattctgaaaaggggataatgagtgttttgtgaatatcttgtcttcattttcactgaggacaggataagggtgcctcattaggtaattgtggaccaggaccacatgtgtatatcttatactcgatcttcaaaccagaggctgcagtcatctataggtacactttttaaatacctgctttctcagcttaaagtctatagccaaggctgaggaaaaagaactataagataggaacttatgttaataatgaagatggagatttagacagtttataactatggctaccagtttacttaggaaattgccaaatactgggattaataagttttttaaattacaaaaatagcacagtcttgttaatataaaaggggaaaaagaagaaaatgaaccattgataattctaccaccagaaataactgctgataacattttattgtacttatttcagtctttaacagctacgtaaaaatagattagggtattgtcctttttggatataggggtctgaattaaatgacttatgttttacatagatagaagaagtgatcctttgttttcagtatttgtttttcttcttaattgtcacttattttgtaaaatacttataattatgtgggttaaaaagttattcactttgcatcctaaatgtttataactgtaagtttgcccaatttacctagacacaatgtatttgaactttgaaagaggagcaggtgtttgatcttagaatgcaaaatcattacctttaaaaaataattttacatttatttcaatgtgttttcagatgacaaagaaatgttctcaacttttaactcttgagaaacagctggaagaaaagatagttgcttattcctctattgctgcaaaaaatgcagaactagaacaggagcttatggtaaaacttatctttgttcctacaaatttactgtgatttttaggcacttaatttgtgacagcacatttgttttagcatcattattataaaatatataggaaagtataaattctactaaactcttctgatcatttcttgtttatatttttaagttaataggcttatatggcaagttatccaagttttctctttttttttttttttttgagacagagtctcactccgtcgcccaggctggagtgcagtggtgtgatctcggctcactgcaagctctgcctcctgggttcacgccattctcctgcctcagcctcccgagtagctgggactacaggcgcccgccaccacgcctggctaattttttttgtattttcagtagagacaggtttcaccgtgttagccaggatggtctcatctcctgacctcgtgatccacccgcctcagccttccaaagtgttgggattacaggcgtgagccaccgcacccggccgttttctcatttttatcctaataggattgaagataatggtagttctttgatatgcttcttgatatttaaaatagtttaaatcttctcgtcttgataaagtatttttagccattttgttaaagtttgaagtataaactactgtggttctttaaagaatggagtatgacatatttaatggttgactaatgtacttttatgtaaaactgcttttcaattatactttttttttgagacaaagtctcactctgtggttcaggctgcagtgcagtggcacaatcatggctcactacagccgtgtcctcccaggcttccccctgagcgtccccagaagctatgaccacaggcgcatgccaccacatctacttagctaattttttgtatttttcatagagacggggtcttgccgtgtttcccaggctagtcttgaactcctggattcaagcgatctgcctgccttggcctcccaaatcaattatactcctttaaagtgttttgtgtttctaggaaaagaatgaaaagataaggagtctagaaaccaatattaatacagagcatgagaaaatttgtttagcctttgaaaaagcaaagaaaattcacttggaacagcataaagaaatggaaaagcagattgaaagagtaagtaatacatatttagaatatgagtgctgaaaagaaacttaaacattactagccccagcattttttattttgtagacgaggacacaaagatacacaaaagttagtggcaagagctgtaattagaatcccaatctttctgaataatttttcagtgctttaacagaatatagtatgccttctgtttcagctgtaatcattatttttgacattattaaagtaagagtaattctgtagactccatttccctaaaaatatcagttgcttgaagattgattgagaggaaaaagcagaataagagaagcactcttgaccttgggttaaaagtagaaaagaaaatttgagaccaaaaatgcaagacacagtaaaaaaaaatagatacagtagtccctgcttatccatgggagagacattccaagaccttcagtgaatgcctgaaaccacagatagtactgaaccttatatattttttcctatacatacatacctattataaagcttaatttataaattagacacagtaagagattagcaagaattctaataaaatcgaccaattgtaacaaaatactgtcataaaagttatgtgaaaacttgttctcataaaagtgtgttctctctcttatgccctagtgcctcctttgcactttttttttttgagatagagtctcgctctgtcggccaggctggagtgcaatggtgtgatctcagctcactgcagtctccgccttctgggttcaagtgattctcctgcctcagcctcctgagtagctgggattacaggtgcgcgccaccaagcctggctaatttttgtatttttagtagagatggggtttcaccatgttggtcaggctgatgtcaaactcctgacctcgtgatctgcctggctcagcctcccaatgtgcctggctcacgcagaggtgtgagccactgcgcccagcctcctttgcacttttatgaatgtaggttctgtgagtcatctttgagaacagcctagtttcgctgcaattgaagtcttgctttggatggtatcttttctccttagcttcttcatctctgctggaaatgtgacagcagctgcttcatcagcagacacagcttctccaataattttaatatttttcagtctaaccctattattgaatctgtgtaatcatcccttatttgcagtaaatgacttggtgtcacttgtttcaggggatctttgctgaagtcttaatatatactcaatattttctggtgcaacacattgcagtcagttggaacatgttttctgttaatgccttccacctacaaatttaatgccttttctattttaactaagcacttacgcattgtggttgtaacttttgtagtttgaggtacaactgccatacttgcatgaatttatttttcttcacaatttcatggatagatttattctttattgtagatcttagcaacctcagcatgcagttttttttctttcctcattaagtcaagaaccttcaccttttcacttaaaggaagcatgctatgtcttctctttgacatatccaaattggatctgcatccagatagcatcactactcttttgctttggggccattattaagtaaaataagagttccttgaacacaagcactgtgataccatggcagttgatctgataaccaagatggctactaagtgactaacgagcaggtagcttatacagcatggaaaatggatcattcttgtccagagctggacatagtgggacgtcatgagatttcatcacgctgctcagaactgcaattcaaaacgtatgaattgtttattcgtggaattttccatttagtattttcagaccagggttgactgcaggtaactgaactgtggaaagtgaaaccacgaataccacagggctgctgtaatttagatgagcttaacagaagaatggagcagacaagaggaaaaagacagtgaacttgaatgtagattaatagatattattcagtctgagcaacagagaaaaaattttttttccaagaaaagaaagatttataaaaatattgaacaaagcctcagagatatatggggaaggacctggaagatctgatattcttgtcttcagagtcaaaggagagaatgagattagtgcaggaaaatatttgaaggaataatgtctgaaaacttcacaaatttgatgaaggaaataaatttacaaatttaaaaaaatcaaagagaactacttctagacacatcaaaatccttgccaaaaactaaaacaaaaaactttgaaagcacccagagataaatgacactgcatataagggaacaaatgttaaaattactgcagatttctcatcaaaaactatggacataagaagatggaacaacattttttaaatgctgaaagagaaaaaaactgtcattctattttatatccaacaaaaatactctctaggaatgaaggtaaaataaagacattcttagatgaaggaccgcatagagaatttgtcaccagcagacttgttctaaaagagaatgctaaagaaagttcctcatggaaaaaaaatacctgagagaaacttgggacctcaggaataaaggaagaacaacaaaaacagtaaatatttggtaaatataggatttttataatatctatggcagttgaaagaagaaattataacatttactgatgaggtatattgatataatacatgtgacaacgacagtgtaaagggggaggggtaaaggggtctatattcttagtttctacattttgcctttttttcttcagccgttaagttcaggggtacacgtacaggaggtgcagatttgtcacataggtaaatgtgtgccatggtggtttgctgcacagatcatcccatcacttaggtattgagcccagcatccattagctattcttcctgatgctccctctctcccatcccactcccctataggcctcagtatgtgttgttcctccccatgtcttcgtgtgttctcatcattcagctcccacttataagtgagtacgtgcagtatttggttttctgttcctgtgttagtttgctgaggataatggcttccaactccatccgtgtccctgtaaaggaaacgatctcgttcctttttatggctgcatagtattccatagtatgtatgtaccacattttctttatccagtctatcactgatgggcatttaggttgattccatgtcttttctattgtgaatagtgctgcaatgaacatacacatgcatgtatttttataatagaatgacttacattcctttgggtatatacccagtaatgggattgctgggtcaaattgtgtttctgcctctaggtctttgaggaaatgccacactgccttccacaatggttgaactaatttacactcccatcagcaatgtaaaagtgttccttttctctgcaacctctccagcatctgttttttgactttttaataattgccattctgactggcatgagatggtatctcattgtggtttcgatttgcatttcttgagcgatcagcaatgttgagctttttttttgtatgtttgttgtccacatatatgtcttcttttgagaagtgtctgttcatgcaagtgatttcatttcttccttaaaaagagagaagctgaagacaatttggcaaaatacaaaaatctatgtaatttcaattatagtgtcacatgtatttaatatttaaaatgtttcaaaattttaaaatatttaatatgaaaattctgttttcatgtttagcttgaagctcaactagagaaaaaggaccaacaatttaaagaacaagaaaagactatgtccatgttgcaacaagatataatatgcaaacaacatcatcttgaatcactagatagactcttgacggaaagcaaaggggtaaaatcatccttataaaagtgctatttagaagttgactaatattttatgtctctataacttgcctttaaatctaatcaaatctgcatacttatacttttcttactgtttttaggaaatgaaaaaggaaaatatgaagaaagatgaagctttaaaagcattacagaaccaagtatctgaagaaacaatcaaggctagtatgctaatactttatttttctttctttccttttttttttttttaacagacagaatctctctcatttgcctaggctggagtgcagtggcatgatgataactcactgcaaccttgaactcctgagctcaagtaatcctcccacatgagcctcctgagcagctaggacaagcgtgcttcaacatgcctggctaattatttttttctatttggagacattcttgtggcttttttacttttctctgtaaattgtaaacattgtacagataaaaggcaattcagagctgacgatttgatctgactcaatgaacttagttcctttaaatgtattttctttagagcgaattatgatcttaattatttgatagttaatcatctagtttgcaggttatctagcctctttttgtcttaaaacagtttttataaccctaaaaattgttttaaattttagctataattgctacttattaacattaccaaaaaaaaagaaaattaccagaggaagtggaggaagagaaaactaaaagtgattcaattttgcttgtttttatcagttggcttgtaagattaattgagataaagccagaatttctagctaaaatacggctttctggctagtatatcttcatggttaaaaacatgggctttgttgttaaattgggtttcagtgtggcttcaagtgcttacccactcactgtaaccttagccaggttatttaactctttgaactttaatttcttcatccacaaaataggaatgacaataccctagaagagcattagtgtgagaattaaatgaaacagggtatataaagtgcttagcacatactgagttgcccgaagttttgtaactaactgctatatatttagtattttctcttgcatttttagtgttaaacgtaggtccaaatatgctatgacgtttattctgtcatatgtagcttgaatataaaagatttgctttaaagatacgatgttattttttccctattctgtttttaattcattttgtgactgtgtatgcccatgtagacatgtgtttattcataaatattcctgtagtattcaccaaaactcttaacatttaatgcaatgtcagttcatttccctgtgtaagaatagccccaaatttcattaatattaaaaaatgattactgtacagagattgtaggcatgaaatacttttattagataaaactcatgcagccacttaactcctggttttcattaaactacctaacgtaactgggcagtcatctggtgaggtatttccgtgtgttaatagccagatatgagatggaaaagaaatcagcaaaagaatgaagtatgatgttggattttattcctttaacatctttagcaggtttgctgtttggggaaaaatcaaaatgagtaagaaatatagaagccaaattcctatgatttaagctatattgactgattctacacataagttatttatagcagcaaaatagaagcctgaagtctacttctctcctgattatgtcattactaccttcctttcatgacttttgttcatgtctctcaacatgcctcaacttgttctctgcaaaagaaatatgaatttttttatctataggaaagttataagggtcagtttaaagttgtatcactaagctaaaaggttgatgataaaattctgaactggtaacaagaaatcagtaaattaaaccagttgttacctgctgttaaatggaaaattgaaaaggtgcttattagacttacagattttatttcttttgttttgttttcctcttattttctactttagattccccaaaacccccacaaaaaagtcttaaacataaaagaagagtttaccttctttttttgaagatgcatagcctagggccctatctggttgtctccagattgtgcacctgaggagcttctttggttcagcagagtggtgtttgtttttgttttgatttcatttatttatacacacacacacacacacacacacacacacacacacacacatttgcaagtggtttgtatacaatgcaagatgtttatctgtatgagattcagactttcaaactctgttcaaataagaaattcaatagagtagcggatgttttgggtttttaattagttttttattagctataattgatttatttctaatttattttttaaaatttcaagcccacaaaaaattgaaaaaatagtctactcctcacctagattcactctctgttaaactctattaaactctaggtacactcactttatctctctctacacatacacatgcatgcatgcttgtgtgtgtccctaccaacccacctcccttttgccaaaccgcctgagagaaggtacggatgtcataatactttacccctttaatacttaacatgcatctcctgtgaacagagaatttcttctgtatggccacaccaccactacactacagagaaagtcaacattaagttagtaatatcattcaacattgtccgtactaaaatttccccaattacttaaaattgtcctttatagccttgctactcaaagcatggtctgtgaactagcagcatcagcatcacctggaagctttgaagagtatctagccatgccccagacctgattcaccccagtgaatcaagtgtgatgacacaaaatttaaggagacactctcaggattatataccttatttaatttgatgactgccagatctcattattttaagggcatacattttcattgataattagcaaactaactttggggtgagtctttgaggccatgtgaatatcctgttcctcaataaccttataatcaatggctttcatatctaatgatgaatcttgcccaaatgagttattacactgttaactattaggtagtgatattctgacagaatcataggttttatttattttctctgtgtgaaggatgatacaagtcccaatgcccattctctttcataaaaaagaaaatttctaagtatttataattttcataaaacaaatgttaattagtcattcagaattacagattttttagctgttaatgatttcatatacagactataagggtggtgttcaaaaactgtgtatcttataagattccctttttagaaataagagtggcaaagataatttcatgatgtagaatagaatctgcaagagagaatgtttttctcgttttttcatctgctaagaaatctaagatttctttcactttttcaagactgcttactagaacattattagcattaagaggaagaacaccattgagaagctcaaatttacaataaagaaaacaaggagcaagacaagaatcttaatagatgagatgtggagcatgtatgcaatatgtgcgccttgaacgaaaagtaccaaatttgagttgctctttggtattaaggtagtaaagcagtggcaactatatgaacacttggaccaagttaaattgctgcctttctgaaaatattttcactgtttcaaagcaaagaaggtttcacttctttttttctagctgacaaattattttcttagtaacttcagcatttcaaaatattctcacttaaggccaggcaaggtggctcacacctgtaatcccagcactttgggaggccaaggcgggtggatcacctgaggtcaggagtttaagaccagtctggccaacatggcaaaacccactctctactaaaaatacaaaaatcagcaagacatggtggtgcatacctgtaatcccagctactcaggaggcggaggcaggagaattgcttgaacctgggaggtagaggttgcagtgacccgagatcgcaccactgcactacagcctgggctacacagcaagactttgtctcaaaaaaaaaaaaaaaatctcacttaagcatcattaacagtatgctagtttgtactcactttcctatttttcttattcaaggaggcttaagaagtaggtttaaataccacttaccttttaaagaaaagtttttagagtgtttggcctacaggttcttgacagttggccctagtttatcttgtcaattgtggctcccaaataaccatttcctacaaattcatcttcttactaccctaggcttttgccaacttctcaccactccctttcgcagggccttgcttctgagcatactcccttttcctggaatgcccttctaaacttgtccaactcttgtttattcttcaggattccataccttggttttctctttggtttcctcatttgcaatgaagaattagtttactcaataaatatcttctataatggcattttatatcctaagtaggactgtatattcactatttgaagcagtcaggtaacattaggagataaatctgtaaaatattgagtatatcgttttgtgttttttttttttttttgctttttttcctgcttaggttaggcaactagattcagcattggaaatttgtaaggaagaacttgtcttgcatttgaatcaattggaaggaaataaggaaaagtttgaaaaacagttaaagaagaaatctgaagaggtaaattaacatttactttatatatagcatatatttcaagtgattttttttaagaagcatgagatgtaggacaaaatatatatatatatatatatttcttttgagacagcgtctccccatgttgcccaggctggagtacagtgtcgcaatcttggctcacttgaacctctgcctcctgggttcaagcaattcttgtgcctcagcctcctgtgtagctaggattacaggtatgcactaccatgcctggctaatttttgtatttttagtaaagatgggatttcaccatgttggccaggctggccttgaactcctggcctcaagtgatccacccacctcggcctcccaaagtgctgggattacaggtgtgagccactgtgcctggccaaaataatatcttttatgtatctgatataaaaaagtatttccaataaaatgtaaattccaattttattttctttaaagagcaaacatttcaatgcaaaatagaatataccttaaaattctaattcttttatttttagggaatcagaagaataaattattaatattacagtcattctaatataatattacatgacaccttgaacattgttttagatttagaggtttaaaattcttcaagaatttttcattttgtttttgttcttgttgtctgtaggattgagaattaactttagaatttcaacttttttaagataagtttctcagatactgcattggaaaccttttttttttttttttttttttgagatggagtcttgctctgtcgcccaggctcggctcactgcaacctccacctcctgggttcaagcaattttcttgcctcagccccctgagtagctgggactataggcgcatgctgccacgcccggctaattttttgtatttttttttttttagtagagacggggtttcaccatgttgcccaggctggtcacaaactcctgaactcaggcaatcctgccaccttggcctcccaaagtgttgggattacaggcatgagccactgcacccagacttggaaacttttcttgaacatcttactcatctctgtatgctcaatttgtagcactttactttggttaggcactcactaaacatttgctcaaatggataatcgtaatgaagaatgtatttgttagaatttataatgtatatattttaaggttaaaatttatttttagaaatcgttcccaatgaatcttcatcaaggttgacttttggccactcattgttgctcacgcctataagcccagcacttggggaggccaaagtgggtggatcacttgaggccgggagttcaagaccagcctgggcaacatggggcaaaaccccatctctacaaaaaaattaaaaacattagccaggtatggtggtgcatacccgtggtcccagctactcaggaagctgagatgggaggatcacttgagcctaggaggtcgaggctgcagtgagctgtgatcacgccactgcactccagcctgggcagcacagcgagaccctatctcaaaaaaaaaaaaaaatatatatatatatatatttatttatatttacatattagtcaagatcgatttgactatatcagaaaggtccaatgagaaaaacagaagcctttatatcttttaaatagagcaaatttatacagagaattagatacacaggtgatgaaagggtagagaagccaaacagtataccacagtgactcagagattattataagcagggacccgctaccattgttaaggttagaggaacatcaggaaaagatggtgtgatcatagtctagaagcagggctgcctatctggagctggggccaaagaaaaaaggtctgtccaataggaactggggcaatagaggaggagcactgcagctactggccattcccattggccaaacctatttgtaatctagagggcaaaggaggccaagaaatgcagtttcctgcaatacacagagcagaacaggggaaagccataggtaaatctaagagtaaataatgtagttgaccagcactccagacttaggtgcatcaagtaattatatagccttagaagtttaaaaaaaaaaaaaaaaacttcagatttaatacggtcatgtcttcttctgtctaccttcccttatgaaggtttttatagcatctttgacaggcatatatttttctactccaatacatagaaactaaatcatctaaactgtatgtacttggatttttaaaaataggaatgtccttttttttttttactatgatcatctttaaagtagtatacaaaatacattattttggcatttattctactgcccatacccacactccgcttcataataaatagacttggcagagatggaatctacctggaggtaggcagcatttgtaacaggagaatctgttgagctttagactttgcattcatagaaacaacatcagagactagggtggataacagatatttacacacaaaataaatagaacgattttttttttctttttttgagacagggtcttgctttgtcacccaggctggagtgcagtggtgcaatctcggctcactacaacctctgcctcccaggttcaagcaattctcctgcctcagccttcccagcagctgggattacaggcatgtgccaccacacctggctcatttagaatgatttttacaactggaaatacatacctaggctcaaactgaattagaaaccagaagtggtaatcaggtatatttgaccagactagggagtaagtaaattagaaagatttgcaagctcatttattgccgctcaatccttagctcaactgcacatgcattggcttgcttacttaaaaggtcatctgtcacatgttcatgtgtattgataaaaaacgtggagaagaatccaagtactaactgttgacttatttgcctttacagcaaattatgtcttacagagaaaattctttctaatgttggttaatataattaacaccttgtaacagcagagttgtgaagttttcatcatatatagctacattttagaaaatctgatttgagtaatagtgcatccattccgttaataataggtgatattataaagatgttcttatcttttaaatcagggaatatgccccaatcatataactcactgaataattaagtggccctagggcatataggtagaaatttagccagttgtaaaaactacatgttgattacccgttgcaaaaagctaatatatgttcctctgagcttttgcctcagccacatattcttttccggatgttgaaataaatatatttatgatgaaaataatactttggggttctgaatttttggaagatatttaatttcatattaaaatgtttttaacaatgcttttaaaataataaagttatgtgttcatgcaaaattacattgtcaacatgataaaagaaactcaatacaaagtagatgcgactaagcctaaatgttttctgcataaagattttattcaataaaatcagtcgtttcattgataaatatcttcatttaaatggatggacttagattttgagaagctggcatcatatttctgcattatattttatttttaagcaacaattatgagactttctgctttgggtacatagtgatactagataaagttaagtgtaaggtagattttatcatctaaattctactttcttatttacttcaattataaaatattaagtactctgggaatataataatacattagtagaaaatatgatgtaaaaacaatttgttctgtatttacttttaaactaaagccaactggccaggcacggtggctcatgcctgtaatcccaacactttgggaggctgaggcaggcagatcacaaggtcaggagatctaacacggtgaaaccccatctctattaaaattaaaaaaaaaaaaattagccgggcgtggtggtgggcgcctgtagtcccagctacttgggaggctgaggcaggagaatggcgtgaacctgggaggcggagcttgcagtgagccgagatcgcatcactgcactccagcctgggtggcaaaggaagactccatctcaaaaaaaaaaacaaaaaactaaagccgactggagttaaaggtcagtacaatgaaatgtcagtgtaagtttgatagatatatgttctattttgtaaatatttgtgataactaattttagctatttcaatatatgtaattgaaatgtcagtgactagattactgaaataaaattttgttgttattatgtggtaaggctttgtgttttggttagatcttatttttttcttctgttttgtcttattttaatattttgtccatttttttctctgaataggtaagtatgaaacaggatgttccaataaagaaaaaaagagtatttaaacctgtcttgcaggcaagtcagttctatctaaaataaaccagtgcagaagtgtgatctgcaggtttggtcaggagctaagagagaaaacaaaacaggtgatactgacacatatttacactaaattattttcatgcagacagaattaaacaaaacatatttgcatgaaaagggattataattcaggattagagatcagttagttgcctgtgatatccagggttacttcgagtatacaacatcatcatataattaagaaatctgaaatctcagagcttctcataatgagcaaagaatatttggccctgaaggccttaatgttcacctgctggatagttagaaaaaagaagcaagtcgtgattctcttccgctatttactataaggagtttaaatttccttttggaatgatatttactggaaagattctttgctttaaaggaatggctttattttccttcacttaaaaaatttattatataagcaacaacaagaaaacttctaaagaacatttacctacagcccattctctaatacttcagttttcatttttctgtttgcatgtatatttttcaaaattatattaatgaaatgtgattttttaactttataaatttttatgttagctgtctttttaattattttaaatggttgcacattttaaatcacattgacaatcatcacttattaaatcttccattcactttggtaggagatgaagaatattataaaatatattttaaattatgtttcattgttgatagtattttaaaaataatttctgctggcatatttttagaatttggattactaggacaaagggaatttatttttcttcttaataggtgctcttggataaaagtatcttaaagcaattttggagaccatcatattcaagtcctaaatatatagagtaattagtgaaatttcttagttgttattgtcattcctttatgtgtttttttgtagcataaatattcagcagtgctttgctgggatattattatataaacaacagcaataatagcaacaataacaataaatagcaccaaacatcatatagtgcttttatggctctagtttattattagaaagggtgaaagaatcaggtgaagtgcagataaaaccatggctgcctatgctgttccctccttctgggagaggtcagacagaacatgctcctttttatagcagtaaaatgtggcaatatctgtttctgcctagggaagcctatttatgactcaaagttcagggtttttattgggggcttgtcacacaggaacaatgaccagcctacaagtatcaaaaattccagaattctaaaggaaggcatgtttcagtgccccagccaggcaaaacaacctcatcacttaggaacatttttaaagccacatttccagacaccaaccaagagcaatcctataagcaagcccttccagtacatctccccattagaaaaatgaatactgtccttccaatgacaaactatagacatgaatgcaattgtcccacatgacaagtggatggttatctaataaggaggacagctttgacattttattgccatttatttgaaacattgcattgtattgagagatatatatatatatttgccaggtatattgtttacagaaagagctaaagataaaaaatcacagtcttcaagagacttctgagcaaaacgttattctacagcatactcttcagcaacagcagcaaatgttacaacaagagacaattagaaatggagagctagaagatactcaaactaaacttgaaaaacaggtatatattattagcccaagattgttttatttgtatgaaatagaaatttttaaaatcatgaatagatttttcgttagttttttaaattgctgtttggccagatgccgtggctcgtgcccataattccagcactttgggaggctgaggcaggcggatcacctgaggtcaggagttcgagacgagcctggccaacatggccaaacctcgtctctactaaaaatacaaaacttagccaggcattgtggcacatgcctgtaaccccagctactgaggaggctgagacacaagaattgcttgaacccaagaggtggaggttgcagtgagctgcaatcgtgcccttgcactccagcctgggcgacagagtgagactccgcctaaaaaaaaaaaaattgctgttaaacctcaaggattttgcattataagaaatactctatactgatattgtaaaataaagttctattcctatgtaatctgacctccatctcttataccatgattatatgtttgctgttccatacaatttataattcatgtttctttattcaatctctcttcttgtacctaatctgaatacctataatttttcctttttggatcaggacatggtatgtgatattccttaaagaaatggcaaagcagtgcactaaaagaaaaatcccaagggaaaatacccctgaaagttctaaaattaaaaattattacttacttgaatgtaagaattctagagaattttatactagaatctaatctttttcctttaattcattactgaatttatctgaattctttagatattttacattcttattttgttttttctttgaaaagaaatcaaatttacagtaatgtgtaaattagaaaatgatcgtcccctgtaatcttactgtattttccttttttgtcattttttcggtcttttatctacttgttctgaagtcctcctcagcctgtccagtggaactaaagtatcttcctctcactacatttaaacacatcaggcaggtattctgtattttttttttgagacggagtttcactcttgtcacccaggctggagtgcaatggcgcgatctcagctcactgcaacctccgcctcccgggttcaagcgattctcccacctcagcgacctgagtagctgggattacaggcatgtgccaccacacccagctaattttgtatttttagtagagacagggtttctccatgttggtcaggctcgtctcaaactcccttctctggtgatccacccacttgggcctcccaaagtgctgggattacaggcgtgagccactgctcctggcctctattttttttcaagagacatcttcctgtgactctccatcccttttgttaaaatttagacctactgcttgctatgcctactatacagcttcatcctgaagcatttcttcttctcatctatgtttgattcccactgcctacatcctttgtcattgactctggttcttgcaggattgattatgattcttgttcctaactcacttctataatggttgtatggttttttctgttttgttttgtttttttttaacaagttcacttttttttcttttttttctctttttgagacgtagtctcactgtgtcgccaggctggagtgcagtggtgcgatcttggctcactgcaacctctgtctcccaggttcaagtgattctcctgcctcagcctcccgagtagctgggactacaggtgcgcaccaccacatccagctaatttttgtttttttagtagaggcggggtttcaccatgttggccaggatggtcttgatctcttgatcttgtgattcgcccacctcagcctcccaaagtgctgggattacaggcgtgagccactgcgcctggcctcatttgtattttttatttggtgattttctttgtgatcttgttttaaaagattttgtgttctcattagcttcactgaggtctacagaagtttatatctaaaaatttcttcagtatttggagtaaatttttgacttggtattccttttctgcctttcattcatattacactgtgcataggttccattttgcatcttcagatttctctatttaattaagaattgagtaggtggattttccttggttcctttccctttttacctgggtactgttttaattttcttcttgaaacttgaggtggaggggtggatattaatggggttttcttgttttgttttgttttgagaccgggtcttactttgtcacccaggctggagtgcagtgacatgatcatggctcagtgcagcctcaacttccctgggctcaggtgattttcccacttctgccttccaagtgcataccaccatgcccagctaagagtgtgtgtgtgtgtgtgtgtgtgtgtgtgtgtgtgtggcttttctttttttttcttttttttttttttggtagagacagagtttcaccatgttgcccaggctggtctcgaactcttgggcttaagaaatccaccctccttggcctcccaaagtgctgggattataggtgtgaaccaccgcacctggcaagatattaatggtttatgatctatatttagttcttcagtgagggattttagaagaacgggggatatgcaggtcagagttgagaggttaactttgagaccacagtcatataaatattcatgaagacatggagtgactgaaattacctagggagagaatatagaatgagaagcaagaagattgacttggacagatccctgagggatgtgatacatggaagccaaagtaagtatttcattaaggaaggaatgaatgttgctgtcatgggctactggaatcagtgtcaagtaaaatgaaggttgggaaatgtccattggaattagcaacttggaagtcactggtgttgtaatccctgtttctgtggaatggcctctggctatgggttgaagaatgagaagtgagacagtgatacaacatgcatagaaaactttgagaagttgggctatatatgggaggaaataaagggtagtaggtagagggaggtcaaggtctgaagaaaagctttttacagtgggaaagtcttttaacatgtttaaatgctaatattaaaaaaacagtagagagactgaagatattggaaagaggagatagtagtatgaagttcctgaaaaaatgaataggaattgaatccacaacacctatgaagcagtttgatttatataaaggaggaagaatacctcctttattgtagtagaatagaggaagaatgaataggaacagattcaagttaagatgggagcaaatgcaaattagcatttgaggtcatgtggaaatctaggaatctattgagtgagccaattcgtgaagaaaagaaaggagcagtatggtaagagaagaaagggcatttcaaatggggacaatgaaaaggggaatatttactatcattttgttcaattattttaacactttagtgttatgatgtggccacttccctaaatagtaatatgtatgtgaagtatctttattattagaaagtaagccttgctttttatattttccaaacattacttcttggtctatatgttgatttttatgatacatcttgaaactgataagctaggttacatatttataaaagtatttttcttctgaatttaaaatgtttactgaaaactgctttacaaggtgtcaaaactggaacaagaacttcaaaaacaaagggaaagttcagctgaaaagttgagaaaaatggaggagaaatgtgaatcagctgcacatgaagcagatttgaaaaggcaaaaagtgattgagcttactggcactgccaggtaaaatgtgaatatgttttatttaccttcccacttcaatatcagtggtatctgagttttgaaatcagataatgttcagtggagcatttgcttgaggaattaatgtctccatagtctgtgttcctattgcattttgtttgtatttccttcatatctctcattatgctttttactgtattacagtttaatgcttttaaccttcctactataagtttcttaaggcaaggatcatacctggtttattttagggtcttacacaacaactggcacagttccttatacctcataggcactcagcaactgttaattgtgaataacattaaaagttgtaggcaaaaatgtaaatgtactcacatagaggaaactttcaggcaatccaattatataggggaagaatgacaatataaaagtggttctcagccttgagtgaatattaaaatcacctcaagagcttgtaaaaaaacatactgatgactgggtcccacttttagattaaataaaacctaaagattctgatttaatttggctaggctggtcccaggcatcgatacttaattggtcaagaaaggaacccatgagctgaaagcagtacccagcctcttcagatctcttctactttgttgggaagaattgacataatttataacataatcagcccacccttctaccaacaggagtcaagagtgaacttaggcactggcactaaaaccacatgtccccaggttccctctcctccattgacaggggtcctttgtgctcagaggagcaacttgcttcctcagatgtctgtcaccctctcagcagggttgagggcttcccaagtttaagactaagaccaaagtatttcacaccttctttcttccattgacagatgttctactcactaacatggcctcaccactggtgtccaccttgagtctgtgaagactgactgcattatcactttatccttgtttatgccagataccacaagaaaccctagatttccaggtcagctctcatatctcacactaattcccaaaaaactctccacacattctgtttctttctccaaccccatcccaacttctgaaagacttctactgtgccttttgaacttcataatccattctctgtattcactactttttcttttctcttgctgtaatagaaacctggccctcccctaaggacattgcttcttcccctgtagccttctaaagtaaaaaacttttccccatagctcttgtaccacagggtccaggcaaggtgtgaagtatatactatacttggtgaacctcatgccatcagaacccttactggtgctgatttctttagacggcctgacttactgttgccctctccagcatcacttctgtcattcttcttggggatttcagtacacctctgaagctgatccttctgacaccttggcttctcatttttaacaatttctgtactctagtgatcctgatctttaacatacctcagccacttactcccatggaatttatcttgtgctgaaaatttaaatcaaaaccaaataacattttttggtagaaattttctaaaatgtatattttcttggggtttttactttctctgggtatctcagggttatcattatatacatcatgctaaaatgtagtgataccctaatgaaactttgaggcatatacagttctgttttttataaaatgtctgtaggctgctaatgctttttgagtccttgtatattttctataattttcccctaactcctttgctgacaagccatctgctcatggctctatgccaatctcttttgattattcttttctaattatctgttttatatctactttaatattagagctaattggtcaagctaaaaattatttacttgggattttagaaatgtaaaagtgtcattagcactcatctaatctagtacttaattggtctatggacatatttgaggatctggtaaaaagctttagcttgtcttctatacatagatgtatacatgtacattatacatgtataattttgcatactgtttcaggggttttatagttttccttaagtttactcatggacttccaattaaaaaactcttgaacaaatccaaatttgttgaagttttatctagaaaagaaatgctcctacttgcaaactcaatttagaaatttcaaagatcaaacaacagaaagtgttgacacaaaggaacatgaactcttcctaccattgagggtaacattaacaattgtttaattagtaaatatcactttagaattaccaacaaagggacttaaaactggctcttagtatgttgatttgtctgtaggggagctgccgtattagaataagttcaggactgacaaagttagtaaacctggccctatcactattaacagctagttgtattatctcagacaactcacctagtcttcagtttcctcctctgtaaagcagggaagttgcactagtctaggaatctctagttccttttaaagctaaaaaaaggatagaaccaataataaaactgagtaaaagcaattgacttggctctccagtgagtaatatggtttttatggtgaataatttgattgtttggcttatttattttctttgttgctaataacaaaaattcctagatgaatgaggtccttggatattttcaatacatgcaaagctaaagttaaatgtggttagagtgaaaagaatgctaggcttgttaaatattaccaggtagtagtagtaaagttgtatttagtggtatgtaatgtgtaaaggaatagtttttagttggagaatttttaaaaataggtgatttaaaattccaactagatattttgctgatatttgtccttatataacttgcaggctttttttttagtcagagacaagttagttggttaagtttctaaattacctgttttattatttgtttttaattaggcaagtaaagattgagatggatcagtacaaagaagagctgtctaaaatggaaaaggaaataatgcacctaaaacgagatggagaaaataaagcaatgcacctctctcaattagatatgatcttagatcagacaaagacagagctagaaaagaaaacaaatgctggtaagcaagtggttagatgagtatagctgcctatgtatttgtacttaacgaagtgaaataatgtgagaatttgagatggtggggctggaagggaaaataagtggtattttgcctctcgtagatgaatataattgaatattcttaatatatacaaagtttgtaataaatggtttacatatagttataaaattattctctcctcttaatagtaaaggagttagaaaagttacagcacagtactgaaactgaactaacagaagccttgcaaaaacgggaagtacttgagactgaactacaaaatgctcatggagaattaaaaagtactttaagacaactccaggaattgagagatgtactacagaaggctcaattatcattagaggaaaaatacactactataaaggatctcacagctgaacttaggtgagttaaataataagaaattatatcacagttataagtccttggataatacaataaaatatgttgttgcattctagacgtctaaatttctcaactgtctttggctcactttggctcatcccagccagcctatcccatgccttatctaactaattcagctgtctttgttggccgccaaaactttcatcctcagtctttagaccattttatactagccctagtggtaaaaaatcattgggcatgcatacagcagtggctaacagcaggaggatattaataatgataatattgttctttgtattaagtccttattttatgctaggactacgccagggacttcacatatgatctcactcatttccttacaacacacctattagaaacatatatcacctttttaatagttgagaaacctgaggccttgagaaaaataaaatgccccaagtcatacaggtagtagagtctagagaagggagttaaacacaagtctgtccaactctaaagtctgggatcttagattagcagtataacataaactgttatgctgacacacatgtatagtgagtggaggtgtacagccagattagagccaaagtatgagaaataggttcagaaaaggaaaatagaattacaaattaggatgtaaaatgtgaaataaaagaacaggataaagagcagcaagataacccagaaacttagatactgtaccacagaattcagtgtagggcctccttctcttctgtatccacaaactcatccttagtaaatttcatgtagctttaaatactatgtgtcagacacttccaaacccatttctccagtattgaccttttcctgtaactccagattcaatatccaactagttgttacctccattcggatatttttaagaggcatctcagacttagccaaaataggactcatattttctcataaccctacccttctcctaactcagtatcatgcagttgctcaaaccacaaatatataagatttttcttgttctctctttccatcccttttttcatccagtgtattagcaagccatgtcaactttatttccaaaacatatatatatattttttttcagacagattcttgcccaggttggagtgcagtggcatgatctcagctcactgcagcctccacctcctgttcaagcaattctcctgcctcagccaccaagtaactgggattacaggcacctgccaccacgcctggctaatttttgtattgttaatagaggcggggtttcaccacgttggccagactggtcttgaactcctgacctcaggtgatccatccacctgggcctcccaaggtgctgagattacagacatgagccactgcacccagccccaaaacacattcttaaatccattgatttcgtggcctcttttctgttatccttagcacaaagcatcatctcttacctggtctgttgctgtggcttcctagctgggctctctgcttacaatcttgaccccctcccaacaatccattttccaaaaatagatttaagtttattatttaaaacataaattagaccaggcgcggtggctcacgcctgtaatcccaacactttgggaggccgagacaagcagatcacaaggtcaggagtttgaaaccagcctggccaatatggtgaaaccccatctctactaaaaatgcaaaaatcagccaggtgtggtggcaggtgtgtgtagtcttagctactcaggaggctgaggcaggagaattgtttgaacctgggaggtggaggttgcaatgagccaagaatgagccatgatccattccagcctgagtgacagagtgagactccatctcaaaaaaaaaaaaaaaaaaaaaaatagatcatattgcttacctacttaaaccttctaatggctttctaaaaccttcagaataaaatccaaactccttcacaaatgaaaataaaaactacattgatatatcacttcataccaaggatggtcatttttaaaaaccaaaaaatggaaaagaacaagtgttagcaagtgtagaaaaaaaatgaaaccctcattcattgctggaggggatctaaaatggtgcagccactgtagaaaacactttagccttcctcagtaagttgaacgtagaattaccatatgactcagtaattccactcctagttttgtactcaaaagggttgaaaacagatatctaagcaaaaattgtatacaaatgtttacaaagtaagccaaaaagtgaaaacaccccaaatgttcatcatcagatgaatggataaacaaaatatagtgtcttagtccgttttcatgctgctgataaagacatacctgagactgggcaattcaccaaagaaagaagtttaatggactcacagttccacgtggctggggaggcctcacaatcatggtggaaggtgaaagacacatctcatatggtggcagacaagagagcttgcgcagggaaactccgctttataaaaccatcagatctcttgagactgattcactctcatgagaacagcatgggaaagacctgcccccatgattcagttacctcccactgggtctctctcacaacacatgggaattcaagatgagatttggatggggtcacagccaaactgtatcattctgccccggcccctcccaaatctcatgtcctcacatttcaaaacaaattatgccttcccaacagtctctcaaagtcttaattcatttgagcagtaactcaaaagtccacagtccaaagtctcatctgagacaaggcaaatcccttctgcctatcagcctgtaaaatcaaaagcaagttagttacttcctagatacagtgggggtacagacattgggtaaatacacccattccaaatggtagaaattggccaaaacaaaggggctacaggccccatgcaagtctgaaattcagcagggcagttaaatcttaaagctccaaaatgatctattttgactccatgtctcacatccaggtcacactgatgcaagaggtgggtttccttggtcttggcagctccacccctgtgactttgtaggctatagcctttctcctggctgcttccaccggctggcattgagtatctgtggcttttccaggctcatggtgcaagctgtcagtgcatctgttattctggggttctggaggatggtggccctccctcttctcacagctctaccaggcagcgccccagtggggactctgtatgggggtgcccaccccacatttcccttccacactttcctagcagaggttctccatgaagccctgcctcagcagcaaacttctgcctggagaaccaggcctttccatatatcctctgaaatctaggtggaggttcccaaacctcaattcttgacttctgtgtactcacagattcaacattgggtagaagctgccaaggcatggggcttgcaccctctgaagccacggcctgtgctctatgttgtcctttttccgccacagctacagtgactgggatgcagggcaccaagtccctaggctgcacacagcgtggtgaccctggatcccacccatgaaaccattttttcctcctaggcctccaggcctgtgatgggagaggctgctccagagacctctgacatgccctggagacattttccccattgtcttggggattaacatttggcttctcattacttatgcaaatttctgcagccagcttgaatttctcctcagaaaatgggattttcttttctatcacactcaagtcacctctggagtgctttgttgcttagaaatttcttccaccagatacgctaaatcatctctccgaagttcaaaattccacaaatctctagggcaggggcaaaatgccaccagtctctttgctaaaacttaagagtcacctttgctccagttcccaacaagttcctcatttctctccaagaccacctcattctggactttattgtccatattgctatcagaattttggtcaaagccattgaacaagtctctaggaagttccaaattttcccacattttcctgtattcttctgagccctccaaactgttccaaccctacctgttacccagttccaaagtcgcttccacatttttgggtatctacagtagtgccccactttactggtaccaatttactgtattagtgagttttcacgctgttgataaagacatacctgagactgcacaatttacaaaagaaagaggtttaatggactcacagttccacgtggctggggaggcctcacaatcatggtggaaggtgaaaggcacatctcactggtagcagacaagagaacttgtgcagggaacctcccatttttaaaaccatcagatctcatgagacttattcactgtcacaagaatagccaaggagagacctgcccccatgattcaattacctcccactgggtttctcctaaacatgtagaattcaagatcagatttgggtgggaacacagccaaaccatatcatatagtgtatccatacaaagaatattattcagtcataaaaacgaatgaactactgatacatggtacaaagtgcatgaactttgaaaacattatgctaagtgaaagccagacacatgttgcataattccatttatatgaaatattcagaattggcaaattcatagagaaagaaagattagtggttgccagggactaggggaagggaaaatggaaaataagtgctaatgagtaggaagttctttgtgggggactgatggaaaaatactggacatagatagtggtgatggttacataacattatgaatatacttaatgcttctgaactgtgcactttaaaatggttaaaatggtaaattttatattatatgaattttaccacagttaaaaaaatccaagttccttatcttgaatacaaagccttatgtggtctggttcctgtccttgttcctgacatttttcttatactttacacttaccaagttttcttctaccatggaaccttggccatagctgtttctttttactggaataacagttacatggtcagcttcttcttgtccttcacattacttcagagagaagccttctctgactacccactctaaagtagccacccagtcactacctcatcatgcagttaatgctctaacatagcatttaatattatatttttcttacttaggtgtctgtcttttcttctggacctattacaatgtaaactcagatcagagacatttatcttttttactattaaatccacagcacttagaaccctggcatataggaaacatccagtaaatatttgcaaaataaataagtgaatgaaaacatgaaagatgtaaacagtgaaatcttaagttctagctaacagatgaattgtggaagctccgctatttgcatagatagaagttagagttttctttaatttcatactatttttagaatattagttttagccttgtgttatatacctcttgagacttttagaagaatattaaaaacaactcattaaagaagttcaaaatcttcttttaaaaattagtacccttatcagtactatttcatatttcagactggaaaatcatatgaagattttcaagatcaacattttcaacctttgtcttatcagaacttagagtttcaaattattctctgatcacaggcttcactttggtaaaagccttaaaattgtgtcagtattaagcattttataatataaggttatacataaattagggtttaagagggcttagaatttgtaatatttttatattagatttaagtgcttttttatatgtaaggcatcgttttgagtaacatcctcatgagaaatactatggttaaatgcctcattcaattgtaatgaagtcacaattgttacatgtaaaagactttgaaacactcctttgatctgtgtatgaaaaaatgtggatatgtatttttaaaaattcttataatcattcaatcttggagtcctgggagtgttttagcaattagcttaaattatctgtaataccacagtgtgagttaacttttacccttttagaataccctttattaaattaattgtattgatgtcaatctttttctttatctattattccttaaatttgaccctttcaatctgacttgattgcatatattattttgcttttaatttatagaagaggtaacctggttgacctaactttttaaaattatactcttctactatctgctttgatctttttcctttgataaattgtagagaatgcaagatggagattgaagacaaaaagcaggagctccttgaaatggatcaggcacttaaagagagaaattgggaactaaagcaaagagcagctcaggttgatttttcttgattatattttaatggagttttctgttatgacacagtcacacaggatttgagaggtcaccaattttttgtaaaatgggcatttttatagcatatcttttctctgcacatagggtttactaaattagagatatgtcatctctctttatcttgatatttttctagcaagtagattttgaaaatgaggattagcttagtatctgagccttttgatctcttatattaccccgtatcagaagaagctaagtgttggaggaacaaaaatatttggaaggcgttatttagcactttttgtccagcataaaatgaagtctgaattatttgtcatttatgaacacaactatattttattgtttctataatgtatatgggattgaatgtcactatgtattgttaaaaaaaatgcatatggggctcatgagccagtattagtaaacaatgattatttttcccatttaaaaaataatttgagtttatactaaagcaaagagcattagtatattagctatactaatgagtttatacttgttatacttgctataaacaattacaaagcctattctaagcatacaagtttttatatcagaataaaattgaacaacagtttaaggttattttttaggttacacatttggatatgactattcgtgagcacagaggagaaatggaacaaaaaataattaaattagaaggtactctggagaaatcagaattggaacttaaagaatgtaacaaacaggtaaattattttaaaattacgtattttaaattattttttaaaaaattcaaactgtaactaaaaacaccccttcaaatagtgggtgttttttgttattgttgttttgttttttgttttttttggagacagagtcgttctctgtcacccaggctggagagcagtgacacgtgatcatacctcactgcagcctcgagttcctgggctcaagcaatcctcctgcctcggtctccccaaagctttgggattacaggcgtgagcgaccacactctgtggatctttcacttctttgattaaatttcttcctagatactttatttttttgtagctgctttaaataggattgccttcttgatttctttttcacattgattgcttttagtgtatagaaatgctactgatttttgtatgttaattttgtatcttgcaacttgactgaatttatcagttcttttttagtttttgtttttgtttgtgttttgagacaagatctcaccctgtcatctgggctggagtgcagtgtcatgatcatagctcactgccgcctcaacatcccaagctcaggtgatccctccacctcaagtctctgaagtagctgggactacaggcgtgcaccaccatgattggctaattttttaattttttgtagagatggggttttgccatgttgcctaggtaggtctcaaactcctgggctcaagcgatcttcccccctcagcttcccaaagtgctgggattacaggcatgagacaccacgccagccctgtttatcagttctaatagttttttggtggagttttcaggtttttccaaatacaagattatatcctctgcaaacaaggataatttaacttctctctttccaatttggatgccctttctttctcttgtctagttgctctagtcaggactcccagtattatactgaataatagtggtgaaagtgggcatacttgtcttgttctatatcttagtggaaagactttgagtttttccctattcctatgatattaactatgggtttgttgtaaatgatctttactgtgttattttccttcttttttttttttttttttttttttgagatggagtcttgctctgtcacccgggctagagtgcagtggcttgatctcagctcactgcaacctccgcctcccgggttcaagcaattctctgcctcagcctccccagtagctgggattacaggtgcccaccaccacgctcagctaatttttgtatttttagtagagacggcgtttcaccatcttggccaggctggtcttgaactcctgacctcatgacttcacacacctcagcctcccaaagtgctgggattacaggcgtgagccactgcgcccagcctgttattttccttctatacccaatttgttgagagcttttataatgtgaagatgttgaattttatctgatgcttttcaataatgcttttaattttaatatgaaattattatatggtttttgtccttgattctgttgatgtaatgtatcatgtttaatgatttgtgtatgttgaaccatcttggcatccctgggatgaattccacttggttatggtgaatgatcttttaaaaatgtctttgaattcagttgatagtattttgttgtggattctgcctctgtgttcatcagggatattggcctgttgttttctgtttctgttatgtccttgtccggttttggtatcagggtaatgctggccttgtagaatgagtttagaagtgggccaggcacggtggtgcgtgcctgtaatcccagcactttgggaggtcgaggtgggcagattgcctgagctcagttcaagaccagcctagacaacctggagaaaccccatctctatagaaagtagaaaaattagccaggtgtagtggcatgtgcctgtagtcccagctattaaggaggctgaggtggaaggattgcttgagcctgggaagtagaggctgcattgagccatgagtgcacaactgcaccccagcctgggcgacagagtgaaaccctgtctcaaaaaaaaaaaaaaaaaaaaaatgttccctcctcttcaattttttgaaatagtttgagtagaattggtattagtttttctttaaatgtttggtagaattcagcagtgaatgtatcaggtcctgggcttttctttgatgggcgactttttattactgcttttatctcattacttgttattgttctattcaagttttctgtttcttcatggttcaatctcagtaggttgtgtgggtccaggaatttatccatttcttctagtttttccaatttgttggtatgtagttgttcataacagtctgtagtgatcctttgtatttctgtggtatgagttgtaatgtttcctttttcatctcattttatttatttggattctctctcttcttagtcatctaaaggtatttgttaattttgttcatcttttcaagaaattaactctttgtttcatttatcctctgtattgttttatagtctcaatttcatttatttttgctctgatctttattactgctttccttctaataatattgggtttggctgttgctattccagtgtgggaaaggcagttcaagaccaacttgaacttaccttttgtagagacagggtcccactatgttgctcaggctcacattcttatcagcacatggaattatccagaatacataaatgtattatgtattatccagaatatgtaatatgttaggccacaaaataagtctcatcaaatttttaaaggtagaaatcctatcaaatatattctcaatgcaattctaaaagcatcattttcagtaatatgtccaataatattttcaataatgcttttaacatgcacctttaggtgcattgtttgtttgaaatttttgtatttttttgatgtaagcaattattgctataaactttcctcttggtactgcattcacagtagcccgtaggttttgttatgttgtatatccatttttatttgtttcaagacattaaaattttttttaaaatttcttcactcaccctttgttcattcaggtgcatttgtttacattttatgtatttatataatttctaaagttcctcttattattgatttctatttttattccatagtggttagataatatatttgataggatttctacctttaaaatttgatgagacttattttgtggcctaacatatttatgtattctggataatattccatgtgcagataagaatgtgagcctgggcaacatagtgggaccctgtctctacaaaaagtgaaaaaaaattagccaggtgtgatgatgagcacttgtactcccagctacttgggaggctgaggcgggaggatcacttgaacccaggaggtcgaggctgcagtgagctatgattgtgccactgcactccagcctgggcatcagagtgagaccctgtcaaaaaaaaaaaaaaaaaaagaaaagagagaaaaaaaagaatatgtattcagtaacagtgggtgaaatgttctgtaaatgtcagtcacaaaatgcctccttggcctagtttgtagttgaactctgatgtttctttgttgatttttttaatctggacaatctgttcattactgagagtggggtattgaagtccctgtcgttttattgcaaccacctatttgtcccttgagatctattaatgtttgctttatatactcgggagctttatatgcctgggtgcatagatatttataatttttatatcctcttgctagcgtgacacatttatcattaaatactggccttctttgtctctttctactgtctttgatctgtagtctgttttgtctaagtatagctatttctgctatacttttgatttccatttgaatggaacatctttttacattattttactttcagtctatgtgtgtctttatgaagtgaatttcttttaggaagcatatagttggatttgttttttaatccattcacccactctatgtgttttaaatggaaaatttagtccagttacattcaatgttattattaataggtaaggatctgtgcctttctgttacttgtttcttagttgttttgtaactcctccctttctttcccacttactgtctttcattgtggttaaatgattttttctggtagtatgattaattggttgctgtttatttttagtgtatctctcacaggtttttgctttgtggtgagacttatagaaaacatcctattgttataacaagctatcaaaaactgatatcaactgtgatagcaaaaacaaaaaaaagtaaaaacttgtatactttaatctccttctccttccacattttgaatttttggtgttccaattaaattgttatattgcctatctctgaataaattgttgtaattattatttttaataattttgccttttagtcttactaaagatataagtggtttacacaccatgatttcagtgttggtgtaacagtcacattagtggcggtttttcttttaagtttgaagtattccctttagcatttcttgtaggacaggtctagtagcgacaaatttcctcagcttttctttgggaaagtgtctcttcttcatttctgaaggataactctgcttggcacggtattcatgattgacaggttttttttgttcaacactgagtatgtcatcttactccctcctggtctgtaaatttctgctgaggtgtctgctaccaggcatactggatcttccttatatattatttgcttcttttctctcactgctttcaggatcctgtgtttgtctttgatctttgagagtttcattataatatgtcttagggtgttattatttgggtttaatctggttagcgatctttgacctctttatacctgcatacttatatctttcctcaggtttggaaatttttcttttgtttctttaaaaaagctttctacccctttgtctttctcagttccctttttaactccaataattcaaagatttgctcttttgatgttgtcccaaagatcccataagctttgtttattcctttttattccttttttcctcctctcactgtgtagtctatttatctatctatctgtctgtctatctatctatctatctatcaaactaattaactaactaacatggggtctttgttacccagaggtggagtgcagtggcacaatcatagctcaatgtagccttgaccacctgggctcaaagaatcctcccacttccgcattgtgagtagctgggattacaggtgcatgctgccacacctggctaattaaaaaaaaatttattttaagtgatggagtttcactatgtgactcagtctggtctcaaactcctgggctcaagtgatcctctcagcctactgagtatctgggattacaggtgtgagccaccatcctcagttctgattatatattttcaaatagtccatcttcaagctcactgattctatttgacccattctgctgttgatgctctttatttcatttttcacttcatttattgtatttttcagctccaaaatttttgtttgattttttaaaaattattttattctctgttaagtttttttgataaatttctcaattgattccctgcgtcgtcttagagtttgttgaacttccttaaaatacctattttcagttctttgagagatcacacatctccatcacttcagggttactctctggtgcctaatattgttcatttggtaaggttgtatttctttcaatgttcttgatacttgtagatatgcaacgacatctgcatattcagggactgggtatttattttagtctttgcagtctggcttagtttgtgcttgtcctttttgggaggcccttccaggaatttaagcaaactggcttttgtgttccctgaggctgtgatcactgcagctgttgaacactagagaataatctacatccaggcttgctgcaggtcttacaagggcttcaaggttgacatggctttctggcccacatggacctgggaaggggtcaagttgcgtactaaggctgtgggaatgcttgccagggacccaggtccagaaggctgtcctggtggcccagatgggcatgtttcccagcaaatcttttgacaggtgagatgagtctctagttgcaatgagaggggctggagttgagactggccctcttgggatatattgtggaatggaggctgaagagcccagtctcagcttagaggggcacacatagcccagcaagctccttcacaggatatttccccaacgacagtgtgaggagctagagttgagactgggcccccttggcatctgctgtgggatggaggctggagaacctatcttgttggcccagacagggccagcaggtctcagctcagatggaatagttccctgtctgcagtgggaggtgctggagctgagatttaacccctttagcatctgctgtgggacagaggctggagagcctatctcattatttcagaggtgcatgtgtctcccagcaagtccctgcacagacaggatagttccctgattgcagcaagagagtcggggctgagactgggtccccttgggatctgctctgggacagaggttggcaagcctttcaaggaggcttagactcctaggcagcaggataaggacaggtctccctttgggtctgtgtgtgagtagctctgagctgggacctttgctgaggggagttggagcagagtcaccaggcaattttccggtccactgctgagactgatgtcagcagggagagagcctttccactaaggcactagtatgcatgattccttatggaccccttttcagatggttgtgcttgtaggctcaaggccaaatggggctgtagccaagtcccttggggacgtgggctgtttccaggcttgaacccagaagcaagcttggcatatcagccacctgggtttctgtctgtgctctcaaaataacactcccacatcttcgtctctaccaggatttcacaaactcctacctgaatcctgaggctcctgcaaagaggcttttgactatagaaaggtgcaggattctttttttattttattttattttaaattaacagtgtttatttacctctaagtattgttgagagactggggtgaagacacaattttcattttgtaatttacagacttctataagctaaaacaaaaacaaaaaagtcttctctatttaatataatggtagaatacaacttctacttttatttattttaattttttaaatttcaatcgcttttggggtacaagtagttttggttacatagatacattttatagtggtgaagtctgagagggtgcaggattcctgttgttgtgggggaatatgagtgggttaccctctattctgcctttctggtaatgtccaagaacaagaatttttgtgcttatttccaggatacgattgccttaacctatttatattttgcttttagatatgagtgtttaaagcttgacttacttggaacacagcattgattaaattacatttcattaattttactgatactgcttatctgtttaaaattcagatagaaagtctgaatgacaaattacaaaatgctaaagaacagcttcgagaaaaagagtttataatgctacaaaatgaacaggagataagtcaactgaaaaaagaaattgaaagaacacaacaaaggatgaaagaaatggagagtgtaagcaaattatttccacctaaggaacaagtggtagtctctgttgagtgaaatgaatctttatgttttaaactggttggttttaatatacagaaactgtgccataactgtttttaggctagttttttgtgccagaaacctgttagtttctttgaccttttaaaatatttttctgatggtctaggtataggcaaagacagtgtcttatttatctctgtatacaggcctttgcatggtatctttcatatagtaaatctacaatatatgcttatttggttgacaaatatttattgagaagctgctatgtaatagaattgaggagtcagctttttttttttttttttttttttttttttgagactgagtctctctctgttgcccaggctggagtgcagtggctcaatcttggctcactgcaacctctgctttccgggttccagtgattctcctgcctcagcctcccaagtagctgggattacaggcacctgccaccacgcctggctaatttttgtatttttagtagagatggtgtttcaccatattggccaggctggttttgaactcctgaccttgtgatccacctgccttggcctcccaaagtgctgggattacaggcgtgagctaccgtgcccggccgaagagtcagctattaataagatacagtgttttgtctgttaggaactccatcaaaagaatggataaataaataattgtacattgagaccaagtgcactgagttgccagatgaagtttgatgacttcatatcatcagtatgcatgtgtgttgactggtgaattcattcctccacttgctcttttaaaaagtgaatttagggtcaggcacgatgactcacacttataatcccagcattttgggaggccaagttggcagaatcatttgagcccagaaattcaagaccagcctgggcatcgtagcagtgggacccctgtctctacaaaaacattaaaaaactagctaggtgtggtgatgcatgcctgtggtcccagctacttgggaggctgagatgggaggattgcttgagcctgggaggtcaaggctgcagtgatttgtgatcacgccactgccctccaatctgggcaacagagcaggagcctgtaccaaacgaagaagaggaagaagaggaagaagaggaggaagaggaagaagaggaagaagaaggaggggggagggatagtggggaggagggggaggaatactttattagaaatttaattgagtaatataaaaccatttcagtgggagtagcagccccagtgacaagttttactttcacagagagtaagaccttaacccagctgtgtggattaaatggtggattttaattatctataccaatatattctctgtctttgacatagataatcaaatgttaacttctcttttctctttatgttttctgtcataaatgttacatttaaaatgataaaagattatatggcttgtgtatgttacagtgatgtaatatatatcaataagagtcccaattatggtatttttgtcattttctcattagatttttttcttgaatatcagtttcacagtgggtgatactcattgtatgttaaattttaacatactcattgtatgttaaaggatttagttggaaggtggaaatttacgtattaagcaaaatcagaataagaaataggttatctatatatttcattctgaaacctacaaataccttatgcttttcaggttatgaaagagcaagaacagtacattgccactcagtacaaggaggccatagatttggggcaagaattgaggctgacccgggagcaggtgcagaactctcatacagaattggcagaggctcgtcatcagcaagtccaagcacagagagaaatagaaaggctctctagtgaactggaggatatgaagcaactctctaaagagaaagtaatccctattttaaataatcttatgtatctgaaatcttacaaatattagcattttttttgaactgtagaatatagttctttcaaaaatgaactgtattgcacaacagtgtgaatgtacttaatcccaccgaattatacacttaaaaatggttaaaatggtcaattttgtgtgtattttaccacaattttagaaaataatgaactgtgttatatatagataactttgtaatataaccaggaagtccttcagaactgagttttggctaaactagttctcaaattgagttataaagcacttttagacttttaagtgagttcgagctcttacttgaagaaaaaataaagctaatcttttttgagtaaaaatttttacatttgtagtgactcttaaaaatgaaaactattggcttggcacggtggctcatacctgtaatcccagtactttgggaggccgaggcaggcggataagtaagtcaggagtttgagaccagcctggccaatatggtgaaacaccatctctactaaaaatacaaaaaacaaaattagccaggcatgatggtgggcacctatagtcccagctactcgggaggctaaggctggggaatcgcttgaatcccgaaggcagaagttgcagtgagctgaagtcgtgccactgcaccccagcctgggcgacagagcaagactccatctcaaaaaaaaaaaaaaaaaaaaaaaaaaaacatgaaaactatccaaatttgtaactattaaatttgtaacttttaggaaacctgtagttcaaaacccttggttgataaagtaacttggaggtaaagtgcttttaaaaagcaaaaatactaatataaattttatttttccagtatttggtaggaagttaactacttggcttaaaaatatttacattggtatacttgggttaattatttagactttaagaaaaatgtgtttattgatgttgcaaaaaaaaaaaattcagctttccattgtggtttccatggtttaattcaattccataggaactgaattaaaatatttttacctttaattttggttaagcctacctatgttgttattcacatttctggatggttagaccagtaaagcatacatagagaatgtttattagagatatattatacatttggggttctaggaaaaggaaagctatctacttttatctcatttctgcctttatcaatagtgtcaaagtatagtacaattggtttttatttgataagctaagctcactttaaaaagtgaattaaagttaggaattttttaattgacagtgttttaaatacttattttaacccaaaactaaatatatattgatatgtttttcctttgatgtagggccaaaccttggttctttttgtatgagtcatttgattagaattctacctagtctttctcacataactagactcctacctggtctttcaccacactatattccatcatctatagtttccaattctgctttctttaaagtggaggaagaattaattaaaagacattaattaaaattaaaataattaaattaattaaaattaaattaataaaaattaattaataataattaattaaaagacatttgtaagtgaaccatgttatatttttatgggacctcctaccatattttataacaattttgagtgtttctaattggatagcaaaatgttcatgacttacttattaagctggttcaaaacatataacttagtttttggataaaaactttgcatttgcttatttcatcatgttcataatctataataaaattacacaattaaaattacaagcacagttagctaaattagcataaataagtttgaataaaaacacaactgactcttgataaacagacaatatatatagtgagcaaaaatatacaggcatacctagcagtagactgttatctgccagagttcagtgtcctgaggttattattaatagttcattttatagaaagcattggttagtgaacatctattttatgatgacagcaaacaattatattaatactctcccattaatagtctctgaaatgtctagattttaaagcatactatttagtaagttaactttgtgtctgtgtttatataatataaaaaattaaactacttccaataatgcactggattagtttagctataataaccaaataaacaagttttatagcttttactcaatatgtcatttttaaggatgctcatggaaaccatttagctgaagaactgggggcttctaaagtacgtgaagctcatttagaagcaagaatgcaagcagaaatcaagaaattgtcagcagaagtagaatctctcaaagaagcttatcatatggaggtaaagaaaaatttaatttgttttgttagtgcccactaaagtaggttgacctatctggacaaaagtatgagtccagctcttaagtgttcattattgaataatacattgtggtcttcatttctggtagcctaaacatacagctttcactttaatatactgtggggttaagagcttgaattcctgagccaggcaacctggttctaaaccctagctcaccacggagccacctgtatcaccttgggtaagttacttaacctgtgtctaaaatggatataataatagtatctacctcatagaactgtggtgaatattaaatgaattaatatataatataaaatagcatttgtaaaagattaactggaaatatttaataactgatataaaccgtttcatgtgatgtaaatctataatgctttgcaattttcagcatttcttcttataataacttagctagagagataatactagagcctttttatctgtcagcatgtcttgagccttcacagaaatgggcagtattattgactagaatagcatttttcatctttttaaaaactacatttaaagatattacccaaaatctctgtatatgatttaaataaattacttacgtttagtgctaataaagcgttttttctaatacggcaagggttgcaaatatttatgttaaactccattcaagggagtttggtgacatttttgtgagtgattggtagggcttgtggggaccatgtcttgcttaaatacatttagaatcatatctctttgaaagcattgtgcctgccaaacaaaacatatttacaagctgaatctaatcctaaggctaagaatttgcaacctttgatctttagcgacaaacctgaatgaatgctgttggactcagcataattatataattgttattaacagctcagcttagtaactatcagtaataattaggcgctttcaagtgtttgcccttaactactcattacactttcattatatggcctctgttctgtttttaagtataattatccaattgtttcttttagttttataagccacctgaaattataaatagattgtacataaaataaattgtaaaattagttcagtattgctatctttttaaaaaagtgatggggtctgtgttgctcagactggcctcaaattccagagctcagataaccctccccactcagcctctaagtagctgggagtaaaagcacacgccagccgggcgcagtggctcacacctgtaatcccagtgctttgggaggccaaggcaggtggatctcttgaggtcaggagttcgagaccagcctgaccaacatggcaaaaccccgtctctactaaaaatacaaaaattagctgggtgtggtggcgcatgcctataatcccagctactcaggaggctaaggcagcagaattgcttgaacctgggaggcagaggttgcagtaagccaagatcgcgccattgcagtcaagtctgcgtgacaagagtgaaactccgtctcaaaaaaaataagtacatgctgctgcattttaatatttaatattactatttaatatttgatactaatattttgtctataatattgaagtatatatttttacctgtttggaagttgataaaaatttacttttaaaatatatatgttgtttgaatataaaaatgagaggatatggtattaaagtaatagagagctagaaaagaggatcaataatttttaacagttttttttattatactttcttttttttttaatacattaagttctggggtacgtgtgcagaacatgcagttttgttacataggtatacacatgccatggtggtttgctgtacccatcaacctgtcacctacattaggtatttctcctaatgttatccctcctctaatcccccaccacccaacaggccccgatgtgtgatgttcccctccctaggtctatgtgttctcattgtttaactcccacttatgagtgagaacatgcggtgtttggttttctgttcttgtgataatttgctgagaatgatggtttccagcttcatccatgtccctgcaaaggacgtgaactcatccttttttatggctgcatagtattccatggtgtatatgtgccacattttctttatccagtctattattgatggacatttgggttggttccaagtctttgttattgtgaatagtgctgcaataaacatacatgtgcatgtgtctttatagtagaatgatttataatcctttgggtatatacccagtaatgggatggctgggtcaaatggtatttccagttcgagatcaacagtattttttaatatataggtttccaaattgtcagaaaatcacttaataataaatgtaaaactcctgacttattggaggagaatgagattgttttaacctttaattgtgaaaaatttaaatatatttaaaaatagaatagtataaatagtatatacatcctcatatttatttttgaacgttaataattttcaatgcatagccaatttatttcatccataaatacattgaccattttctttatctaaaagagaatacttttgagaatgaaaaggaatgctatagtaattacatgagggtaccaggcataaaacctagacagtcctaagcattctcggaagtgtgtcaacatacctttaacctttgaaagcacagtgctttcaaagagatatgattctaaatgtatttaagcaagacatggtccccacaagccccaccaatctaagcaagacatggtcccccaagccacatcaatcacccacaaaaatgttaccaaactcccttgaatggagtttaacataaatgttaaacccattcccaacccatcccccatattcacatattatttgaagcaaattttagacataattatttcatctgtaaataattatgtagacataattattctatattcaataagtatcttgtattagtccattttccattagtccattagtccattttcacactgctataaagaaatacctgagattgggtaatttataaagaaaagagctttaattaactcacagtttcacatggctggggacacctcgggaaacttacaatcatggcagaaggttaagggaaagcaaggcatgtcttacatggcagcaggagagaaagagtgtgtaaatgccacacttttaaaccatcagatctcatgagaatgaacttactatcatgagaacagcttgggggaaccacccccatgatccaatcagctcccaccaggtaccttcctccacatgtgaggattacaatttgagatgagattcgggtggggacacagagccaagccatatcattccaaccctggcccctcccagatctcttgtccttctcacatttcaaaacacaatcatgccttcccaacagaaccccaaagtcttaactcattccagcattaacccaaaagtccaagtccaaagtcttatctgagacaagccttccatctatgagcctataaaataaaaaacaagttagttacttccaagatacaatgggggtacaggcattgggtaaatgctccccttccaaatgggaaaaatttgccaaaacaaagaggctgcaaggcccatgcaaatctgaaacccagtggagcagtcattaaatgttaaagctccaaaataatctcctttgactccatgtctcacatccaagctacactgatgcaaggggtggactcccaaagttctgggcagctccacccctgtggttctgcagggtacagcccctgtggctgttttcatgggctggcgttgagtgcctggggcttttccaagtgcacggtgcaagctgttggtggatctaccattctggggtctagagaatggtggccctcttcttacagctccactacccagtgccccggtggggactctgtgtgggggctccaacctcacatttctcctctgtactgccttagtagaggttctccatgagggctccacctccacagcagacttctgcttggacttccaggcatttccacacatcctctgaaatctaggcagagcctcccaaagctcaactcttgtcttctgtgcacctgcagacttaacaccacatggaagctgccaaggtgtggggcttgcaccctctgaagcaatggtctgagctgtaccttgaccccttttagccatgggtggagctgaagcaacagcaatacaggtcaccccgtcttgaggctgcacagagcagtggggctctgagcctggcccacaaaaccattttttcctcctagatatccaggcttgtgatgggagaggcttccttgaagatctctgaaatggcctggagtcattttccccattgtcttggcaatatttagctcctcattacttaagaagatttctgcagcgagcttgaatttctccccataaaatgggtttttcttttctaccacatggccaagctgcaatttttttttaacttttatgctctgcttcccttttaaacataagttccaatttcagatcatctctttgtgaatgcatatgactgtacactttcacaaaagccagatcacctcttgaatccttaaaaatttcttctctcagagaccctaaatcatctctctcaacttcaaagttccacagatctctggggtgggggcaaaatgccactggtctctttgctaaaacatacaagatactctagtttccaataagtttctcatctccatctgagaccacctgagcttgcacttcattgtccatatcactatcagcattttagtcaaaaccatttgacaagtctgtaggaagttccaaactttctcacatcttcctgtcttctgattcctccaaactgttctaacctctgcccattacccagttccaaagtcacttccacattttcaggttatctttatagtagtaccccactattctgataccagttttctgttattagtccattttcacagtgctataaaaactgtgagtcaattaaacctcttttccttataaattacacagtcttagggctggtgtgagtgcctgaggcttttccaggtgaaggtgcaagggctgtcgctggatctaccattctggggtctggagaatggtgacagttgcagggtaatttataaagaaaagaggtttaattgactcacagttccacatggcttgggaggcctcaggaaaattacaattcttatgattatggcagaaggggaagcaagtcatgtcttacatggtggtgggagacaagagagcaagaggggaagtgtcacacttttaaacgatcagatctcatgagaactcactatcatgagaacagcatgggtgaaaccatccccatgacccaatcacctcccaccaggttgctcctttgacatacaggaattacaattcaagatgaagcctggatggggatacggagccaaactgtaacatagctctaaaagataagggctattttttggaacagaaccacaataccatgatcacacctaaaaattgacagtgactccttaatatcatcaaatacccaatcattgttcacatttccccaattgtctcaaaaatgtctttatagtttatttgttcaaatcagtacccaaatagagtccattgcatttggttaattaagttcttaagtaaattgaagattatggattcctttgttccctttttcctctagtattcattgagaaatcagatgtttgtaactataaacagaatttactttttttaaagaaaaagtaaataaaagtagaaagcattagactgttgtcgaatccagtttccttccatttttttattttttttcttttccaattctggggctatatagatgatttcacatcaagagaaccatgcaaagtggaagatttctgctgactctcaaaagtcttctgttcagcaactaaacgaacagttagagaaggcaaaattggaattagaagaagctcaggatactgtaagcaatttgcatcaacaagtccaagataggaatgaagtaattgaagctgcaaatgaagcattacttactaaagtaagtaaacatataaaagtaataaagcatatctatgaaaacataaatgtctgacttatttacctgtcttagtagtttatagaggactatatgaccaaatattggcctgtttgaataaaaaccatttgatttagaagatgttgaatttaggaaattattaagatgatgtacatcttattaccgtagaagatataatttataaatgttcaaatataaactcatctaatcataatgtttagagggttttatacttgatgtacctaaaaaaaggtagaaacatttttcaaaatcagcaaagttcttttaaaatcataaagtaggccgggcgtggtggctcactcctgtattcccagcacttcaggaggccgaggtgggcagatcacttgaggtcaacaagggcaaagacaattttttgagagccatgaaggcatcattatattatggctcactacaattacgttcacaacagtgaccttctttgagtcttaagaaaaagttgaattaatttaatgtattcagtgtactatatttaattgtaaaagttatgtgttaaactgtaacttaaataaaatcctacttatatgagataccacatatcaattatggctagataatgcagaataggaaaaagaaaaagactgcagctgtgtacagtcctattctgtgccaactctacaactgttttgttaattgtgattttaagaatgtgaatgtaggatttacaacaaaaaattggcactctagccactttaaaccaacaggctttaaaccaacaaagatcaaaagagaccaagaaggccattacataatggtaaagggatcaattcaacaagaagagctaactgtcctaaatatatatgcacccaatacaggagcacccagattcataagtcaagtccttagagacctacaaagagacttagactcccacacaataataatgggagactttaacaccccactgtcaacattagacagatcaacgagacagaaaatcaacaaggatatccaggacttgaactcagctctgcaccaagcagacctaatagacatcgacagaactctccactgcaaatcaacagaatatacattcttctcagcaccaaatcacacttctgccaaaattgaccacatagttggaaataaagcattcttcagcaaatgtaaaagaatagaaatcaccacaaactgtctctgagacaacagtgaaatcaaattagaactcaggattaagaaactcactcagaaccacacaactcatgaaaactgaacaacctccttctgaatgactactgggtacataacgaaatgaaggcagaaatgaagatgttctttgaaaccaatgagaacaaagacacaacataccagaatctctgggacacatttaaagcagtgtggagagggaaatttatagcactaaatgcccacaagagaaagcaggaaagatctaaaattgacatcctgacatcacaattaaaagagctagagaagcaagagcaaacacattcaaaagctagcagaaggcaagaaataagtaagatcagagcagaactgaaggagatagagacacaaaaaacccttcaaaaaatcaatgaatccaggagctggtttttagaaaagatcaacaaaattgatagaccgctagcaagactaataaagaagaaaagagagaagaatcaaatagaggcaataaaaaatgataaagaggatatcaccactgatcccatagaaatacaaactaccatcagagaatactataaacacctctacacaaataaactagaaaacctagaagaaatggataaagtcctcgacacatacaccctcccaagactaaaccaggaagaagttgaatccctgagtagaccaacaacaggttctgaaattgaggcagtaattaatagcctaccaaccaaaaaaagtccaggaccagacagattcatagctgaattctaccagaggtacaaagaggagctggtaccattccttctgaaactattctaatcaatagaaaaagagagaatcctccctaactcattttctgaggccagcatcatcctgataccaaggcctggcagagacgcaacaaaaaaagagaattttagaccaatatccctgatgaacatcgatgcaaaaatcctcaataaaatactggcaaaccgaatccagcagcacatcaaaaagcttatccaccacaattaagttggcttcatccctgggatgcatggctggttcaacatacgcaaatcaataaatgtaatccatcacatgaaccaaaccaaagacaaaaaccacatgattatctcaatagatgcagaaaaggctttcaacaaaattcaacagcccttcatgctaaaaactctcaaactaggtattgatgggacatatctcaaaataataagagctatttattacaaacccacagccaatatcatactgaatgggcaaaaactggaagcattccctttgaaaactggcacaagacaggggtgccctctctcaccactcctattcaacatagtgttggaagttctggccagggcaatcaggcaggagaaagaaagaaagggtattcaattaggaaaagaggaagtcaaactgtccctgtttgcagatgacatgattgtatatttagaaaaccctatcatctcagccccaaatctccttaagctgataacttcagcaaagtctcaggatacaaaatcaatgtgcaaaaataacaagcattcttatacaccaataaccgaccaacagagagccaaattatgagtgaactcccattcacaattgcttcaaagagaataaaatacctaggaatccaacttacaagggatgtgaaggatctccaaggagaactacaaaccactgctcaatgaaataaaagaggacacaaacaaatgggagaacattccatgctcatggataggaagaatcaatataatgaaaatggccatactgcccaaggtaatttatagattcaatgccatctccatcaagctgccaattactttcttcacaaaactggaaaacaactaccttaaagttcatatggaaccaaaaaagagcccacacagccaagacaatcctaagccaaaagaaaaaagctggaggcatcacgcttcctgactacagggctacagtaaccaaaacagcatggtactggtaccaaaacagagatatagaccaatggaacacaacagatccctcagaaataacaccacacatctacaaccatctgatctttgacaaacctgacaaaaacaagaaatggggaaaggattccctatttaataaatggtgctggaaaaactggctagccatatgtagaaaggtgaaactggatcccttccttacaccttatacaaaaattaattcaagatggattaaagacttaaatgttagacctaaaactataaaaaccctagaagaaaacctaggcaataccattgcctaggcatgggcataggcatgggcaaggacttcatgactgaaacaccaaaagaaatggcaacaaaaaccaaaatagacaaatgggatctaattaaagagcttctgcacagcaaaagaaactaccatcagagtgaacaggcaacctacagaatgggagaaaatttttgcaatctactcatctgacaaagggctaatatccagaatctacaaagaacttaaacaaatttacaagaaaaaaacaaccccatcaaaaagtgggagaaggatatgaacagacacttctcaaaagaagacatttatgcagccaacagacacatgaaaaaatgttcatcatcactggtcatcagagaaatgcaaatcaaaaccacaatgagataccatctcacaccagttagaatggtgatcattaaaaagtcaggaaacaacaggtgctggagaggatgtggagaactaggaacacttttacactgttggtgggactgtaaactagttcaaccattgtggaagacagtgtggcgattcctcaaggatctagaactagaaataccatttgacccagccatcccattactgggtatatacccaaagtactataaatcatgctgctataaagacacatgcacatgtatgtttattgcggcactattcacaataggaaagacttggaaccaacccaaatgtccatcagtgatagactagattcagaaaatgtggcacatatacaccatggaatactatgcagccataaaaaaggatgagttcatgtcctttgtagggacatggataaagctggaaaccatcatcctgagcaaactattgcaaggacaaaaaaccaaacaccgcatgttctcactcataggtggaaatcgaacaatgagaacacttggacacagggtggggaacatcacacactggggcctgttgtggggtggggggaggggggagggatagcattaagagaaatccctaatgtaaatgacgagttaatgggtgcagcacaccaacatggcacatgtatacatatgtaacaaacctgcacgttgagtacatgtaccctagaacttaaagtatttttaaaaaatcatataaatcaattttagatgaagtagtaaaaaaaaaaaaaaaggaaaataccaaaatatgcgtgttaaacttttattttgtaatgcattctgtggttatgacagttttagttatgaacacagtatttttgaaagctactttaagaatagaaactatcagagtaaaactgacaggatttagaaatatatatcttatggatacctttaagaaaaggcaaatgtatttgaagaggagactactatacttacattattaagcttttgaaattaaaatatcatctctttttttaggctttttggttttttagtgtatgtagtctcattcctaggatcccaaagttcagtcagaggacccaaatgaaagacatgaaaaaaattgaaatgaaaagtttatttaacaaggattgatttattaaaaatttatcactttaagtttttgaaaaatttctaatgcactaaagctttcttgtaatgagaacacaaaaagcagaatagcttatctatttattccctactggaaattctgaaaggggtctttttgtgtctatatgtgttagattaacaaaagatagcgtacctctacatctttgcagagaaatttttaggtgtaagatttcaatcttgaatagaaattgatattgtcattaacaccaaaaatatatatataaggagaatctagttttaatggaatttcttagaataagcatatttcaaaggaatatgtgtaattttcccaaagtgaacctatcttaagtaaaggttttaaacagagcttggaaaactctcaagaattataaacagaattcctatagtgggacaaaggttgactttctaaaagtctatgattttctaaggagttcattcatttaacaaaaatgtattgagcacctactatgtaccaatttatctgcaggaatcagaattaaccagattacaggccaaaatttctggacatgaaaaggcagaagacatcaagtttctgccagccccatttacatctccaacagaaattatgcctgatgttcaagatccaaaatttgctaaatgttttcacacatctttttccaagtgtacaaaattacgtcgctctattagtgccagtgatcttactttcaaaattcatggtgatgaagatctttctgaagaattactacaggacttaaagaaaatgcaattagaacagccttcaacattagaagaaagccataagaatctgacttacacccagccagactcatttaaacctctcacatataacctagaagctgatagttctgagaataatgactttaacacgcttagtgggatgctaagatacataaacaaagaagtaagactattaaaaaagtcttctatgcaaacaggtgctggtttaaatcaggtatgtattttatacactgtaaactgtaataatttgtttccaaagaatatcattttattacttggaagaaaattcatatatttaaatgaaaaactactaatatttgaagaaggaagattttacattttatacattaagtaaaatcaataccaaaagacattttctctattgcatggtgtgagacaatacggggaaagagagaggcagagggagacagaacaggaagtagaacgaaaaataggaagatagacatgaaagtgcttaaaaataaaaaaattaaaaaactgaaaaaaagaaaaatggtaagaaatatgcagtgagaggaatccagagaaagtaggttctgaggtgaatgttctcataacttcgtcataatttactgttcatttgggctctgtatgtcaaaataagttattgctggctatcactgatccttggaaagttgatttactgaattagccattatttaaaagcatgaataaggccaactgtcctcatccttataatttttcaccctaaaatatttatattcatctttccttcttttgtcccttttctctttaaaagaaagatatatccctcttcttttttagagagaaattcttgaacatgtactttcaagcctttaatatgcttgcctgttttgcttctctgcttcctgatttaatctgtatcttcaggcttctttatttccctcttcctttcatttccagacatcttaaattcatacccactctaagctgggtgcagtggcacatgcctgcaatcccagctatccaggaggctgaggcaggaggattatttgagcccaggagtttgagacaagtatgggcaacatggagaccccatctcaaaaaaaatttttattcattctatttctccattgttgctacctccttactacccttcccactttgtaacttactgtatttgtctcttgaatattaaatttactgttttcttgaaagtcacaaaaaactctttgtataataaacaaatttagtatcctctttttcttcagcttttgtagatttaactgtccattcccccttttgatattttctcttctcttgacttttatgatttaatatttttctggtcctcttcttattttgaactaattactttctcacttttctgctcctcgtattccttatgttccacaatataggatttaatctgtagtttgagaatggaaataatctcctttagataatgtcagctttttaaaaaatgcctaacatcattttcaaacacatcaagatagctttggtggcctgaacagttaaaaactatttttttggaatagatccaagacaaagaaaaattgttgagtgagtttttcttcataatacttatttttgctggcttaagtatatgtctatctacttgtttattgattgtctcccccactgaaaatgtaagctctgtgtggagagggtatggtcatttcgcttatttctatatttctagtgcctggtatatagtagatgctgaatgaatatttatgaatgtatcaagtggctaaataaattatatacagtaaacacaactgtagttttaaatgctagatttcatcaggctgtgctggccaaaatttcacttttagcatattacttttagcacccaagaagttaaagattcagtaaaggtaactgagaagtaatcagtgaaatagaagagaaattaggagagtataatatttcacaatgtatttcaaggagggtgagatcaattgtgtccagtgttgctaagtaaagtgaaggttgattattgactatcatatttggtaatgtcgaggcttttatgaccctcataagactggctttagcctaacaatgggaatgaaagcctgttgtagagtgggtttagcatagaatggaaagagaggaaatagaaacatcaagaatagacaactctttggataaagagtaaagcagagaaatgagggagatgtgatgtcaagggagagttttttgttttgctttttaacataagagagaaaacagctgttggatattgataggaatgatccagtagacagggaaacagccattcaagacagagcagaaggagtaaaatccttaaggtaggcttaagaaatgggatacaggagagcagtagaggagttggtcttggataaaaaggggcagttcatccactgtggtgggaaggcaggcagaatatgggagcacagaaacacatggaatggaaggtttgatagtgggagagaaatttctttatcaattgcttttcttttctttttttttttgagacggagtctggctgtgttgcccaggctggagtgcagtggcgcaatcttggctcactgcaagctccgcctcccaggttcacgccattctcctgcctcagcctcccgagtagctgggactacaggcgcccgccaccacgcccggctaattttttgtatttttagtagagacggggtttcactgtgttagccaggatggtctcgatctcctgacctcgtgatctgcctgcctctgcctcccaaagtgctgggattacaggcgtgagccatcgtgcccggccaattgcttttattttcttagtgagataagaagcagggtttttagttaaggcacagtaagatattggatatttaagaacagggaaggtatgtgaaatggttacttactttggagagtaggaaagcataaacagactagcaaagtctagtagaattgccagccagatagttctgtcatgtggaacaaccgtgcaagatacaggacatctggcatcatttgtttctgcctgttgtatatcagcagcagcatgtccctttctcccctatcacaatgacaaacaaaaagtaccatcacaaatttctagaatgttctgtagaggatggtactgcaccctttaagaacctctgctctactccagtgacccttgcagtcatagatatgcaagactctctttttggtaaaaatcgcacctaatttatgcaggataaatttgataagtacagtgacagactgtgatcataacaatacatagcctttactgtatgtcaagcaaatcctttacataaattaactcatttaatccttataacaaccccctgataggtactattatctgaatagtaccaaataatagtacctaatagttctactgtagtgggtactattattatccttatgatatgaggaaactgagtccctgctcttaaccactatatataatctttacataattgtattggtattttcttcagtatgtctaattacatagtttggtcttgcagttgcttagccaattaaggattaagagtaggagttagccaggcgcggtggctcacgcctgtaatcccagcactttgggaggctgaggcaggtggatcacgaggtcaggagttcaagaccagcctggccaagagggcaaaaccccatctctactaaaaacacaaaaattagctgggcatggtggtgcgcacctgtaatcccagctgctcaggaggctgaggtggagaattgcttgaacccgggaggcagaggttgcagtgagccgagactgcgccacagcactccagcctgggtgacagagcgagactccatctctaaataaataaataaatagtaggagttaaaagttactacataacagatagaataatttcttactctgtaggtttttgcaatatatatttgaatttttcaagtcatttcacctattcaattatcattgaagatcaatgccaaattaaaatattcaaaatactggccgggcaaggtgcctcacacctttaatcccaacactttgggaggccaagcaggaggattacttgagactaggatttcaaggacagcctgggcaacatagcaagacccgatctctacagaaaaataaaatgaaaaactagctgggcatggtggcgcacatctgtagtcctagctacttggaagctgaggtgggaggattgcttgagcccagttcgaggctgcagtgagctattatcatgcaatgcagcaagaacccatctctaaacaaaacaaacaaacgtagcctattgttaaacttaaagattggattcttaaaatcctatcaaagttatattctgtataaacatagttttcttgattgtcaatgatactctactgagttttaaatgcattgaccactgtcaatactcataactttaagctcacatggaactcctacagcgcatgagcctcagttgcattacctgtggtagtgaccacctcatagtcatttatatgtatgttgcattaataaatatatactactctgtaaaatttaatgaaagagatgtatttttatttttttgaggcagagtcttgtgctgtcacccaggctggagtgtagtggcacgagagctcactgcaacctccgcttcccaggttcaagcaattctcatacctcagccccctaagtagctgggattacaggcgtgtgtcaccatgcctggctaatttttgcattttttagtagagatggggtttcaccatgttggccaagctggtctcaaactcctggccccaagtgatctacccaccttggcctcccaaagtgctgagatgacaggcgtgagccaccgcacctggcctgaaagagacattttaaattgggatgtagagccatgatctgtagcctagttcaggtcctcggcttatttcacctgccacttaagtatgacattgcattggtctcctatttaaaagcaggattttaaaactcttttaaaccaaataaattattatttaaataaagaaatccagtatgtcaaatagattcaaaggtagtttatctgattgggggtaggatatgtctgacctttacccagttacttaaatctactcatggctgctcatgcaaaagctccagagcagccctggattaatcattaaggaaaataagcaggagcataggggactaaggggaatgccacagagttgtttgccctagctatcatcctcttaattcgttcactgccacacttgactttagtagaatttttagtaactgtctttatctgccagttcaaatttaatctgcactattaaaaaatcattttctttggtatgatgagtgacaaaagtttaaaagtttgatttgaaagtgtcatcaggtattacatttgtttctttacacatggtgtgagtttcaaaaccagctacctgggtctggatagcatttgactcatcagctgattcgtctaaaggactcttaagcaattttttaaagcagtggtagggccaggaggcgccattgttgggctgtgcagagggtatcagctggcctaaatccagctctgcttcagaaaagtgcagttttaaagtccactggtacaatgaaaagaatgtggaaaccgatacatgagaagtgtttaataagtgttagctcccttgtgttgcagcccaaatactattttcctaatggttaagtacgttggcacttccattgagagtaaagcctcttaacactgaagtattctgctttcagactaacaaaagcttcagaactcaaaaaattacacctgtacacaatttagaacacaatatcagcaagttcagagacttcatattaactcctattctaatcctgttttggattagagcagtggaagtgttgtgaatactgattaattagctaattcaccatttattaggaatttataaaaagttattacttctatttctcttatttgtaagtagttttcaagatatggtacatatatcatgcagtaagatgaaaaataagaaattaggaaattagctatagggaaaacaaagatgaaaaaaaaatgttaaaccaggagtacaggtaatacctagagacatgataatattttcaaattcacaccctcagtaaagatgaaggtatgacaagaaaatttggcccatatttttttaaatcccctgggcctttttcctctatttttctactttatgttaaactgcttttatatgcaaataattgtgtaggggtgggttgcccctacacacctgtgggtgtttctcgtaaggtgggacaagagatttggaaaagaaaaagacacagagacaaagtatagagaaagaaataaggggacccggggaaccagggttcagcatatggaggatcccgccagcctctgagttcccttagtatttattgatcatctgtgggtgtttctcaaagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagaggcattccttcctcttttactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccctcaagcatctgtttaacaaagcacatcttgcacctccctcaatccatttaactctgagttgacacagcacacgtttcagagagcacggggttgggggtaaggttatagattaacagaatctcaaggcagaagaatttttcttagtacataacaaaatggagtctcctatgtctacttctttctacacagacacagtaacaatctgatctctcttgcttttccccacataattgtcttttgtctctgtctgctctttttttcttcttttaatcttcctttttcattgattttttcatgtagctattcatcatccttgtttattgtgctctcaaactataacatgacactgatgccaaaatgttatatttatgttccttttttcgagttttaaaattagtttaaccccatattcacacccacctcatcaagccagaattatttgcttttattttttattttatttattttattttatttttttgagatggagttaccctcttgtctcccaggctggagtgcagtggtgcgatctcggctccctgcaacctccccctccaaggttcaagtgattctcctgccttagcctcctgactagctgggattacagacgctcgccaccacacccagctaatttttgtatgttttagtagagacagggtttcaccatgttggccaggctggtctcaaactcctgacctcaggtgatccatgcacctcggcctcccaaaatgctgggattacaggcagtgagccactgcacccggcctgcattttatattcatgtggttcattattgactttttatgattcatatttttcagtagactaaatatttctcactctcgctttaaattatactcctgttattatggtagacttttaatgctaaatcagtttaggaatatttcaaatattaatctattattttgcattattctagggagaaaatgtgtaattcaaagaagatactgatgtgttgaaaaaatggaatttttggtactgtgctgtttacttattatatgtagctcatacttcatagaagctgttattttgcttttgaataaattttatatttcaatattttaaaagaaagcccttctaaaacttaattatatttttaaagaaaatttattattttatttattgttttttggcttaaacttgctgctttcttttgctttttatataaaaatcattgttaaaatgca

SEQ ID NO: 1633 - DNA, 42142 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggg

SEQ ID NO: 1634 - DNA, 44255 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatctacgtaacctcaatctagcacgagcaacaggcagatttcgccatctttgttgtggtcaaggagtcttcttgggttcctgggttctttagtctcgaaatatataagacttttcgttcttcgctagtcttctgagctcgagatgaagcacagaaggctaaaacaatgagggacagcgttccagtagccctgccacagctctctcatcctctggtccgccctcactcaagatggctaccagcaagaatggtgcaatggcgtgacagctcggccctggttgccaaggagatgcgagtaccggaaat

SEQ ID NO: 1635 - DNA, 42142 bp, Homo sapiens; identical to SEQ ID NO: 1633

SEQ ID NO: 1636 - DNA, 44255 bp, Homo sapiens; identical to SEQ ID NO: 1634

SEQ ID NO: 1637 - DNA, 43954 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatct

SEQ ID NO: 1638 - DNA, 43954 bp, Homo sapiens; identical to SEQ ID NO: 1637

SEQ ID NO: 1639 - DNA, 43067 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttc

SEQ ID NO: 1640 - DNA, 12467 bp, Homo sapiens
acagaaaatagcaggcatctgccagaaataaattaggtcttgggaatgatcttgtatctgaactaggatccccataccctttctggtactctgaatttattttaaaggcatttctagataccttctcttttaggcaagggcctgtcctgtagcaaatggagttacctccaagactgttgtatctctgttactcctgaagcctcagaaattttagtcattatcatttgatggctgagaaacaacctggctggcgatagatgctgaactacttcctttttacagtttttgttcttttaatttacctcaataagtcctgcccctccaaacaataagttaaaagtatgctgagttagaatgttaatggatttggttccattaatccctaaaccataggagtggcaaagtggttgagagagaaacaattttatttttggcctttttattattattctagcattttagggcttccactcttttatttttagatggttaactcattgatgatacctatttgccatatagctgatcccaactgatgaaaaccattctaaaacatcaataattaattcacttaaagacgatggtccctctgtccctaagacagatcctatcaagagagggaaaagtctcttttctggaaacaaattgacagcaaaaagatgaaaaattagtctctgtcaagctggacaggaggtagttaacaggtttgtaaaaccaaacctgaaacctaccttcactgcccttcaacaaggagaaactattccctctctttcacccctttgtaacacaattctactgtttaaaaggacatcttccctaattaccacctccaataaatatccattctaaattattctccacccaattattaaagttttttacaagctcggtgggggaagattttccctgagacaaacaatgaacagagtgaggattttggaaagatagaaaaagctacaaggcaaagtggtcacagcataagaactgaaaatagccgggcacggtggctcatgcctataatcccagcactttgggaggccaaggtgggcggatcatgaggtcaggagatcaagaccatcctggctaacatgatgaaacccgtctctactaaaaatataaaaaagtagccgggtgtggtggcaggtgcctgtagtcccagctactcgggaggctgaggcaggagaatggcatgaacctgggaggcggagcttgcagtgagctgagattgcgccattgcactacagcctgggcgacagagcaagactccacctcaaaaaaaaaaaaaagaactgaaaaattctgccacctgtgatttagtcatgaagcgggtgaaacatagtcaagttggtatgaggaaaaggaaatattaatatttgtgatgagactgggacttattgagaatcttggttgtctaggaaatgatcagttactaagaaaaaagtaagagagtcagttgcattacgcacagacttgtgctcagaaaaggggtacaaggcagccttatattccaggtaagatggtgggattggggatgcactggaatcatcaatcaaatcagaatcctttactcctcctttccaatcctcctggagaggtggtgccaacatctggcctctgtatagtacaccaagggaaaaaaacagcagacacgaggagagcaagagcagcttcccagcccatggtttccccagatccttagcactccctaccctaaggttagagggttggatttctgctgatccaatcccagccttacttagtgccctatggtcattctccctggtccaccctcactatatccccctgccacccaccctgaagaacacaaagctttttagttctctgccacaaggtaattttaaaaatgtggtttctttgtttaaacagttactaagttggttcatctttcagtaacagacctcccctcccccagctccccactcagtcttgtatgatcacatcatcatcatcatcatcatcatcttcctcctcctcctcctcctcttcctcatcatcttctggcagttcttcctcctcctcttcctcttcttcatctagacaaactaccacctcagctggctgaggtaatcgagagtcaaaccaatccagcacctgctgggtgctaagccttgatgcctgactcaattgagggatatcagtttcccgtagctgttggtgggctgcccagtacctctccaagggttgtatatccggtgggggtggagggatcggcagaggtggtgtctcagccctttcgttcaaggagcgggttgatggtggtggtgtaggaattgctgggtcttggaaactaggggcaccaggtactgcgttgtcccgaaaccactttagttgcccatgcttcaaggcatagcgtgtgtcaccaaaccactgaatgatctcaggccgaggtaaaccagtgatctgttctaacttttggtaatcctcacgccgtgcccactggcactgtaaaaaaaaggatttaaggatagccagctgctctttggttttgcgcttggtctttcgctggcgttgcatatctggggaaaggtactctgtggggccaactctacctggtactgagttatgccgtagcccttggggccaggctggttccagatgtgggggtaatgcctgttcactgggtgacactgactgtgggacacagcctagtggctggaggggtttagaggcggcagtagctccattagccagtacctggaaagaagaagaggtagaggaagaagagggagtaacactagatgctgactcctccttacaactactggcaattaatgcaattggtgggggtttatcccgagcttgtggctgggggacggttgtggagtggttccaggaagcagtacctatgccatgtgactggttgggacccctgcctgcctgctcctttgagaggccactgctttgaagatgttgccaaaaatctgattggtaggggaatgctccactgccaggtgtcatcagggactcctttaatttctggtgactctgtggcagtggtggcatctgagagggctcctcaggctctaccttcaatcctttcgtctgggtaggcttgctaagagttggaggacctattccaataccaacttgctctggagctggcactggaggaggaggcacctcctctgggggccgtcccgcatgatgagtaaaagagagaagggatttgaaatggagttggtcccgacggtagactactcgggctcgagtctcttctatttcttcagatgaccagctaataccacagcggaggcgctgggccataaaccaagtcttgactttctccatctgcaacccataacgtaggcagagaagggcaatgtctgctaggctgggatagggaaagtagctgaaggttttgagcaggtgttcattgctgtctagctcactggtctgggctgcttgcgtccacacaagctgtagctcctcagagattggagggaggcagatgagccccgctggtgaactactgagaccgctggcctctttattaggaggcatggtgccttctgatttgtgcccttcagagatagctgcaataagaagacaaacagctcaatcactgggtctcctcttctgacacactgctcaatttctaccaaactaactgctggacaccagaacaatttaatctgtatttgtatcatgttgtattgctttttaagtgcctcaacaatttcttatttaattttcataaacttaagtcatcagaccctgctttaattcccattttctgtggaccaaagtccatagacgttaaattaccccaagccacatgactggtgagtgttgttccaagaaaaaaatctgtctttaaagccagccatggtggctcatgcctgtaatcccagcacttcgggaggccgaggtgggaggattgcttgagcccagagctttgataccagcctgggcaacacagtgagactacaaaaaatttaaaaatcagctgggcatggtggttcgtgcctgtcgtcccaactacttgggaggctgaggcaggaggactgcttgagcctgagaggttgaggctgcagtgagctatgattgcaccactgcactccagcctgggtgatagagtgagaccctatcaaaaaaaaaaaaaatctgtctttagaagttaagaaggaaaactgatcctgatatagctttttttagtgtgtatgtgtgtgtctgtgtgtgtgtgcgtgtgttttgagatggagtctcactctctcgcccaggctggagtgcagtggcatgatcttggctcactgcaacctccacctcccaggttcaagcaattctctacctcagcctcccgagtagctgggattacaggtgcccgccaccacgcccggctactttttgtatttttagtagagatggggtttcaccgtcttggccaggctggtcttgaactcctgacctcgtgatccacctgcctctggcctcccaaagctggaattacaggcatgagtcaccacacccagctggtgggttgtttttttttaaagagataatattgctctgtcacccaggccacccaggctggagtgcagtggcaccatcatagctctgatacagcctttatctttcctattcaaacccacttctagaagctatccaccaactctcaccttctaaattcatggaacaagaatcacatagtgaagactcaaccacaaaaacaagaggagcaataatttcaactggtttgtgtgtgtgtgcatttttgtttttgttttttcaagagacagggtctcactctgttgcctaggctggagtgcagtggcatgatcatggctcattgcagctttgaactcttaggctcaagcaatcctcccacctcagcctcccaagtagctaggactacaggtacatgcagccatatccggctaattttaaaattttttgtagacagggtctcactatgtggcctaggctggtctcaaactcctagcctcaagtgatcctcccacctcagcctcccaaactgctgagattactggagtgagccactgtacccggccctcagaattgtttgtttgtttgtttgtttttgagcaggatcttgctctgttgcctagactggagtagagtggcatgatctcagcttactgcagcctccgcctcctgggttcaagtgattcttgtgcctcagcctcctgaatagctgggactacaggcgtgtgccaccatgccctgctacattttgtatttttagtagagacgaggttttaccatgttaaccaggctggtcccgaactcctgacctcaagtgatccaccggcctcggcctcccaaagtgctgggattacaggcgtgagccacggcgcctggccagaattgttaataactatttttttttttgagacagagtctttctgtcacccaggctggagtgcagtggcgtgatcttggctcactgcaacctccacctcccgggttcaagtgattctcctgcctcagcctcctgagtagctggaattacaagcgtgcaccatgatgcccagctaatttttgtacttttagtagagacgaagtttcactattgttataaataaagtttcggtgccacaaaagaaatagcaatcgaatataaaattttcttttttttttcttctcagtagggcaatttacttctatagaagggtgcgccctcatagatggagcagtggtgagcacacacctggacaaaagaggggaagaagttcttattcctgacacaggtggcccctgccgctgtcattcccatattggctagggttagaccgcacaggctaaactaattccgattggctaatttaaagagagtgaccgggtgagtggtttggtggggaaaatggttatggcagagcaggaaatcggaaggagtcagggtggagaatgagtcagggcagagcaggtaatcggaatgagtcagggtggagcaggtgatcgaaaaaggttgctttacaaggaagttaagtttaaaagtagaaggcaaagaattgaacatactgacatattgattctttgaagagaaatttagaactcatatctaatgctatgttggccaggctggtctcgaactcctgacctcaggtgatccacctgccttggcctcccaaagtgctgggattacaggcatgagccaccgcgcctggccactatttttttttagagacaagttctcgttatgttgcccaggctggcgtgctatgcataggtgcaatcataatgcactacagcctcgaattcctgggatcaagtgaccctcctgcctcaacctcctgagtagttagaactacaggtgcacaacattgttcctggcttgttactaactctttggctgctaacaatttatatttagaatgtggatcaacagattgggaatacaactgatgaatatctggaaggtaggacagcactgtcctctgcccagccccccttttttctttcccttcttggtggtggagtgttgggggaaggcgactgacagtacctttaagccctaagcccaaacctgatagctttattttttccatctcttggttggatgagagacatgggtcagagattggggataaatgaggctcactcccctaaccctttaggtcatgtgaaaatagagaggggaatgtttcctcctccaagtcagccttggaacaaaggttatcccctcccccagcctttgtctcttccaacagctcagcttctccccagggagcccagaaagctccctcagtcactaacagccccctccacacagggcagaaggtctcctgagcttaacttttcagcccagctttctcctcaagaccaggtggacaggctcattataaattgtaaccagctcctgcaagctacccagcagcaccactgctcccaggattatgggtatggggactgcaggaatagcctttgactgtgctgctttcctgaaataactgctcaagttatttcccagaatattctgttgacaatttttaactcagctccctgtgtgggcactagagaccctttaacacatccatcaccctttactcttaggggaatcacatctgttatattttatttttatttttatatttttatttttattttattttattttattttattttattattttattttattttattttattttattttattttattttattttatttggagacggagtcttgctctgtcgccaggctggagtgcagtggcacgatcttggctcactgcaacctccgcctcctgggttcaagtgattcccttgcctcagcctcctgagtagctaggactacaggcgcacgccaccacacctggcttttttgtattttagtagagacaggatttcaccatgttggccaggatggtcttgatctcctgacctcgtcatctgcctgcctcagcctcccaaagtgctgggatttcaggcgtgaaacaccgggcccagccttctatctgtgtttttaagtattactcctgatctgctaaggacaggacaggattcctatgtaaatgctacacgatgaattgcaaaaataaacctcaagtccatacatttagagcaatgtgatcgcagggattttacaccatgatttttaaaattcagaagcattttaatacgtgtcaccatttccttttaacaagcaaatctaactaactgaggccacgcagaccctgaaagcaatactgcttgaagagccccttaagagggtcaatggaggcagcatggcatgacgggtagaaatatgaattcttcaataaggccaacctctgagtttgaatcccggttctgccacttatcagctatgtgatctcaggcaagttacttaacttacatgagcctggtttcctcctatgtaacaaagtgaagacagtgcagagagtacgtaagagtactacgtgctaggtgttatgcataggcagggcatagagcaaatgttaggggatggatgtccggggtgagacaaattaatgcaactccacttcctagaatgctgcttgtcctcaggcagttatttaacttctctaagtcttagtttctcatgagaaaaaaagcaccttgggccgagcgcagtggctcatgcctgtaatgccaacaccttgggaggccaaggtgggcagatggtttgagcccaggagtttgaggccagcctgggcaacatggtgaaactgtctctacaaataataataataataataataataataataataataatacaaaatattagctgggcatggtggcgcaactgtagtcctagctactcgggaggctgaggtgggaggattgcttgagcctgggaggtggaggttgcagtgagtcgagattgtgcactgcaccacagcctgggtgacagagaccctgtctcaaaaagagaagaaaaaagcaaaaaagcacctacccagcaagtttatgactaaatgaaaaagtgcacttgacattataactagaacaaagtaagggctcaataaatagcagcttttatcatgacttcaacttcatggaggtgattttgatgtgaagtaatgctcctcctagacaatggggtaactgggacaaagactgaatcatttaacattcactgttttcaatctatttttgcagagccctaattctagttagcgatgaggaaaccagtgtatctgtgattctatacttttacattttggggtttaaatacaatttcagaatgtatttgccacttaaaaaaatgtatgaaaaccagtgctttagaactgcatccataatttggatcctttgtgatcggtgtgtcagttgcctatgtgatagttccacctttcgccttccaggttcatccaggacacagctgaaatggcctgggaggcactgcttgcatggccaggtgctaaactaccatttacaaattgtggcccaccgagaacaccaccaaatccaagctggagaacactttatgatggcaatgcttgacgtctacttaacctcatttgtgtcctattatataaagacacaataacactttagagataaggaaaataaagcataaggaacaaagcagtccagtgtgaggatgaatactgccagatgggaatataaggcaggcacatttataagtattaaaagctgtaaggaagcattttactttcgtttaggtggcttgatgtccttcacattctcggcatcagcttgatatttcagtgtaacatacagtactgcaaacaacatatttggtgtactatatgcattcagttttcacttacacaaaacaccagttatggaacacttcctgaaacagaatggtggcttaaatcaaggcacagctgtatagctggtacttccctggaagaatctggctttgaactaagagaaaaccacaaccagaatggctcatgagaattataacaggtagggtagaccctatagtaatcaaaatcataataaagacactagagtatcttgtgttcttgtgtgtccattttggattgagtagaaaaagaagagaatcaaaagctgaagtgaggagtcctagcgcagaggaggtagtggtggtggtggtggtgaatatctattctgaacaacttctaaatttgtatccttattaaatatgccagatatgtcccattgctacttaaaaatcactaataaaaatatatggagtcatggctgggtgcagtggctcatgcccgtattcccagcactttgggaggcaggaggatcacttgagctcaggaattcaagactagcctgggcaacatagcgagacctcgcctctacaaataaatatataaattttaaaaattgaaaaaaaaattctctctctctctctgagacagtataacacccttctttccccttgggctttccatatccctggacagatggaagacaagaacggactgtcttaaacttccagtttctgtgtttacacagtcctaggaaaaagaggactctagaactttaggtttgaacctaggcttatcgttaaagtaggagacagttaaagtgggaggcgaggctgggtctaatggctcacgcctgtagtcccagcactttgggaggccgaggcgggaggatcacttgaggtcaggagttcgagaccagcctggctaacatggtgaaaccccgtctctaccaaaaatacaaaaattagccgggcatggtggcatgcgcctgtagtcccagctactgggaaggctgaggcaagagaatcgcttgaacctggggggcggacgttgcagtgagccaagatcacgtcactgtactccagcctgggggacagagtgagactctgtctcaaataaataaataaataaaagtgggagatgagatatgatcctttagaattccctaaatctttatttagagacaatctgaagcactcctgaaatgtgtttggggatacagttttaagggccttaaagacttatagtgatattcagcttatatgcttcttaactttttagttcatgaacctctttgagaatcagacaaaagttacagaccctcagaaagttatgactaaccttcccaaaataaacattcacacttacacaataaactcaggggctttagttgctgccaagaagccaggttaaggcttactgcctcatatccttccaacttaacaaaggcaatagtgataatcacttaaagatgaacagtttgatgtgaatgaacgtaaagagttgatggaatactcaagaattcaagtgcgtctagaagggacaaagtatttgtgatattagttggaaagagtggaagggagggatgctcaactgggccaggagcctggcttaactgagccactggattacatgaccaatacccacagtacactggaaactaaaggctaagtaggctgctactagtgcgccaaaatcatctgcttcattcagttgtcctgtgtcctggggccagttttgtgtgattacaaacctgcttatgtccatatttttcagtgtctatataataatgtaattaaacctcatgttaaacctatgaaaaatcactgcattaaaaattgtttcttcaggaatactgatttttaaaaaattgctcctatgaaaactaagtcaaatgttttggagagacataacgcaaggaagagtatgcattttaaaaattgttgagttgggagtgagcaagacaactgtaaaagattgagcggtgggacttaatctcaaaagtactctgcactcagaagtgtctaaattcatacttcactttaaataaagcaaaacgggaaaccaaagatgatgaaagtgcctgagtggctctcagactgcacactagaattacctgggaagcttaaaaaccaggccaccctccttcccattcaggttcaatagtctgtactggggtccaggcatccaaagtttttaaaagttctcagggtacagccaggtttgagactccctgtgtagttaatactggaaagagaattgggaactctgaacagcagtcttagacacaaaaacagtctcaccactacatcaaaagattggtgaaatggatatacttttaattataatgtttaagatatgtatgcattatctttaaaattcccaatctggctttttcaattactaccaactaaccgaatcatgtaatataaaagggcttcaagtgtatgatgggaaggaggttcacatgacaaaaaaaaaaaaaatctcctgataggggcccacattaccaaacaggtctcagcttgagtcttctttcagtttaggagtctcagaataggacgcaacactaggaaccccagaggactcaggttctcagtttcctggttggttctcttagtatggctgggtacgggagtcagaggggcagtttcttctaaacctttcattcccaaaggccactgatccccagaagcaaggccaggttctgcacgtgtgttgaggtcgccaggaggtagccgtgggggttgggggtttgtgtggcgggggggcctgggaaggaaatgtttctcctatcctccatttcacaggcagtccagaaggctccgaactgggtcagggaacaaaaagttattgcacttgggacgataagccccatgaggcaggcgaatctcaatcctactctcgccaagggcgccccaacccaaccttcttgccctcccctacacagacactcaccctcccctagttacaacaggggagggaaccgaaaagtccagaggagaaaaaagagagaaccgggccacttcgaacctagaattatccccccaccagcgcggggatggggctccagaggtgggagaccgtacacgagctgggaggggaagtccaaggggctggggatcactcaccgcagtccagcccgggcggcggctcccagcctcgcaccatgggccggggggaagtgggggagagggcagggggcctccgagtgggagtggggttgctgcccggtgcggccgctccgagcccaccccagcgatggccgaaaccgggactgccccccccaccgtccccgggagcgcgccggtctacccag
